United States Patent 6,812,339 (POLYMORPHISMS IN KNOWN GENES ASSOCIATED WITH HUMAN DISEASE, METHODS OF DETECTION AND USES THEREOF) - sequence listing, part 48

SEQ ID NO: 14720 - DNA, 390890 bp, Human
  misc_feature (1)...(390890): n = A,T,C or G
tctcctccagagctcccttgtgaagcttcaagtagaccgtgagctttctgaggacagggtctgaggcttaacccctgttcgtgcagggcatgaccccctgtagggggattacagtaaacacagtttggctgaaagtttggcttcacttcacagtgacctcagccaccactcaggagcatttggcctgacagccagtttgctgactccccaaagatatcgctaattaggagtgctgttgaggtggtctgggatttacaaaaatattttttctgttaaaggatcatttccaattgaccttaattaggaatctgtaataatgaagagaaacacaattttttctctttcctttttatacatgaagaaagtcagaagcataaattccagattatggagttcagttccccttgatcatggatttgtgcttttgctgagtgcagacagtatagagttttgccacttgcctaatataggatagtcaaaagagtctgctgtattaaattgggagcactcttatggaaatatctgtaaacaacttgtggatttgtgcttcaagaaatttgtaaaattctctttgtagttgctaagatacaggaaataacttttagggctagtatgatacactgccaaggaaaacattttccaggctgtccgtctttggtcacacacgtgctaggtgttgattcctgtatcatactgtaattgtggtggcctctaagcctacttttagcagtttgaaggtatctgttttctactacctatgagatatttacttatccatatcagtaccctttaaactagaaattaagattagtttactattaccttgtctgtatatggggggtggggcaatcacatggggaatatgtgttcttatagaaaaaaatcatcattgtcttgtttttcctacattccttacaaattttacagccatatttcttgatcatttatgccattagaaccatgaaaaagtgatatttgaaaaggtatcatctttttaaatacaattaattttaaggaaaatagtggaacaagcatattatataatgtagtcaataatgtggctaaagtggatatttgagttgactgaattttatttttgtgatagttatttgtcgaatgagaatgactctaaatatcaacacatcagtcaaaataaagtaaatttgttatgttgaactcacagttttttatgagaaaaatgaaaataaggtttgaattttctgtattactactcttttatgatagaatactgagaatttacctttattctagattgtaatctattccacaagcatacaaaatcattagcatgtggcgaaactgttgagttcttccattctcctcattgaaaataaaacgtatattttgcttcttgacttagagatatcacaactataatattcctctatgattttctatcttgatgtttagcaatagagtcaggactgtaatcttggtttaggtgttttgttttgctttatgtttccatcatatcatattgtctttcagattttcacatcatattcacccaggtatttggaaacttggggagtggatgactctaatggtcagctgggatctacttcctggatcactttggctgtcaaatatacacagcaccaatgtgtattaattgtgcaaagtcagataaggcagtgaaagtcactaatctcattctatttgctttctaagaccaggtgccccattataattaatccatgccttataataccacaattacatgggtttgatttctttatacactggctatcgtagtctttaaaaaacttaaattaatgaagaagtggatattttaactgagtctagataattatttgaaaaggatgttatagagtgaatggagagttggctggaggacggactatatgacttttaactgttctgtataatcagggattccaagattcaaaagctgagctataagggaaatctaagaaatgctagtagccttagttacagtgtttttgtatgttggtttgtcacagactgccttttcaaggtgtgccctatgaacagatattctgcccagaagcaatattggaaagcaaagcaagccaaacaagggaaccacaccgaggcagccttgctgaagaaactacaggtaaggaccaggattccaattgtctggcttaggctaaccaagtacagcaataataaaaatgtatttagagctttctagctttgtcctttcacccaaaacacagagatttagaatacatatagcaacacattgaaagtagaagggcttttcaagtaatagggtgtgaccatctatttcctggcatgtaggtagcacattactgctgctgttttttagggtgtgccagactaattcaaagcttcccatcaaaatgaaaaccaattcagaatctctgtaagaatattaaatccagttatattttacttgacataatccttgatatttttcctgaaagaaactatggagaaaaataattgaaagaccattgtttatggtttgtctgagtgtaaattcgatagaacttaattttgcctcattaaaattcctggtactttcagaattaagaacttttatttttgagactttggaaattctactattatcctggttggtttttctagcaatataccttcttaaagtaattttaaaagaacaaagagcctagtacttttctgaaatgtccaacataaaagtggcccaagacatgttggagggcatttcagcatacattgacaaatcatcacactatattataatcatttatttaattactgctccctttggggagtcatccactccccaagtttccaaatacttggatgaatatgacgtgaaaatctgaaagacaatatgatatgatggaaacataaagcaaaacaaaacacctaaactaagattacagtcctgactctactactagcctattttattcctggctatagtcttgttcctaaaaaaaatttctttgtcagttattacactctgtttactatatttctacactgaatatttgataatcatcttatagcacgctgcagaactggaacaaaaacaaaatgaatcggagaataagaaactgttgggagaaattgtaaaatacagtaatgttatacaagtaagtattttctcttaaacgaggtgagtattttatgtggagtttgtcagtaagttggcaggaaagccaaactgcgttaaaattttgagatacaggaagtttgttctttgatgggaattatcgatgttgtgacgtattgtgatgtattcatttgatatgtgctgcactattctgtatgtttaagaataaatctgattttacacataaagaagtgatcttatctggatgtatacacaagttattacatcaaaaagaagagggtcaggaaacaatttctaaaggcctgttctgaaatagtcctttagattaatgggactgtgtttaacatacggagcttagcttttcattttgtgaagagagaaaagttttcactttcagttggaagtcatccttgaattgttattagaaggtcttctatttctattagtatgcacacactgttttatctcagctgcattcctttcctgtgtttcacttagatctttttagcttcttacttggttatttgttaatatatgccccacctttttcaaaaaagaatgtaaggcactttccaaaatacagagctacatagtgagataaaatacaaataaataaagcaattggtcacagggaaaatcatggttggatgaataaattgaaatcggggtaaggcatgtttataaaaaccatgttgtaaagtctggtaaattttgacttgaaggctttttcttgccctcttagccatagggaagcatagtctgttacatcgttggctaggagatccgcagcacagagccaaatcagaggtctagaagcacaactgttcccaggaataggaccagggaagtgtttctcctatgtgtgctcataaagaggacactgtgtaatatagtaaacaatagccttgacagcttccttacagtaaatgctacaatgaggcatttcatagagctgtcttttaaaataatatccctgatattttgttactggccaatggcaaaatgccagaacacagggcagtcaaagcagtgcactgttgggataagatgagagaagctgggtcggcagctccctgaatgtatgacttaatcgaatgatggataatgtgaaacctgcaacctgagtgggctggatgtccctggggcaatccttcataaatagagtttctcttaaccaagtttcggttaaatgtcagcaagtggaacttatgtttcttgtcaagtacccgaagcgcaggtgttagcttggtcagtgaggggctgagccatgttcttgaacatggtggatcccaaagtccagcccatgagggtttccattgctttgtggtaacataaggacccaagagtatgataatgagcattttaaaatgctgattttttttcaattaaagaaccgtactttattttgagataatttcttacttatattgtgagtactaaaatgaccattgttttttgaaatgattgtaataatagatggaaaggttattttgttttggttttgctactcagtagaatcatgtttttgtaagattttgttcacaaagtccaaaaaaatctgagaagtgatgcttttacactcatctgggagggggtagggtcagcatcccctggcagaaggtgtagaagcctatttaggatgagcagctgcctccttacagaggaagaatcagggctgactgtgggcagggctggttaataatagtaagtgggttggtgcattatttgagtttcttggcctttctttagtatattctgtttttgtggctatgcaggcattgagaaaggatgtggttttggggaaactcaaggtctcctttggaaaacctagttttagccattatttatcagtagatgaaaatcactcggaggggtcccctgtttttttttccctattatgccgacttcattatgaagcagaattggggtgaaggggaggaagaacccaaagaaagtcaagtaggaaagatggtgagtgtggaggctgaaaatactcctttgtttaattttcatctcaagccatgttagatgaatatatgatacatgtataaaacatatgaatgtaattaacagaggagaacaaagaataaaggtggtaatctatgtcttttccctatagctactgcatataaaaagcaacaaatatcttactgtcaacaagagattacctgctttactggagaagaatgccatgcgtgtgtccttggatgctgcaggaaatgaagggtcttggttttatattcatccgttctggaaactgagaagcgagggtgacaatgtatgtaatatacaattaagagggaaatagtgggttcataaagaaaatgattcctaataagtaagataatccagaaagtacaaaaaagaaaatatagtttttactcaatacctgatttttatgttagtatctactaggttaaacatgtttatttatagtacaaattgtgctcagaagtcataagacaaagttcagattaatttaaaatcttccagctagaatttgtatgaaagaacttaagcaaccttaatattggctgagacttttaaaagagaaggagaatttacttttttgcctaattaggaggaagcttggtcataaggaaaaagagctgtgtttaggaaatagtgtgtgccctttgaattaatggagtgacaccgtgattcatgacaggattccatttactggctgtatgccagctgctgacagtctataagtcttaatagagatggagtagaggagctgaaggttggcatctgctcattgatgacaactatgtttacaatatgttgtggactagttggggcactgaggcaggagaatcacttgagcccacgggttcaagaccagcctgggcaacatagcaagaccttgtttctaaaaaaaaaatttttttaatgttgtggaatatgtgtgtattgcacataaattttagtagttgctgaaatattttctgctactttataaaatagagaataaattatgagaaatagtcaataggatctagagtgtgatatttttgcatgtaataaataaaatactgcgtgatagtccttagcacatggacgatgctcaggaaatgctgctagacactgagcgctgaataagtttcataaatacctgcaagtattgcatcaggggatcaatagttaagatttaaaaaaattaacatgaattcgaagcaatataaaagtataattattctgagagagttttttcagttgaaactttgattacattttaaatgtgttttggatatttcttgtcttaggaatgtctttatcgtgaatctaatttttccagtgaattttgaaatacaaattcaattccacaggatgcaagcttctggatttaatttggttaataaattatctggtgatatcttcctttggtaaggtttggtagaagcatggcatgcaggaatgtgatgcactttaagtcttgtgttggttggatttcttaaaaaaaaaaccctacttttttttcttttgacatcaggtgatgtgtgctgtgagcatgatacacattttagtttcattaaatagttcattacaatcaactctcaattgttcagggactgattatgtagtttatgaacaacctgtgcctttgaggctctttcttgcaatgcttgttcccatccccagccctccactgaatagtatccctgtctacaggaggtccatgaaaattaaatatgaaaacaaacaaaacctgagctcaagctcggaaggaatgtgatgaaataattgaatgaattggagtttttaaattagccgtggattatattaattcatcctatctgcttatttattcattttatctattcttttccttgctgcctttacacagtcaacagagagttgaatgtaatgaactatttcaaataattagttgtactggaaaaccaaaacaaaacaaaacctaccacccaaacactcaatcttggtgaaaatggacaatgtaattgttaagtgcaatacaggagttcttatctggatgtgcttcagaaagcatggctgaaacaactttccacactgctttttgctgaaacagctcaccgtttttgtttgccactgtgtagcttttgtgtgtaattaaggttgctgaaagcataagcacacccacaaccctatattggtcacataaataattgtattgtaatactcgtttttttccctaaaataggtagcgtatttctaaaatataaaccgactgtgtggaaggcaattggaaatacggtcacttcataaccagtggttcaactactactgattttctttaaaaacacattaaattagaaaaaggaaattgcaatgtttagaggacttttaaaatgatattttactatttaacaatagatgaggttttaagatgatattttaagatgaggttttaacatccaacaagatgttctgttacccaaatgaaatgcaataaataggctgacgatagtctgggagaaaggaaaccctatcttcaaaaggtaatagttcctattacttaagggcaactttatgatatagcttatggaattgtgggatggatggttttggggaagaaatagactcatggatccctgtactttcagctgtatacaaagcccttggttgcagttgaactgcaaagtcactagggacagctatgagcagagaacataaatatttcatttttctttccttatttttttatctttatgtatcttcccatggttgaatagttaatttttcattttcaattttgatctaagaaaacttgggttctttacttttatggtagattttaaaagggaataaaggtcagatattctttaaatgaagagaaaattttaactcttgaaaaaagaaactcttcaaacagcaagtagactttgcgttttagaaaaagtgtgtgcccaccagggactgttgtggggtggggagagcggggagggatagcattaggagatatacctaatgctaaatgacgagttaatgggtgcagcacaccaacatgacacatgtatacatatgtaacaaacctgcacgttgtgcacatgtaccctaaaacttaaagtgtaataaaaaaaagtgttgaatttctagctgcggtggaactagaaccctggcgtttagattcctattgtgatgttcttttcaccataccaggtgccacttcaaaagaagggtagctgctagtgatgttatatccctctttattttcagcgaaatctcagcttgaatcttacatggctcttacatagaatcaacagaagtgcttttggaattgcaatttataaaaaacatgtttgtgtactagagtgaatgtgatggcttatcctaggatgtggcagaaaatgacttcaccctcaagttctatattaaatacatagcttctcagaaagcacctgaccccatctgtgaatcacgtcctgagcttcactattttgaaaatattaccatatttcatatttgctaagttatctaattaggtatgaattctgtgagaatagggactatttcttagacctttttgttttctccctggaacttcttaatattctttttatttcacatgattggtagtttatccatttcacttgcaagttttattcagcttggttaggcaaggtaatcattgtcaagaataagaatgaggatctgaaaattactgaattaatgttagattctacttatgaataccattttttaatgaaccactggaagctgtttcacagataccaaggaacattttggctatatgattggtctcttaatatatacaatgttaggctgggcacagtggttcacgcctatgtaatcctttgggaggctgaggcaggtgaatcacctgaggttaggagttcgaaaccagcctgaccaacgtagtgaaaccccgtatctactaaaaatacaaaaattagctgggtgtgatggtgcacacacgtgtgatcccagctacttgggaggctgaggcaagagaatcgcttgaacctgggaagcagaggttgcagtgagttgagattgtgccactgtactccagcctgggtgacagagcgagaccccatctcaaaaaacagaaaaaactatatatatatacacacacacatatatatatactatatatatgcacatatttgtatatattatatatttaagtctatatatatatttaaaaccttatatatatatacagttttatgggtggtattttgaagtaaatatacggattgacccaaagcttacagacaactatagtaaaatagcaagacttagagcagcgaatgtaggtgcaaccaaaagtattcttgaattggaaggacatagttaaaatatgtcattatatttagtaacttattggctaggatttatatggcacagatgagaatcaaatagtaaaccaaatccagttgttctttaagaaattggaagttgagaacacatggacacagagaggggaacaacacacaccagagcctgtcagggggtggggggtgaggggagggaacttagaggacgggtcaataggtgcagtaagccatcagggcacatgtatacctatgtaacaaacctgcacgttctgcacatgtattctgttttgtttttttgtttttgtttttgttttttagaagaaataaagaaaaaaatgtaattggaagaacagatgcagcactggcaaaatgtggcatcaagctcccagtactttagagtatggatgatgactcaggcctctacatggctctgtgacttggagctgccttgctgtcatgtgcaacagcacgtgttttcctagggagaatggggattgggaatatgcttatgtcatgttgactttcatttgtttttgctcataatttaatttttaaaagggataccaattcatggttcaaagatagaaaacaatgtaaagatatattgtgaaaaatctctcttctactctttttattccatctgtccgatttctactcttcttcttcctcaggtatgcactggagagatttatttatgcagatcctcctattccctccctcacatttgtacacgaatgatagcatactacatgccttgctctgcctattcatcttttcacttaatactgctccttaatgatctttccttaactgtatatagagagcttctatgatgaatctttgtgagttacagcatctgacttcttatggacgtgatgagtagagaccagtcctgtaaacagcaggagttgtttccacaaaccaaagcacaacctttctttgtttggttggtgagcttgaggcttctctattatatttcaatcgccagatatagtttgtgacaacagtaccatatgtgagcatggactcctccgtatcatccatatgaggatatctgatattgaaaatatgaaattatgttttttaaagtttgggcttagattaagatacactacatggagaagttctgtttattcatatcgactgaatcctgatttgttttatcatttatctatcaaactaatttattctaatatttacttggtataaaatatacaaagggagggttttggttttcatttttgagacagtgatcaattctttaagtgagattttatttactataataatatgtcttctaaataaattcagcaatgtaagtaactttaataatggaaattaaactgttcattgttatcatgaagaaaggataactttgattccccacaatttgagttatgaataaaaatacttaaagagaaggtggatattgctacaataacatacattaaaaaatcaattagagttacttctgtagagcacttttccaagaatcaattttagtttttatttaaaaatgaacatcaggtttaaggagcaatattagtttaatatatttaagatatgagtgaatcggatgcccaaggctcaaacacaaaacatatttctacaaggtcatacctaattctgcatttcctgaatcgagctgacattagaatttttaatacacttctgagactatgggaagatcaaatttactcatctcttataaaagataatacaagtgtataacattttctgcttgcttttgcagtggttctaatatttggatagattacttttttgtggtgacagatgcatttactctttctgttgtgcttatggcataagacctcgtggggagggataatggcctatttattgactttaaggaagctctaactgaaatgggagatgaatatgaaaaagatccacactagctttatgaatccagactgataggcactatgggacatggttatatgatcatttattagaagatattttacctcaaagagaaaaaggattgtatgaaaatttgtgtgaaggataaaaggaccagatgtcagatcaataatggggactcctgtgcagttatttctagcttcgaatatagcaccaaagatccatgcagtgtctcaattgtgatttatttctgcttcctagattgttgtaggagataaagttgttttgatgcctgtgaatgcagggcagccactacatgccagcaacatagagcttcttgataacccagggtgtaaagaggtaagttcaagtggaaaaggaatgaatgtgttcatttttctcatgagacagagggagaaaaaagtaatatagtttctttcattgttttcatgagcataatcccagttattctaattaatatccctaaggtacatatagctgtgattagttattgctatttttggatggtctctcaaagatacttgtattgagctatatacttcattatccaaaattgtctttaatttccttttactagttgaactaataatttctggtagagaatggaatctgtagtcttataactttgaacgtttcttcattaataggtgaatgctgtcaattgcaacaccagctggaaaatcactttattcatgaaatatagttcctatcgagaggatgtattaaaaggagtaagtatgtgctacacaggacatttgctgggagaaatgatggtagtcttactgaaattctagatgcaaaacctatgtattcactggtgttcataatttagaatgtgactacacatgttaatacttactctaagtgttttactgaatttcccccccacatttttaaatgtttaaataagcattaaataaatttaaataagctttaaaagtcaaatagctagtagaagggcccagagtagcaaaaccagaaagagacacctgcttctcacatctgtttgttcagatgtctcttgacctttttgctagggggacgttgttagattatttcatgcggaacaagagaagtttttgacttgtgatgaatatgagaaaaaacagcacattttccttcgtacgaccttgcgccaatcagctacttctgctactagttctaaagcactctgggaaatagaggtatgtaaatgttttttggcacttaataaatatttagatcaaaaagagaagattcactgggcttgttgttttattgttataggcatcatttatgatagaatcataaaatagaataatttttgtgaaccaacttgtgcctattcattgctgtgaccaatttgaaaggaaactgtttcctaagcctgtcttctctgtggtagctctcattttctctctctccttctctgtcaagtgcacacacacacacacatttacaaaaggtacattacgatcttacttttaacaaatcaattgtgaaatgtcaagactagttagactgaagaccatgtgactcaaatggcactggagtcaagatggagtaggatgcctcactttgaggaaggttgaggccagaactactcagtccctgaggagaacaatgtttatttcttctgtagatgccatttctattggaatcaggagacccatagttaagaattcattcatctttttaaaagtatcacttaaatgtggaacatggtagagtaattaaggaaatgtaatctatggatttttccttaaaggatctttttatatgtggaggagataagatctacagaattgcctatgaacaagagatttactaaacatctaaaccactagcggtgattctcaaccatttcaaattcttcacctgcccccaattttaaaacatatattttgtgacactccctttaatattctaaaatgaaatttataggtaatattatttatatactaataggtagaattagtataatgctcaaattctaacataaagaataaataaaaggaaaatactttataataaaataatatgtatttcaacatgagaatgactatctaaaagatacaatatttatgcccatcttggatggatatgtttggatttgagagaagtggttaaagaagtggatcagaagacagcccatacaagtacaggaaaatgaaaaagcaaaggtaaatgtgggcccttgaatgataaccagtgttaggagacgtaataacggaacaaactgaaaaacggagagataaccataatcaaagtagggataatactttaggcaaattaccgacgagatgcagaaaatgaggaagtaagatgcctctgcaaatgagctgagccttatttataaatatgacactaaaaaagaactaagtttatgacatggtttagaatcgagatgaaatagtacaaaagaacttatcttctatcttgaaactccacaacatattgaggaataatttcagtcgctagcatgcagatggactttggagaccacaaccatcaacaggtgatggaactgagaagctctggggaaaacagctatgactaaagctaataatacacgaggctgcatgaaacacctcccagaagtctacctcattcataagagcaaaactgaaaaataacaggcaatcctaaaataaatacataattaaagcatgcattttcacaccataaagttcttaatattttgctgtttttaaaaattaaaaaaatatagaggtagcaataagatgagatattatttaaaactctgttaatgaaatacagtgagttacctgcatttgatgtgtctctgcttatttaatattggttctgagtctgttaaaaggagttttgaaaattctctcatatttttgcttttagttttatagcttttgctgtaactgtactactgcagtgaaccctttccatcaaaatgcatagttggaaatgctgtgacacattgaccagaatagggagcgaataaattgtttaataattttgagatgtctttacttcatttaaacgtccctcaccgtaatgaatttcatataacttgatgtaaaatgtttttatctgctgatgtactaaagtattgccagtttatatcggtggtaggcttatttctatttgagatttgagggacttttctctattgtgtgctgtcacagttgggctttgtgaggaagcctgaggactgtgcttacccagcatgggcatcaggtgtttcaaggaagagggaaattacgttcaacatgattggaagggctggggaggaaatgtggagtgggggacatgggcttatctgaatgcagataagcaatgcaatgactgctcctcctctgagcctgcaggcctctgctcacatgctgaggggtccttacccacgcaccttgtaggagcgggcactagtcagctgctcccactgttactgcagcccaaagaggagtctctcttctactgtcctctgctttccattctaacgggaatgtcctcagagccccgctgggtgaggctttcagcccctgtgatgcaggggagcacttagcagggtggggctggtcctgagggccacacacagtgttgatcacattctggaattccctgtaaattgcagcatagataatatcttggtcactgcatattaaatgccaatagcatccctccaaaatcattgtgataaacaaaaacaccctcccttccaaatctctagaatatcccctctagggagccgtactgcccttgccagacccactgatgtataggagagtagttcttagtctgggatcttcagatcatttgttaaccttagcatttatatacaaaccacaaaattgtgtgtgtgtgtgtgtgtgtgtgtgtgtgtgtgtgtgtatttgagacaaacattagattttatcacattctcgcagatatctctgcctccctcaaaggtttaagagttcaaacactgacaagatcacagtggccagtgtgattagcaaaggatttgtggaagaaatgtgatgtgagaatttgaaggataggtgggcttttggccacagagggagtgttttgtaagacctcaaggactttgaagtattttcataattattatcttatctgagttatgagagtatgggaagacagttgctggagtctagcaaaaggcattagcaagtgaagtatgttaacacacagaattcgtggttgcagcaggagccaaagggtggtcagtactagcaaaaagaacgtaatgtgctgagggagagtcatgaaagttatcctagcattgtgatatgccttatgatatttcatcttcacaacaatcctgtgaatcaacccattttgtacacgaagaaataaggctcaaagatgttaaattcctttctgtggtcataccccagtaattggtggacctgagactcacatgcctgaattggagtgtaaaacccgagcttttctgctgcccatcccgcctgtcataaccaggtgtgtcagagcttctactgcattcattcccagtgagcctaggggctcagcatctgggcaaggtcaattcagagacaggtatcaaaagacatgctgtcaataaaaagcatgcatggaaagggctaagaattaagtagtttagaccttaggccttgacgtttgtgattctctcttccaatctacgtggctgtctttctcatcctccaggtttcagctcacatgacatctcaaagtggcccatactcatgatggtcatatctaaagttgccttccctagttactcaatcatgtacttcccctgtgttgtttctggcacttgtcaaatcttacttatttctttgttcgctggctctctcttttccattagaatggaagctctagctttatccactgctgtgtttctcttctcttgaaggtacttggcacatagtgggctcttaatgcaagctgccaagtaaatgtttgaaaaacaaagggaagaaaatctcagtatttccactttggtcttggaaacatgtctttctgagtaaagctgtgtttgcagatgtaaggcacaagtgtcatgcatgcacgagttaacaactgttataacatttctcttgctcatttatggggaattttgtttttctgccacattatgctctcatggaaacatatattaggtttgacagatcagtattaacaggagggcaggcatgtaaactgttggtgtttgcttgccaggaacataaatattgttttgccattactatcgttgctctctttgtaggtggttcatcatgacccatgccgtgggggtgcaggacagtggaacagcttgttcagatttaagcatcttgcaactggaaactatttagctgcagaggtaagactaatggataaagtggtattaagtttctgactctgaattagtgaaagaggcagttgggttcgccacaagacatcgtatttgcaggaacagtcattacacaaatttgattgttgcctctagtattctggattggcatataaattatttttaaaatgtaaatgttagtcaaagtattacaaattaagacaacaacgataataacaacaaaaactctgcagttgttttactggaaggccaactggaatggggcatctgatttgcatatgtatgtgatgtggcctaaaattttctatttagcttcaccctttcagaatgtccgcatcatagatatgatcagttcattgcccgtgtcatatagcctagctagctttgggttcatctgcagtggcctctttcactgtgggtggcttttattattcaaatcattgggaaggaaaatgttttcttcgtaaaactgtcaataaaatggtaaaaacgtacaaaagctttttctttatccactaaaagtatgttgacagacagatatgaaggatgtcagaagatatgaaggataggtagaaataacatcatggaagttttacaaatgttttaattaaagtttggttatctaattgaaaaataattttgaagctagtcttttccagatgtatgaaaatttccattcatggaactgtgctgggcacttagcatttgatgactattttgtgaatggatagaggatggggagaaggagatttcaggctttgtatatgagacgcatttggagacatattgggcaaattaatcacactacactccaatttcttcttctggaaaatggggataatcaaatatatttctaattctcttaacttattagaattaaattaggcaaagtgcttgcagaagttgtggtttatggtaagcacagggtaagtgatgctggcatgactaatttttgtttttgagacagattcttgccctgttgcccaggctggagtgccgtgatgcactcaacctatgcctcccaggttcaagcaatcctcttgcttcagcctcctgagtagctgggactacaggttcacaccaccatgcctggctatgttttatattttcagtagagaaggggttttgccatgttggccaggctggtctcagactcctggactcaagcgcctgcctcggcctcccaaagccctgggattataggcatgagccactgtgccctgcctaattttatgtgataaacagggattatttttacttttttaagtatctaacacattatttagtgctcaactagatgaaatacagctttgcaatttacagtctgtttatagcgtaaatgttttaaagtaacccttttgaaaagcaactcattgaagcaaaaatcattagtaaggtagagaatcttgtctaaaataaaaattacaaaagcctaactagatatcctataaaagataagaaattaggattaaaattctcttatgttagtggctcttttcccctgttcacttttcaagcaaatctactgatgtgctgtagaaaactgacatgatgtacatgtatattactagttttctttgttaatttctataattaaaacatgtaccatttgatgcattcaaatgattagatttttaagaattaaattgttcattaaccttagtgaggatccaagacttcaatatatacacgaattaattaaaaatggagaagtagaaagcaaatcattccttgaaaagatttgaaagactctctttcatcctgtctctagagaatgcagctttaaatgccaggtgccgtctcatccattaaagagtctggtgtatttagaggaccttttctttgacctttaatactttagataacatcttttttatggtctagtgggaggaggaaaattaagtattaagcacatatctgaaaactgaaagttacgaatttattttctactgattttaactagtgtaacagaatgggtgctctgtgtagtgttctaatatcaaaatagcaatcatagcctcaaaatcctggcatccatacattggtgttttgtattttctatgtcagttgggacaaaatcctggtgtgctcatgtctcaggatgcttgtccttactggtgtgaaagtgtctagaggtgtggccaaatcacaatgatttctagtccaggaacagctggtaactagcctctgacagcagttgagaagcaatgattacacgtttatcattttgctttctaaaaatgcccaggtctttatttctttcttaaactttttaatttttatggacacatagtatacgtatacacttatggggcacgtgtgatgtcttgatgcaggcatacaatgtgtaataatcacatagggtatttgggatattggtcacctcaggcatttatcatttctttgtattaggaacattccaattctactcttttagttattttaaaatatacaataaattgttgttaactgtgtattaccctgttgggctatcaaattctagatcttactccttctatcgaactatatttttgtacccattaatcacctccaccttttctctccctccctgtcacccttcctagcctctggtaactatccttctactccctagcttcataagttcaattgttttaatttttagctcccacatatgagtgagaacatgtgaaatttgtcattctgtgcctggcttatttcacttaacataatgtcctccagttttatccatattgttgcaaatgacaggatctcgttcttttttatggctgaataatattccactgtgaacaggtactacattttctttatccattcatctgttgatgtatacttaggttgattccaaatcttggctattgtgtgtagtgctgtaataaacatgggaatgcaggtacctcttccatatactgatttccttccttttgggtgtatacctagcagtaggattgccggatcatatggtagctctatttttagttttttgaggaaccgccatactgttctctatagtggctgcactaatttacattcctaccaaccatgtgagggttcccctttctccacatcttcatcagcatttgttattgcctttcttttggataatagtcattttaaacggggtgagatgatatcttattgtagttttggttggcatttctctgatgattaatgatgttaagcatttttttatatatttgtttgccatttgtatgtcttcttttgagaaatttgtattcagatcttttactcatttttaaatcagattattaatttttttttttgtctgttgagttgttttagctccttatatattctggttattaatctcttgtcaaaaaatgcccaggttggccaggcgcggtggctcacatctgtattcccggcactttaggaggctgaggcgggtggatcacctgaggtcaggagttcaagactagcctggccaacatggtgccctgtctctacaaaaatacaataattagccaggcatgatggcgggtgcctgtaatcccagctacttgggaggcagaggtgggagagaattgcttgaacctgggaggtggaggttgcagtgagccaagatcgtgccattgcacttcagcgtgggcaaaagaacaagactctgtctcaaaaaataaaataaaataaaatagcccaggttttttatttcaaagcattagtcatgtcgttcaagtaggacgggggttctctatattttgagtgacaacctcctagaattatttgttttattaccctgtacccttattcttaggcgatagaggctccatggcacagatttattttacttgttcagttttctctttaatatctagatattatttttaaaaagacacatattgggatgtggggaatgcaagaattgggaatgattatttttggaattcataaaattgcaaacatagtctttaagatttcatgcaaccttcaatatatgtttcttcagtgcctggtaaatgcacagcatggtagaatgctgcaggtacggcaaaggaagctgaggactcagtctttgccttcaaagaatggagcttctagttcggaagacagcgcggcacaatcagggagggctaattatatgtgcaggtagaattgggtcatattccagtgagagaatctggtgtgaggttagttgaagattcttgcttggggcaaactggttctcaaagaaaataatagacatggactgttagagaaataaaagggcggtcctgtgtaagttgctaagaaggcgcatcagagatacagaatgtccaaatcatacatagacaatattaaaactgaggcccagcccaaggaaggtgttgtgaaaggaatgactgacaggtctccttgctttaagattttgaatgaagggtttgacttttatccagtttgtaataggaatgaagtttgaggaagtttaacttggtagctacctcgaggctgggactgatcagctattagcaggcctttggtagagatcagtgatgtcattaaaaaaatcccagtacagtgtgatacatttatgatagcaatatgaatagtggcccacacttttctcagggggtctcaaggatgtgcaagaaatggtcagggggtcagagaggttgctgcttaatgaatgagtaaggcacatggggaagagggagaaagggcgttcagacagtgagggcagcttgtacacaaggaaggaggtgtgtggcaccatacaaactcgtttcatatgtaggacttgtgagttaggaagtaatgttagaaggtgagagggaagcgatggggccagaagtgtagtgcagctgatcagttcaggccatatatatcaaggagaatgggttttatctttaaagtacagaggagtataataaatagatttgtgattaaagaagaccactccagagttgtactgtgtaatatagtagtttctagccacatgttggctattaaattaaaattaatattatcaaaataaaattaaaaagtcagtttctcattcacaacagccacatttcaagttgctcaacagccacgccacacgaaataatgcacatttccaaagagacagttgtggtgggcagcactgctctggagccttggtgaagtgactagaagaaattgaatctagaggcagtgaggccagataagagtctgaatgatctgctttctacattttctttctttgccatctggtggaagttttgcctatctacaaacaaataaggtagttgtctttaaaagggctatattacaatctttaacaaagaaaattattttgcattacttgacctatattgctttggaaaggtcatcaacagtttttgctttagtaattttgagcacttgaaccaagggagaggcttcagtaatggtgaggaagggaagggttgaaggcattcttgggagacagaactgatgcagtggtaagccgtcaggtgttaagggttaaggaataggattctggctttggagaactagcgatgtcattcaccaaattagggaaaatgagaagaggtgccaaattgatgagggaaataatccattcaaatttgattatgcttataaaatgtctggatgaaattgtccactagggaagatttcaaaacgtctggaagtttggggattgaccagtgttagatttgggttttcagagcgcaggtaagatcattagggagtagaaagagagtgggagggtgtttgaaggtagaatcatgaggaaattatctttaaaggatgagggagagactgggagcctgagaagccagaagcacctggaaaatcaaatgggctgaattacaaataccaagcaaggaaggagagaacttcgcaaaggaggaagtgctactaaacaggccagaaacaaatctgcttacatcagctggcaagaatgcaatcatttgttactttatggggaaaatttttagtggaaaccagaatgcaggagtggaggaatgaccaggaagccaggaagcagaagtgggtgcagactgagttttcatagcactgctgtgaaaaggggaagcagagttgcaggccagggaaaattaagagccctattagatgatttttataaaatgtatttttaaaaatgaggtggttgaggatgctgctgtttttgcattaaagggaagtacctagcagtgcggctagatattgcagagtattaaccttttttcccatgacctttccaactttaacagacatatttataatttaaaatattactttcatgtgctgtaggcattcctggtaaattggattatgtaattcttgaattgcctttgagtttatggtgtttatattggccagtgtgacagagcctagcatagtgggaaaaaaatcccatgcatactgtttacaatctgtctgactttaagcaaatatttaacccctctggacctgagttcctttgtgtgtaaaaaaagttaagaatgtatattatatagtattattctggaattaaagaagataggggatgtacagcaccttgtacatgagaggtatgcaataaatattaagtctgtttgctttcttggggaggaaacagagagaaaatgcagagtagtgttttattattatcattattaataactagcatgtcttagataagttaaggagggtaagtatataggggcaaagtttagttatttaatatgtttatctggaaaagattactacaatgctttgacataggaaacactgcctcatggagccactgaaaatccttccaataatatctcatgatctgttgtgcagttcctatgtcaggtataacacacagccagccagtcacttccgtgatttataaatagacattttgggtgacattactcttaatcaactgggcaaagtatgctgagtgcttatctaggagaacagctgaaaagactatccatgacctggattattagaatattttaacatatattgcttttatttctctgaattctttagataaatttttctaaagcagaaatgaagtttcttttgaataacttgaaatagtttttttatggtctatacatttgagtttaactcacgctattgtgtagcaacttaaattgtggtcttttaaataatatagcgcagttagagttcattgagcattttagaattttaaaagcctttgattctggataatgccacagttactctccataaacctgttgagatatttcagaaatcccccacttagggaggaaatgtttatagcatttctttgggcttatcacagttcacagttagctatgcatttgtttgttacctgttgtatgtattgtgtatatctattcaatggctattttgttccctgcaatgaaaggcctgtatctgttttgctcattgctggatgccttgtgcctagaagagtgcctgacacttaatttgccttcagtaactgttggatgattgaatgaatgaatcacagggactatgactgttgttataaatccaataattttagtttacagaaaaagaaatccaggctcacagaggtgatttattttgttaaaatcaaaaaaccgatataatgaaagtattaggaatgaatgctttcaactgagggtaacgatggcaatgtctagagacatttttattttcacagttggggaatgggagctgctatttattgtcacagttagggaatgggatgtagctaaacatcctactatacacaggacagcccctcccaacaaagaattatcgggttcaagataccagtaatgctaagggttgagaaactctgatctgtattatactgaaagtatacatttattgaatgcctactaggtagaagtactactttgacattgtgaagaaaacagagatgattaacacatggtccttgtcctctaagagtttgcaatttagattaactcaatctctgggacattgagatctcttttgccattgtttccactatacatgcacatctgagagaaatggttctatgtaatgtctaattgttaacatctgtaggtgaccatgctaagtctcacagtaagtttaaaggactgcaaccttaaatctaagcacaaattagataagaagatctaaaatttacttatagatacagtgcccaagtatgatactctattttaaccagcacttaactggattgtttaggtattcagaaaaatgtaataagcctaattatttatgtggaagtgaagggggcactatccaaaggaaatcagaccatttgatatgctggaaattccgtagttgaatcacatagagaaaacacatatgttgcaagctatttaagaatagcatcttttttttggtgaattgcggaaaacacctaggaactaggataatgatacaagatttaacacggtttaagttttatcctgcaagatagtaaagctaaccaagggttagaaatggtcccttattcaatgtaaagatatccaacaggatagtttagggattcggattaattttaaagaaataactcagtgctagactgtaatcccagcactttgggaggccaaggtgggcagatcacttgaggtcaggagttcaagactagcctggccaatatggtgaaacccccctctctactaaaaatacaaaaataaaccgggcatggtggcacacgcctgtagccccagctactcaggaggctgaggcaggagaatcacttgaacccaggaggtggaggttgcagtgagccgagatcgcaccactgcactacagcctgggcgacagagtgagagtctgtctcaaaataaaaggagaaaaaaaaaaaagaaaaaaaaaacaccaaccccccacccccgcccccaaaaaccaaaccaaaccaaaaacctcaatgctagaaacctatggataaaatgtggaacaaagtaattatgaacaagataaagatttttgatctcatgaagtaatacagagcatattattagaccctttctcttgcaatgttggtttctgtggggcatatatgtagttaggtggcatgaggggaaggtaaatatacactgatatttttgacacagctgtccacacactcatcgacactttgtcatagatattttacttgtattattattgtagtggttcaggtaagttcacaactatgtctgtgagggagaaagtaattttaccatattttgcataggaaaatatggggacctcagtaaatgggtcttccacagttgtgggaagaattataaatcagccttcacagtttatgatctgatgctttctgcattttctttctttggatcttactaaagcaaaaacttttgatgatctttccaaagcaatatagatcaagtactgcataataatgtcatttattcaagattggaataaaagcccttttaaagatcactagcttatttgtttgtagataggcaaaacttccaccagatggcagtaaacacttatttcctgactattcaatagcctgtggatttaattaattagctaaaaacccagtactcaagaaactctataatagcataggattttatgactattggggctgtagttttaaatgtctctatgtttagttctctctcaaatgtatcagccatagtatgtgaaaagggcctggtttgtatgcatgtatatgtatacataaatacagcagactaacatacagaccagaccctatacataagaataaaatgttacatatcaaaatatagaaattgtacctgacacacatatacacccagtaaaggttattttctctcctttcttttctaggcttatcaatcagaataatagatttgtcctgaaatgccagtcgttggaaagagaaacatataaatataatcatttaaaaatacacacatgatgtttatgatttcagtgttatatataataaaaattgatcaaaacacatttcattgtaaaaaaaagtaaagcttctcttttaagaaaataagtaggtattatggacttaaaaacttacggtctgcttcttgctattgtgttagatggaggggtgcagttgttttttaattgattgcggtacaagcatgactttcactgcccaggtatttatgatgtttctctctctctatcattttgcaccatacctgacttctttatattcttctttggccagttaattgaagactgtcttcaaagattagtaatgggtctctgtattctctctctgttactcactgccatggctgcagtggaccctgcctttgatcttggatatgccattgccatacaaaatcaataaatttatctaaaatttaattgtttccttgcaaaatagtgatttttcttagttcatagttaaagacttgagagtcatgataaacggttttctctctcagtttacacattcagattctactgattctgtctctgcaaaatctttcacatccactttgtcctttttattccagcattattatcttcatttgggtccacccacctcttccttggaccactgcccttagttactttccctttttcatcctctgtccccttgcatcatctgaatatggatgcaaactctctagcctgcggtttaaaggcctggatgatctgggctgaccctccttcccagcttgcatcacaccactctgctttatggaggcaggagggaagcagcgtgctacaggaactgaaagacgtggctctggagccctcagacctgtgcttgcccaccctgccactccccagcggtgtgactttgcataaagcacttcagttgatgtactccaagtgccttgtctgtaaactgtgttaagaatcttgtcttatagtataattgtaaggttaaatgaattaacctgtaaaagcatataaaaaagtatttcgtaagtgacactggtgggtcttctttaaagaagtctcatttttctcacccatgtggcagtggcccctccagccttgctgccttcttcactccctggttcctgccctgccagttaaaattctacccatccttcaaggcttatctcaaatgctaccttctccatgaataatttgtgaataaatttgcccaccacagatccctccttcctctgacctatattatttataaattattcattcctgtcttatgtcccttgtcacattttattttgtatttcagctgactgtatttatgtcttattttccctcctaggttgtaatgtcttatggtcagggaccatattctctttgtctttgctaaaataccatatgccgcaatgctttgcccattatagatgctctattaatatttattgaataaatgattgaatggcatattagctctccaatgccagatttataatttatttttttaacataaagacattaagtcctaaaagacctccatatgaccatgtctttttcctccttctttaaaaaataatttttttctattcatttttactctcttactttaagaattactgctattattcaatttagagatgggaaacagcagtataatttaaagcatatatttatttggcctttaatagttaacgttggtaaatttatatggccctggatttatttgggtggctttttgtccttctttcccttctcctcttccttttcttccacatcattattgttattattatactttattgagtttactgaggtaatctctctatgttaattatttaaaaaatcatattgcagcctgagagacacagatgaggcaaaatctaactgattggcaccatctgtagttttgctgccaaagatatgaatatgtaaaatttattgacatagagtcatggtttagtcatagtctttttctcattttgcagatgaggacactgagttccatgggcattaggccacctttcctaaagatgctggtgtttccttatagagcagagactggaatccacttccccagacagccagtcagggacgggtaatcctaagcaggggaaatacgtaaagactgattgtagaaggtaacattgtctttggggtagaatatatgatctaagtttcagagggcataaattattttattttgtgtttgacttaggtacattaattcctgtttttgtgcatgttttagtgggggatatgtcatggtttccagcattgaatttcaagtgtctgtaataaccattctaatgtgtattgagtgaaaacttgggccataaggtacatccttggtcgaacatgttgcatatcatttggatataatttagctaaaattttaggatggattttttttaatttaaaagaaaagttgaaatttttcaagcagaagacaaataaatttttaaaaaagctatggtgaaacttgactaaaatagatgaataaatttcttctggacaccgtgctagaattttctttactaacaagtgaaaatgtgtttctttaatcagaagaaaggaggccagttaactcactctttgctctctacctttcactcttggattctaaaagcaggattaaatcccgttttgaaactaattctgttactcataattcaagggaacttaaggaatctgagggaaagtctgggtctctgtagacagaggccagcctcaagtcccctcagtggctgtcccagcattaacaggtgacctgtatcttcttaccctccttgtgtgtcagttctgaaaactgaaagactgctgtcatgaaactcttggtctgggtaatgctttccatccatactcccttccctcacactcctactcattttctgatttgtttcaccataatgtagttttgtttgttcgtttatttcatttaaatggaatcatgcagtacattgtgttttgtgtgtgccttcatccacttaatgtctttgagattcattcttggttgtcgcttgcatgagaagctcgtcatgttcattgccgagtagtactccattgtttgaatatgccacatttagtttatcattcttctcttacatgacatgcttttaaaatcttagcctaatttctggctctgttttacacccctaccactgttttctctgccttttccccttatcatcttcaaatgaatgtgtcaatcttttgtggttgatttcaatggatagagtaacctctgcatacacaattctttcttcagctgaggaaaattttatcttctattatctttgattattgcttgtgttccacttattctctcttccatttgagagctctggtccctcattagttggttgtctcttctctggttgtctgtgaccattttctttttctaattatcatttctggataccttccttctgtatggagggatagctgctaagctgctcatcctctgcattgctgattttctgtaactgtgctgttggtgctaatgtggactttaattttgtatttatgttttcatgtatattgaaatatgaagaaattccataacttctcttatattgtattatttatattgttattttagtatttatatattattattattataattattttgagacagagtctcacttcgtcatccaggctggagtgcagtcactgcaacctctgcctcctgggttcaagcaagtctcatgctcagcttcccaagtagctggaattacaagtgcgtgccaccatgcccagctaatttttgaatttttagtagagacggggtcttaccatgttggccaggatgatctcgaactcctgatcttaggtgatccacccaccttggcctcccaaagtgctgggattaaatgcatgagccaccacacccggccacatattgtttctatactatcattttagctctttatgttatttcgttgcctttatgtagaggtcatgtttacttgtactttcctgagaatgccaaaccatttcctgaaaattcattttgcatcatatcataggaaatgttgagaaagactctgagaaggaatctcccttgttctaactcagtgttccatcagtcctattttcttttttccttcctttgttctttccttgttatcctcagatgagtgagctctgtgcagaaccagagggttgagtggattgtccttttgttcaatttttaaattctctagtatgaaaattcagtcctctttctaaatgttcagctgcagggctggctgatgggtgcatttgcagcgcagttcccagatttgagcagacatcgactctatggattctatggactctacacacctgggtttaactaaggcagttgcttctgtgtcctacccctttgctatttctgcatcatcatgcaatgtcattccagcatacggcattccttttctctcttcacaccatgcttctcagaaaggccttggccatcatcttttccctccactttctgcccacttgttttctgagcatctgtttggtcatgtaaagtcagagacaggtagcagactagggaagcagttttctgcgtaatttcatggcagcttgccagtgatagagaaactcttctctataggtttttggtcggtaaattctctgggtttctacgtcagcgttcaaactgactcactatcttcttatctttgtttacgtggccactagcttaaagagacgttgaagtttgccacatgataaaaactgggtcattacctgcctgtccccaagaactatctactttataattagcatcagttcattgaagatttggaatttaggttgttttttcagccttagttcttaatgagattgggattttttttgctttcattttgctttgcttttgtttttttcagaaccctcattggtatttagtgatgagttggaaggggcaattctcagagctgctagataagtggtattatgagaaagactcctaaccttacattttaaatgataactttactgggattgtgcattgtatacaccagttgattcacattaaaatgattaaattcaattggacaacttgatgtttcaagaaacacaccttatacatctattgctttacgagtgatcaactatttcagaacaactaagaatcgctttgagactgtaaggacaagtgggagtgaggagtcatggatttcaaccagccagatgatgcaagggtctgtactcagcacatccagaactcatctttgtcatcagattggccccaaaatgccactctccaagcccgaagacatgtgtttgtttgtttcagtagtcctcatgtatttgctcacatatcttatatgtagctccttttttgctctgttttgtttttcttttccttgtgtacataacatgtaaaacatgatctcaaatcatcaatgtcccactggttttttttgtttaatttgtgtctgagttattggtaaatggcagtttttgcagagggtaaaatggtgaactctattgaatatttttccagaggaggtgatattgtcaattcttacttcttcaaagatgtcaacagttctgatataaaccaaggcaatgaacttggcatgtcagcttttgtctcctgcaactagggtttgatggtagtattttaaattgtcatatttactaatagtttctttcttagcatctttttatattaaacttagttgaggatagaatattaattgaattgaagatcaatggtcttgttagtgtgcttttcatagcaatgaaaaactaaattttcctttgtttttctagcttaatcctgattatcgagatgcccaaaatgaaggaaaaaatgtggtgagtagaactggcttttctccaacaaatctcagcatattgttattattttatatggatagattggaattttaatagcaaatttgaagactaggggctcagagagattttctgagtagagcctatgggtcacaggtaaaagatgatatggcttagattatgagaagatgttcaattatgggtgcttgggaagagttctgcaacttggaggccattgttggtggagtgctaaaggcagctggcatctgagagatatggtgggtctaggtttagttttatttacccttttttcttctgtaaagaagaaagcttcatggtgacaacatggcttctttattcaatcaaaaattcagaaattcaggacaatttgatgtgatgcagacaaaatctctggatgttgggctagatttttaaaaagttttaaagagcaatttaactagatattttggcgtaatctagatacggtctgtaattcaattttcttaggagtttagcaattccttttgaaattggtaggtattattactccatcattcaaaattttaccctttgacagaaagaattggaatgtttaattaacatggccagtatctttgcattgatacatagctttaggatttgtgaggatattgacatgggggaggtgaaaccaatcagaatttatgtacctcattcaaccctgtttgacccccttctctgtctgactgccaggcttacgatagaaataaagctgtgaagtatcaggtaattggcccaatgaaacctttaacatatcaaaatgtctctaaacgtagaggtaggtttattcgattaattggatctcctatttataattcaattttagcgcactgggtgggctcttctcttgttggttttcacatggctgccccaggattgttgggttcttacttttgtatgatttaggaaaatgctgtcagtaaccaggtttaaaaagcaaagtgtgaatcatggcttctttggttcttactataagcttgtcaatggcctccacccaaagaccatcaggaacacatgggtagttgaacaagttgggtttattacttatgcagtgagaaaggaacatgccatgaggagctgtggggcatctcagagcatgttagaaagaacttactagaggatttgtgtttgtgtaaggtgatttggggaggatttaaggaagtgaggctttgctgtggagagaatgttgtcaggaagaggaattctataattggtatcttaataaattttacctatagggaggacaggcttctaaggaagcaacagtcactcatattagttgggggagagggatatttagtcatttttgtggcttggacaatattcatattttgtctgtgtttagacatgattagggaatggtcttgttttgtcttgatccatcacagtcacagagtggccttgtctgatgacattctgtgaaattgttcaacagagaacagtatggccttgctaagaggaccagaccacctattggatgtcaggggctgctgcttttctctttcacaaggtttatttttgtaatattctgtgtgacttcttcagcatcgtgtagggccaagagagtcttgttctagcaccaccattaacttgtgtggccttggacaagtgagatagctttcttgagactcagtttccccacctgtgtaatgggatgaagatgttcgtcttatgtacttcacctgcatgccatgaggataaaataagatcagacagatggaaactctttgaatttgtaagttgtttctagtaaaagagcatcatatcaaaatttcaaattgtacaaattaattaaatctctgtgcgcatctcctttctactacataatattcggtgatacagctgatgattttggcctgagcagagtgggagaatacagtcttcctccctatccagtggttttgcatctgtgtattcaaacatccacagatcaaaaacaccaaaatataataatacaaattaaaaaacaatacagtataacaagtatttacctggcacttagattgtattagatattatgactaatctacaggtaatttaaagtatataggaggatatgtataggttatatgcaaatactatgcaattttatatgagaaacttgagcagatttttgtatttgcagggggtcctggaaccaatcctctgcagataccgagggttgactacatagggtatggaggttctatggaacagcacaaactgtataaatgatcatatatccatggtgaagttcactctttctgttaatcaagcttttagttagacttgatagcttttcttctttttattcgaaaaaacaacttcttcattgacctctaaaggtgagaaagagtgctcttctgtttaagccgttgttactggcaatactttaattgcattcaacacagatgggtctgcttttgctgtagatgtttatgactgagtctcatctgtcatctcagggagacatccaactgcagacagttgatttaattttttttcctctccagaatacctagcttgagagcaaagaaaattgagaatgtggagccataaagctaacaatatggcttcctattttatagaacatttgccacagagcaataattatttttctgtctaaagaagaaaacaaaggagctgttagagtttatctccagcctgtgaaatatgcaatcagtttcccaaaacagaatactgtttcacctcagatctgggttccagtaacactgactttattatgaccatgctaattttttctttcctagttttcctgacgttgtctatgtaatgcccagttaatattttttttttgtaatttagaaacatttatcaaaatgttgccttccgtatttgaagtttcaaaggttcatgcatggtgccactgaaatgaggcggtgtgtgtcagagctcccattaagacacaaattgctgtatttattctacaaaggagtctattatttccaatattacaaatgtacagcatccacagggaccctgtaaacattggaaccgtgtcaagcccagctgggaacctgacagtcattagtttcttctccttgaaaagctgcatcttttcagatggctctttgaaggggaattttttggaattaacgctacccatcttaacattaccatatttatgtggaatatgatctgatttttcttgggaatgtctgttttagatattggaatttctggccatattgggccagataattctctgttgtggtgcaatggcttttgcctgtaggatgtttagcagcatccacaccctctactcaccaggtgccaatagcaggtccccgattgtggcaactaacaatgtgcccagaaattgccaatgccccctgggggcaaatatcattccctgttgagaaccaccggtctatgtgcatttatatacatcaacagaaatgttccaggaaccagggaactttgtggaaatataactgaaaatcctgtgtccatagaatttggcgggggggcggtgtaccagcttctgacagaccctcaaattttcctgagtaccagattctgacccccgaatttccttgttttactatatattcatcagtgacaaggtgataaggaaaacacagaaacaaaggttctatcagaaattaattggagagtagcagtttgttaaggaacctcggcaagagaagtatttgcagctgtaaatggcagtgttgtgtgcggttacataaagtcagtagtgagagccctggaggatgtgaacaaaaacacacgtgcatgcacatcgttatgctgctgtggccgctcacaggtctgaaccaactctgcaaatgcagacgtttcttacagaatgtctctggctcccaacaacagaattgcaacgtgatgtctgtgctaaaaatttgatgactcacaaatgagtcagcagagaaggtgttctaggggctgactgctgtgcggatgcctgcaggccccaggacggcaggagaagcaaggagagccattagttgagttgactcagctggcttttcgtaggggcattttctccatgtacaacttgagaggctatgtggctttctttctgagtgaaaaatgctcgtttgattaagagctcagtagaccaggttaacattccaaggccctgtgttaccctaaattgagaatgttttggagagctagctgaggttaaatttaatacctgtttaagttctgtcgtaccttaatgtattttcatgctgaagagagagggcgttgcgcttctgtgattcggtgtggggaactagtgtttctgtgtcttttttcttaaaaaaatcaatgtgagtttataaacaaaagccacaaggacacaattttaaactgaattgtcttcatgttataaagatatattgacttttttctatattgaggcttgaatcatacattaaaaattgtatacttatcacacgttattcagatgtcattagaggctggcttgaggggcacattccaaggagtgggcttgaagtttactgtcagactgtctaccaagagagtttattaagcaaattaacagagtgcaaaagagtgaaagcagaatgcttaaggctacagcactgttttaaaaaacttctaaacatgtttgaagctcttattcacacataagcaattgttatatgctctttataaatggagattttcttttcattaaagctattttccaagaacctaagtgaactatttaagggtggaatagcgtattctacttatcctatgtaattaaaataaaaccacaggtcttaaacagtatgagtaattcagagtgacctcttttaattaaccctaactggtgagttttttctgtgtttggaagacagtctaattgttgcagtgtgagaatgtcaaaatagagaggtccctgactactcttgttgggcctttacagggagacattaccaaggagtgtagggtaggagggcattctgtaggaacctgggtctgatcttttcttataagtctagaaaatttatttcattagcattttaaaagagggataaatgcaggaggattaactccttctaaataaactcacaaaagactgatgaataaaccacaatgccaactttcaattgccaaatagacctaaatatttggctcaattggtgcattttccttgaaggagaatatgtatcaaaggctaaattagaatattggggtgcaggagactcaggaaattagatgacacatactccttttaaggatatgctatttttccaagaagactggcaagccatttattgcttctacactaggcaatggtgagagaaactgttttattctccatttatttgggttacatgctgatcttctgttaataagcctttattcaaacatggttcaatatgactgataacattttatcttccttagttaatattatgttttatttgtgccttcccaatattccacttaagccacttgtgcccaaatcccattgccgtaatagtcacaaaaatcctttaggttatttgtataactgactgatcttgttcataacttctgtgtccttatattccgaggcagtcttctctcacatgtatttacaacactcagtgtgcttgtggctctttcttttggctacaatagggttccaaaatccaggaaaaaaagctcttttccaatatttctttgtgactataattctcctggtctatttctccccaagttttcatgttactggggatatcattaaaaacaaacatcctttgttttcttttagaattatcacatcctcttctaaacctcctccttccttccttttgtatgccgtgttcttcataatcattgtcctcttcagtatcagatgtcactacagtttttaaccttgacaaggaattcctacttgcacatggtcttctactgggccctgtaaaagaggattgcatagaccttgttcaggccttcttgcgtcagctgtttgcagttggacagcagtgtggctttagtgtcaccatcagatttcagagccttcagggaaaactgcgtctttgccatccatatcttattataacacctagattttcatgttgaggtacatgatgtagatcaatgaaccaacacacttttgagtttgcccttccctccatccttccctccctcccttccttccctttctttcccacctgcctccctccctctctttttttcttttttcttttctcctttttatctttttgagacagttttgctctgtcacccaggctggagtgcagtgatgcaatcttggctcactgtggcctcgacctccgggctcaggtgatcctcccactacaggctcctgagtagctgagaccataggcgtgtgccatcatgcctaactaattattgtattttttgtagagatggggtttcgccatgttgcccaggctggtcttgaactcctgagctcaggtgatccacctgccttggcctcccaaagtgctaggattataggcatgagccactgtgcctggcctctttttcattttaaaactgtatatagttaaggtatataacatgatgttttgatacacatatgtatagtaaaatgttactctagtcaagcaaattaacgtatccatcatgtcacatagttaacttttatttttgtgataaaaatacctaaaattgactctcttagcaaatttccagtatacagttattcatgtatattattgagttatttaaagacatttagactttcttcttgagggatgagagggtggttttccccctcatatattttgtcttcaattcttaggcttcctcatccttcatgcaaatcaccgtgaaagtgggtcccaagacccaagataactttttcagaagacttgggggagggtcttagccatgagtttttatttactcttagaggagtgactcatacagtatttaagggcctcaggcctggcctctggcttgggttggcttggattcaggccctggtcagttgaatttggggctgagcattcattaccaccatctactgctcccctcttgttctctattctttctccccacctcctctccttccttctttccctcttttcccttctccttcttcttcctctgcttctccttcttcctcccctttctttttccccttccctcatctttcatcttttttaggtaactgcactcatctctttgctcaatggaaattataatgcttacctttctctctcttaaattttttgttgtgggattaatgagaacaaccaaaggaatggctttggtattgtgagaagctttgtataaattcagaaatatcagccaggtgcagtggcccacgcctgtaatcccagcctttgggaggccaagcagggaggatcgcttgagctcaagagttcgagaccagcctcagcaacatactgaggtccagttagtacaacaattataaaaattgttgatgtggtgtgtggtggcacacgtctgtagtcgcagctacccaggaggccgaggtgggaggatctcttgagccctggagagcgagactatagtgagccttgattgtgccactgcactccagcctgggcaacagagtgagaccttgtcttaaaaaaaaaattcagaagtattatttgctaactgtttctgcattttcttccttcctacatgcccatactcccttatgatgtatagtatgctaagtatgcccttttctagtcaataaacagagtttatatttacaaataagaaattactgttatgagggtcaccctttgtggagagtttgctgaacccctgctttcatttaactctgaattttggtctctgtggaagacacagaagtcaaagatgacgggagctacctggtgctgtgaggctgtgagggctttagcagataacaatcctgctcctgtttaggaacgctggcagttccctctgcccattcccatttcaacggtgctaccatttgtgcaccatttacagaagaggccaaaaagcaaggctttttgatccaagtaaaatgatattaacaatctctgggagggggtagggactccaagtgaatgttctgggatgatcaggggtaatatcttgttgtcgcagcagccattgaagaaacgcttgtccatggatataggctgcttgcatttgccttttgagcatcccttccttccctcagtttcattcaccttcctgtgatagtgcagtgacagtgtttctgtctgtctttcttccactctcattttcagatttcacctgttttaataaatatgtgtaagtcactatttttatctactaactaccaagcttatattgcatcccttgttttggtttctcgtgcaaccagttcttccatggggtactgggacttggggaagttctagtaaaaacacatactcattaatctcttgttggtttctgcttaaaatggtagggtgtgctggaagcattgaccaagttccacatcactatgaaggcttctgtgtgtggagatctccttttattttatttcttatgcaattatagtatgttcttgaatctaggggagcaagcaggtggtgaaagggaatgttgctgttgattctgctcctctccaagtattattatgcctggggagttaggtatgaactcctgcacactgccatgcttactttaacttcagaaatctagatgattcaacacacgggctcttctctgtgtttgttttaactgtggaatggtcaaaattactactttgtaaataggtttaagagaacgagggaagggtccataactattggtaccgttagtgccttaatgatgtgggcagatcaagccaccccgccctaggagtgtgggactcatcactgttgacagtaattacctcaatggctgtcgggctagagctagtgtttctggatgatgtgaaatagacacctcttcaatccaaggaagaaataacatgcacatttaaaccttatcacctgattaattggagagtttagcaagaaacgtgataaaagtaaataaacttgtacttcctcaacagagagatggagtccctccaacttcaaagaaaaaacgccaggcaggggagaagatcatgtatactttggtttcagtcccgcatggcaatgacattgcatccctttttgaactagatgccacaactcttcagagagctgactgcctggttccaaggtaaaaaaaattatggttaaaagatgtttctttgaataattataccagtaggtgaggaatgaaaataataatattaatatatttttatgatatcaagggagcaaacataaatgaagaaaaatgtgtaaaacattgtatctcttctgtgaggaggttaacatagtttgttttattcttattaataattaaaatgtgcaggaccaaagaaactctgaaaaatttataagaatcatttattcttattacttgtatggcctttggttactaaaatgaaaaataatataaaagtatttctatttatatatttatcatttatttttattatgtcagatttcccatttcattcatccatttgttcatttatgtagtcaatcagtcaagaaatatctattgaacatccattacattccaggcattgcccttggcattgggaagacaacagtgaacaaactggttatattctcacattcaaatgggggagacaggcagtaaacaaaacaatagacataaaatattaatataaggtcaggtaataaaagtgctttgaagaaaaaatggagggtatggagagttctattaggtaggagtgttcaactgtggcctctctgagttagtacatttgaataacgatctgaatgaattaaggaatcaagtcctctcttcctaggaggaacatttcaagcagcaggaacacgaaatgaaaaatgttgaaatttactgggtgtttttaaggaccagtgagaaggcagagtaattagacataaatgagggaggggttgtgggattggaaatgagattgccagaacttaaggtaagacaatatcttacattcttttgcttgaatttgaccattttattttacttttcatttatttatcttttttgagacaggatctcactctgttgtccagggtgtagtgcagaggcacaatcatggctcactgcatcctctacctctggtactcaggtgatcctcccacctcagtctcctgagtagctgggactataggcatgcaccaccatgctctgctaatttttgtatatttttgtagagatggtattttgccatattgcgcaggctggtcttgaactcctgggctcgagggatccacccacctcagcttctcaaaatgccgagattacaggcatgagccaccacgcccaggctgaatttgactagtttagttaagcttttttgtctacaactgtccatctttcaaccataaggctatgatgcactctctagatgcatcgaggagtcttgcccatattattagggttagtgggatggctctaaattggccttgatggagcagtattgtgcttggccttggcagatggcagtggtgaagctgaaggcacctatgcagaaaggcaggcattgtgtgggtttcctccagggagggtaaaaagttactataataacactattgagaaacattgctggtagagcttcccagggtgttttatggctattctcattcatgagaaatgttgctgaatttcataccttatatgagtccatctctcactcttttttttttccatcaatataagcctgtaaagagatcctctctggttttacctgacccaggtctctggctttctcctcccaggactgggaccttaatcaatccttactatgactttacttattttagatttaagtcagcaaaaagggagtccttcttgaactctaaccaagagaatttgcttaaggaaatgataaaagggtcttactagaaagtgtatagaaccacgatgagggccactgagcctcactttatatagaataattaatctattacttttcagaactgtggaagccctattcagtgtagtgcagaattttgtattaacatcgattcatctgtcattaattgtattcaagccaacattaattaatgcttaataactactattataatataactcttgaagcactttttatgtattaagtcctgtgtcaagttcttaataaatattgtcttattgcatactggcagtaactcttacagatcaggaactagagactgagttggaacagtggttctcaagctgactgtaaattagaaccacctgggtattgttgacacctcaccatgccctggccacactgagaccaatgaaatcagagtcttacaggtggggtgcaggctttactctttttgaagcatttattacccaagtgattccactgtggagtccagtgtttctcagactttatggtccaatgctgcttaaactttattctatactaaatcaccaggggacctgatgacaactgagtacaaattacatctcctgtgtaattcaatgcagaagatgccaagtgataaaacagaggcatttcagaatttctagttatttgaacaaagattggagaactgctattttagatatttgaagctcagtttgtattttatctacttttataaaggagcagaaccaggttgttgaatgaatctctttgcctgagtcccttggcattttatttggttttcttttcttggccctaatgctttttaccttatgttttaagacgtatttatgccttatctttacactgatctgtaagcaacttgaaggcagagtacttactgtgcttttcttttaatagacactatacacatatttgttaaagaaataacaaaagattataaaagatttactaaaaacggtaatacttgagtaggatgaagttctaggtgtcctttcttaggcattctctcacagttcatatctagtcaatctttaaaattcatggtacatggaattagcaaatactgaaccattgttcctaggggaaatatagagttaggttcctgtgagcttctggtcgcaacatttttgttgacgaatacatagccttgttctatgtgtgcttctgtttaaatacaccttatttaatgtacgttgctgattcattaacattgaacttgtggtcaacagcactataattcatgcatgaacgaagctcatctagcacaagtattttctttgtaaggcacatcacaaccttcttgtgctttaggaacactagatggcacttctacacctcatgtgggggccatcttattgtgaaatatgaaaaacatggcactaaatgggccacaaaaaggacacttgtttatagcatgagagctgagacaagaaggcagagcatcaccttgttccacttcagcttggaaatgtgcctactgggccacttaaatttttgccactctatgtatgttctggaatgaccacaaaagctccttgaatattgatttgggggctacaaataaattttaccgaacaggagaattcacaagtacagaagccacaaataatgaggattgattgtacattaatactttcacatgcagacaattaaactacacaaactacactactctctgccagcagtgttagctgagttggctatttgatcaatgttcttagtttagcatgcatcagaactgcctggagaacctattaaaccactcattgttgggccacacccccaaagtttctgattcagtcgatggggatgaagtttcagaatttgtatttctaacaagctcccaggcaatgctgatgccactggtctagggaccacactttgagaactactacctaggtaaaaatgctgcatgctttgaaatagtctataattccgaatttccccttaaagcagagggatcttgagtcaattactagttaatatgtatttatgttcatataatatatgaaactgttaaagatgttaatatgtaagtgtgctaattttttataatttgtttttttatattgttttgcttttaggaactcatatgttcggttaaggcatttatgcaccaacacatgggtaaccagtactagtatccccatagacacagatgaagagaggcctgttatgttaaaggtaaatgtcactgaagatggtttaattttcagccaaatgccatgagaataggattaggataggaatgctgtgtgacacatgttccttatactccatcttcaccaatattacagatcattgcaattaatttcatcaagcatgcatgtctgccagttgcttaggtagctgatctaaatgggttggaggcagcaaagctgtgattcagaaggatgctacagagacaccagaaagaatggtagcagcatatggatggaggagtagaatccaggagtgccttttctctactctgtcgaaactgaagcagagggcaagtgtgaaagggagaagtttccagtggggctttgggaacagggcaggaagtgggcacaggaaatctctgtgtccctgcagcctttcatagtggatgatgcatgtgggagttactgtgttcggatgatctattcttgtcttatatttcttaaacagtactagatgtgttagtcttcaaagaatattgtatagttgtttataaaactaagcttaatggaaaaacatttcagattggaacctgccaaaccaaagaagataaagaagcgttcgcaatcgtgtctgttccactgtctgaagttcgagacttagactttgccaatgatgccaataaagtactagcgaccacagttaaaaagctagaaaacggcacaataactcagaatgaaaggaggtgagtaactctttaaattggtcttaaataatcacgagtcagttgtcaattgttatagtaagcctgatatgaatgaatgactctaagggaatattcagaacattctcgatagcacacttgcttctgaatgagatgggaacttattcctcttgatcatagtgagtgagtgaaatttgtcagatttaaatctgttggaatatttacttgtcccattttagctttgcttgaaaatagttgttttaagttactttctggtcattcttttttaaatcctttgtgagagatttgcaataccttttgctgcgcatgatttgatatttggatttagagttctaaaggacctaaaggaaggtttgtgtttctctgatcttatttattcaagatgcatttctcagctctggtaccacaaaataaacagatatgtaaaaccagaaaaaaaaaatctgcagggtatagttctctgccctcataccttgttcagagaaactggaaccttgattcttcagctctggttttggaaataagtaagaaagagaatgatattgacagctaacgattattgcatgcctgctttgtgtcacttactaggttgggcactgtaaatatattttatgtaatccttcaaatagccttgaaataggtattcctgttttacataaaggaaaactgacgagggtaagcaaacaaggtaaagctgcatagttaatactaagggaggattcagtcatgtatggtttaaagtccatatgctttgcagtatgcctaagcacaagcatcctctgtatttcctctcttcatgatctactacatgccttttaatttaaacaagaaaaagctgtttgccaatttcccaggcattcagacattggagctctcatacacagctggtgagatgataattgatgtatgcaccttggaaaatagtttggcagtaactagcaaaattaaagaagcaaacaccccgtgactcaccaattccactcccaggctgaacattcttgaacatctgtccaaaagactctcctccacatgtgtaccaggacacatgttcaagaatgttcagctttgtttgaaataaccccaaatggaaaaccatccaaatgtccatcaccagttgaatagaggatgaaaattatgttattttcatacaacagaatacagttttgcgatgaaaataaatgaactacatctatgtgcaatggcgtggctaaatttaacaaatggattgggtgaaaactagacacaacattctctgataaatcaggtaacaaaatgtatttgattgatagaattttgaagtaaatgtgattttatctatcagtttctgagtaacaaagagcaccaagttttaatttaaataggggatttaacactagggatcagggagtttagttatgaagagttaaaaaaatttaaaaaacagtgtaagctgttgaaatggcaagtgaattattttaatgatgtaataaaatatttttaaattttgacatagtgatcatttaatgaaaaaactcaccaaaatgtctccatttgaattgtattgataatgtgggacatatgtgtaattcaatatatacatatacccatatgtatatacagaaaattatttttaatactttcctactgatatgaaatttaaaattggaaattttgtgagtgtttttcttgtccaatagagcctgtttcctttttttttggtgatttaacaatctcttgagggctgcacctttaaattcccagattgtcaatagacatgtatagtatatgggataaggtggacacaagtgcacatataaataaaatcttcttaagacttttaactattcatttacagtaggagagtatgtagaaatcatcatccacaagtcataattaggttgtgtgcctactgtagttttttccatttctgtattatataaacatttgcatattaaaatttgatttttcccagagacaagtattatatactgtatctatatttaaatcaaactgtggtaatatatttctcagaaaataatgttggggactatagcctgaacatttggacttgaagcgacatggaggaggaggttgatcccgttgtgtataagttaatatgtgataactattgaatcttgtacaaaaacaaaaattgaaaaagaaaaaagaaaagcaaaaatacagtttttattttgaaatacaaaaaaataaaaataaaaaagaaaactagacacaacaaagacattcactgtagtactatgtgtgacattcaaaaacaagcaaaaacaaactccatttctttgggggtgtttaagcaattagaagaaccataaagaaatgcaaggaagtcattgtgacaaaaaacaggatggtgtttcttcttagaggggagggaggaattatgctccctgaaggtttgaaaggctcctgcagggtcccatttcctgctcttggtgatggcttcatgggattcacttttcagtagtccttagctatatgttttaaaaccttttagatatacatcttacaatacaaaagaacaaaaaatccaagtttgcttccctccatccctgtcaattagaaaaaaatcctaaatatgcaaacaaatggaatagctgtttctcagcttcctctctattcttacctctatttttttccctggcaaacttacatttcaaaacaactattgtatattcagtcgcacctccaaccctgttaggggaaatgaataaaggccggaagcagaaacaactggcccacttttatgggctatagacaagtaaatatcagagctaaattatggcaggaaatggattctgatgtgcagataggaatttttatttgcctgttattgatctaacttttccttttgtgaatctatttctttgtttctaacactcttacatatgcacagcaatttacttggcttcacttaaaaagtctcccttgctaagcattaagatattccttgaagaaaaggacagataaaaattcagattatggtctctccaccattgctggctggaatcctgtgcgagtcactcttcttcagtcacagctggagattatcttaacctctcaagatgattctaaggaaggtggtggactaggactgactagagagcatgcatttttatttcctttgcttctttccctgctgttttggagtgaaaaacgttgtattaatagcaaagagaaggctttgcctaagaaatatgaaggtacaattattgatcttaatttagtaatttcagaaaagccacctcccatcaaaattcattcaaagctgcctgtcagtaaggtagagcttattggcagagttgaatgcatttatattattttctcagttttggaattgaatataaaattatttctgaaaataactgacaactctgacttttttccccctatggaaaatgaagtgattattatctgtctcaaaaagcctgtgttgttggaattttttttttctctctctctctctctgtcttccctttttacttatcccaggaatgaacatgaaccctggaagtacagttcctgtgttatgcttcaagaccctcaacattagatatttttcaatggaattttctaatcttattctacataattgcacccacaaaatagagaggactgggaacatattgtcagggatggaggagggaagatggaggggtgttaactgccatccagaacttgaggaagtgacacaggcagtccctgaccagcatttctgcactatgtttacctctgagggtacacaaaatactggggttactctcaaacagtgagagttcagagatgtgattaattcagtattactgaactcctggtatgtgccaggcacttggccatgcagcatggctatatgtagtgctaatgtggtggtgaaggccacagactatcccatgtctctgtgaaacttaccctctcgagggatggttctcattccccatgataggagcccaggatctagaataggggtcatccaccatgtgatcaccagatcagatgtcattctgatgttgcttctctgagcaacatcattttctcttaaattttatttgccaggtatgactatcctgacaccagcaatcttttgtttaatatttgaaatgcctgatgtctctttttccatatctttttaattcagatttcctggtcattttgttttagttgtgtctcttatgagcagcagaaggttgatttgaaacaatctaatctgatagtctattttatttatttttaaggttgattgtaacaatccaatctgatagtctattttatttatttttttttgagagagggtcttgctctgttgcccaggctggagtgcagtggtatgatcatggctcactgcagcttcaacctcctgtgctcaggtgatcctcccacctcagactcccgagtagctgggaacacaggcacgtgccaccacacccagctaattttttggatttttctagagacagggtttcgccgtgttgcccaggctaatctgaaactcctgagcttaagcaatctacctttgttggcctcccaaagtgctgagattacagacgtgagccaccgtgcctggctgatagtctattttcatttgcaagtttaatgactttgtatttgacaaatttatttgaatgcatttttatttttgttttctttctttagtgtagcttgttttcatttccttttacttctttcttgctttctgctagattaataaagtttatattcccctcccacccaatttactgttttctctactgatttagaagctttaggtcatattttcattcattagcaattacccttgaattcttatcgtacattttgaccatatattcttcctgataaacttgaagttactatttttttccccctcccatgaaagaaaagtgccgcggcatgctttggttttgctctgacattctccctcccttctttcttgtagtagttgtttagaaccttagttctgtgtttattctcttcatttgtaaaattttaatttgataaatacaaaagaataaatgtgtcaatataaatcatgatgcaccaccttttgtttttactgataaattttgttcctttttttaagacaaagaaacatcttttttttacttaaaacatttattttatttttttaatcttatttcactagtttttgaggagataaatttagtttctaaagtttttttagtgattaattatattttttaaacaattttacctcttcttctgcccctttctttacgtcttcctcctgcctttattacttgtatctcacttattctttctcttttcatcttgctgaaatttattctttagtccattcagtggagaggcctatgggttataatctttttaggttttatgtatatgaaaatatctttattttgcctttactcttttttttttttttttaaagacagagtctcactctgtcacccaggctggaatgcagtggcgtgatcttggctcactgcaacctccgcctcgcaggctcaagtgattcttttgcctcagcctcccgagtagttgggattataggcacctgccaccacatctggctaatttttgtatttttagtagatacagggtttcaccatgttagccaggatggtctcgaactcccgacctcaggtaatctgcctgccttagcctcccaaagtgctgggattacaggtatgagccaccatgcccagccagaatttactctcaacatatttcttttttatttttttgagatagagtcttgctctgtcgcccaggctggagtgcagtggcacgatcttggctcactgcaatctccacctcctgggttcaagcgattctcctgcctcagcctcctgagtagctgggattacaggtgtgtgccaccacacctagctaatttttgtatttttggtagagatggggtttcaccatgttggccaggctggtgttgaactcctgacctcaggtgatctgcccgcctctgcctcccaaagtgctgggattacaggcgtgagccactgcactcttgccattactcttaagtgatactttatagagatgttagattgataattactttctatctgtattttaaagctaaaatttaattattttctagcatctcttgttgctgttaagaaatctgctgtcaatagacttgttattcttcactggtaatttttcttgacttggtaattttttttttattattatactttaagttttagggtacatgtgcacaatgtgcaggttagttacatatgtatacatgtgccatgctggtgcgctgtacccactaactcgtcatctagcattaggtatatctcccaatgctatccctccccccttcccccaccccacaacagtccccagagtgtgatgttccccttcctgtgaacatatgttcttattgttcaattcccacctatgagtagaacatgtggtgtttggttttttgttcttgcgatagtttactgagaatgatgatttccaatttcatccatgtccctacaaaggacatgaactcatcattttttatggctacatagtattccatggtgtatatgtgccacattttcttaatccagtctatcattgttggacatttgggttggttccaagtctttgctattgtgaatagtgccgcaataaacatgcatgtgcatgtgtctttataacagcatgatttatagtcctttgggtatatacccagtaatgggatggctgggtcaaatggtatttgtagttctagatccctgaggaattgccacactgacttccacaatggttgaactagtttacagtcccaccaacagtgtaaaagtgttcctatttctccacatcctctccagcacctgttgtttcttgactttttaatgattgccattctaactggtgtgagatgatatctcattgtggttttgatttgcatttctctgatggccagtgatggtgagcattttttcatgtgttttttggctgcataaatgtcttcttttgagaagtgtctattcatgtcctttgcccactttttgatggggttgtttgtttttttcttgtaaatttgttggagttcattgtagattctggatattagccctttgtcagatgagtaggttgcgaaaattttctcccattttgtgggttgcctgttcactctgatggtagtttcttttgttgtgcagaagctctttagttgaattagatcccatttgtcagttttggcttttgttgccattgcttttggtgttttagacatgaagtccttgcccatgcctatgtcctgaatggtaatgcctaggttttcttctagggtttttatgattttaggtctaacgtttatgtctttaatccattttgaattgatttttatataaggtgtaaggaagggatccagtttcagctttctacatatggctagccagttttcccagcaccatttattaaatagggaatccttttcccattgcttgtttctctcaggtttgtcaaagatcagatagttgtagatatgcggtgttatttctgagggctctgttctgttccattggtctatatctctgttttggtaccagtaccatgctgttttggttactatagccttgtagtatagtttgaagtcaggtagcgtgatgcctccagctttgttcttttggcttaggattgacttggcgatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtgtcctcttttatttcattgagcagtggtttgtagttctccttgaagaggtccttcacatcccttgtaaggtggattcctaggtattttattctctttgaagcaattgtgaatgggagttcactcatgatttggctctctgtttgtctgttattgttgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttattttcttctcctgcctaattgccctggccagaacttccaacactatgttgaataggagtggtgagagagggcatccctgtcttgtgccagttttcaaagggaatgcttccagtttttgcccattcagtatgacattggctgtgggtttgtcatagatagctcttattattttgagatacgtcccatcaatacctaatttattgagagtttttagcatgaagggttgttgaattttgtcaaaggccttttctgcatctattgagatagtcatgtggtttttgtctttggttctgtttatatgctggattacatttagtgatttgcgtatattgaaccagccttgcatcccagggatgaagcccacttaatcatggtggataagctttttgatgtgctgctggatttggtttgccagtattttattgaggatttttgcatcaatgttcatcaaggatattggtctaaaattctcttttttggttgtgtctctgcccagctttggtatcaggatgatgctggcctcataaaatgagttagggaggattccctctttttctattgattggaatagtttcagaaggaatgataccagttcctccttgtatctctggtagaattcggctgtgaatccatctggtcctggactctttttggttggtaagctattgattattgccacaatttcagctcctgttattggtctattcagagcttcttcctggtttagtcttgggagagtgtatgtgtcaaggaatttatccatttcttctagattttctagtttatttgcatagaggtgtttgtagtaatctctgatggtagtttgtatttctgtgggatcggtggtgatatcccctttatcattttttattgcgtctatttgattcttctctctttttttctttattagtcttgctagcagtctatcaattttgttgatcctttcaaaaaaccagctcctggattcattgatttttttgaagggttttttgtgtctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggtttttcagtttccatgtagttgagtggttttgagtgagtttcttaatcctgagttctagttcgattgcactgtagtctgagagatagtttgttataatttctgctcttttacatttgctgaggagagctttacttccaactatgtggtcaattttggaataggtgtggtgtggtgctgaaaacaatgtatattctgttgatttggggtggagagttctgtagatgtctattaggtctgcttggtgcagagctgagttcaattcctgggtatccttgttaactttctgtgtcattgatctgtctaatgttgacagtggggtgttaacatctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctgttttgatctttgttggtttaaagtctgttttatcagagactaggattgcaacccctgccttttttcgttttccatttgcttggtagatcttcctccatccttttattttgagcctatgtgtgtctctgcacgtgagataggttgcctgaatacagcacactgatgagtcttgactctttatccaatttgccagtctgtgtcttttaattggagcatttagtccatttacatttaaagttaatattgttatgtgtgaatttgatcctgtcattatgatgttagctagttattttgctcgttagttgatgcagtttcttcctagtctcgatggtctttacattttgacatgattttgcagcggctggtaccagttgttcctttccatgtttagtgcttccttcaggacctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactgtcttctggcttgtagagtttctgctgagagatctgctgttagtctgatgggcttccctttgtgggtaacccaacctttctctctggctgcccttaacattttttccttcatttcaactttggtgaatctgataattatgtgtcttggagttgctcttcttgaggagtatctttgtggcgttctctgtatttcctgaatctgaatgttgtcctgctttgctagattggggaagttctcctggataatatcctgcagagtgttttccaacttggttccattctccccgtcactttcaggtacaccaatcagacgtagatttggtcttttcacatagtcccatatttcttggaggctttgttcatttctttttattcttttttctctaaacttcccttctcgcttcatttcattcatttcatcttccattgctgataccctttcttccagttgatcgcattggctcctgaggcttctgcattcttcaggtagttctcgagccttggctttcagctccatcgctcctttaagcacttctctgtattggttattctagttatacattcgtctaaatttttttcaaagtttttaacttctttgcctttggtttgaatttcctcctgtagctcggagtagtttgatcgtctgaagccttcttctctcaactcgtaaaagtcattatccgtccagctttgttccattgctggtgaggaactgcgttcctttggaggaggagaggtgctctgctttttagagtttccagtttttctgctctgttttttccccatctttgtggttttatctacttttggtctttgatgatggtgatgtacagatgggtttttggtgtggatgtcctttccgtttgttagttttccttctaacagacaggaccctcagctgcaggtctgttggagtttgctagaggtccactccagaccctgtttgcctgggtatcagcagcggtgtttgtataacagcagtttttcgtgaaccgtgagtgctgctgtctgatcgttcctctggaagttttgtctcagaggagtacccggccgtgtgaagtgtcagtctgcccctactggggggtgcctcccagttaggctgctcaggggtcaggggtcagggacccacttgaggaggcagtctgcccgttctcagatctccagctgcatgctgggagaaccaatgctctcttcaaagctgtcagacagggacatttaagtctgcagaggttactgctgtctttttgtttgtctgtgccctgcccccagaggtggagcctacagaggcaggcaggcctccttgagctgtggtgggcttcacccagttcgagcttcaggctgctttgtttacctaagcaagcctgggcaatggcgggcacccctcccccagcctcgctgccgccttgcagtttgatctcagactgctgcgttagcaatcagcgagaccccatgggcgtaggaccctcccagccaggtgtgggatgtaatctcctggtgcgccgttttttaagcccgtcggaaaagcgcagtactcgggtgggagtgacccgattttccaggtgctatctttcacctctttctttgactaggaaagggaactccctgaccccttgcgcttcctgagtgaggcaatgcctcgcactgcttcggctcgcgcatggtgcgctgcacccactgacctgcgcccactgtctggcactccctagtgagatgaacccggtacctcagatggaaatgcagaaatcaccggtcttctgcttcactcacgctgggagctgtagacccgagctgttcctattcggccatcttggctcctcccccgacttggtaattttatagattatttttctttgcttttgatgtcttaagtttcaccatgatgtgtttacaaaggagttttatttttgttttttctcatttgacacttaaggtatacttttaatctgaatacttatttctgccttcaattcttggaaattttcagccgttttcctgcaaatattgcttctttgtctttttcctcctttctgtcttttggaacttttatgagatatatgttggatcctcttaattcctcttctttctctcttaacttcccttttattatttgccttttaatagttctctttgctagtatctggatcaatttttgatactgccttatagattaataatatttttagaatgtatgtagaataattttccttcttcagttaaatttttatttaaataattataataataataattttttttttgagacaggatcttgccctgtcacccaagctggaatgcagtggtgcaatcacacagctcactgcagccttgacctcccaggtttcagcaattcctcttgcctcagctgcctgagtagctgggaccataggcgcatgccacctcaccaactaattttttaattgttttgtgcaaacgggtttcactatgttgccctggctgattttgaactcgggctcaagcaatccccctgcctcaacctcccaaaatgctgggattacaggcatgagccactgtgctcagcctataatttttatctctcagatttttttttttggtatatccacctatttttcatttatattggcctttttaaaatacgttgtctttttaatatattgctttgtttatctctttgaagactgaatacacactcatttaaaacttattttgaaactgttttgttactcggattttgttgatggtggagtagcctcctgatactgtatggtggctatcttcctcaatgtcagctttccttatgtgctttggacttttactatgcatgattttcttaggtgggagatttttgtttttcctttctctacattcacttgtcttctctatcagttttatgcttgcttctacctggcttccctcaactaggccagagccagatctgatatcgagagctgagagtccatgttctctggtaatttgagactttaatcatggagattgctggtggctgggtccagccctatccatgtgtatctgttgtttcctgctaccactgcacagccaaagcccaaataagggccactgaactttaagttttctttaagaggttagagaagccatatgtttgtctctgttttatatgtttagtttatttccctatcatgtgtttttggtccctcttaccttgcaagagttgaaatcatccctgttcctcactgtgtttttcttattttgttcattttccataaagcttaaaaagcaaatgcgtgagctagtaggagctacccactgcccagtatagaatcagagtttgatctaaactgaaaacaaaccagcttttttgttttgccacaaaggggatgcttgaggtgcaaggtcaaaaaaaggtttcagcagtttcagaggtcaaaagagaaggttgcttttcctggcttccatggccttgtcatgaagaggtgggctttacatgtagggttgacatgtcgtgatttgcaatcaagactgttaatgttcgtcgtcatcattccattaaccgtcaccaattttcagggcatttgaatgactttgaaacagagcgatctgtagttgctcacaaaattttactttcttagatatctaaatatttgattatagttattgaaacagcaagagaaaaggaatcttactaatttaaaaaataaaatacaaatatttatgctcaaactggacttgcattgggcatatagaaacttaagttcaactttttttcattttgctgaagtaacctccgctccaaatttgttttgttttgttttaagagcaacagaatgatttggaggacattaaatcacaatttcaaaagaagttcacaccacattttgatgcacatgaaacgggttttacgtttctgtggctgccttcagagattacacgtaactatgtcagtgaatcctgtcagttagacacaattttccaaaagaaacagactgggttacaatttaaaataggcataccaagaaaacatagaatcccaggaattttggaatggagtttatgatccctggaagtatactgaaatttctctgggtgactaaattatggattctaggtgtgtccacttggctgcaggaagtgcattctctttcaagacataaatcgggagataggatcaggatgttttcttaccaaaggtattgaaagagaagaaaagagatgttttccaactgaatacattctatactttcctggaattgttgaagctcttaaaatgtagttttcttatgaatgtattcatgattagcatcattgtattcacatgctaataacagtgaataaagatgctaacactatatggatgaagctaatttaactgtttattggtcagcttttgtctataccaaaaaaagtatgtgtttattgagtaattaagttgtactttaccattaatacaatttaaaaaatgccttgacccttccaatacggattcctcatctgtttacccatttttgcaatagcttgaacccctgccccctccctcaatcgactaacacaaatggaaaatgataaagagcaggcagaggaaggaggaggagaaaagtgaagagaggaaggctttcaagacacttcctgtactacatgccactgaagttcaagtaatagttgtaataataaccaaaatatagatttaaaagtgaacattggtgtatggttttagaatttcacgattttgataggtcatttaatacttccagtattttgagtgtcagattgcttactctgtctctattcataggtcatttaagtttttcctgttctgtacattgggcaagttgaaatgtggcgaggattaggaaatgtagtttaacagtaaaaaaagaaagaaaaaggattggaatttaggaatttagtatagctgttttcccttaagcagaagtatgctgctttgctagtcagttgtggaaaggcatctggtggtgtcatcctaccaactcgtgtgcagttgcgactcacatggctttatttgataatagtctgcaaacgcttgatgagaactggaggcgcaagtagagattggagatgctggagaaggaattttctttgtaaaggcttaggtaaacagtaactgccttagagattatcttttgtcaattaaatacttttttattataaaacaccttgttttcaagtgtttcagttcttattatttaataaaaagaaatttccatggatttgagttccactcctgaagaaaaagtaaaaaaaaaatctatctatctatctatctatctatcttctatctatctatctatctctacctacctacctatcatctatctatacattttccaaaattaagcacactgtaaagtaaaatttccttttcattttgtaataggtttgtaaccaaattattggaagatctcatattctttgttgctgatgtgcctaataatggacaagaagttctggatgtggttatcactaagccaaaccgagagcgtcaaaaattgatgagggaacaaaacatactggcacaggtgaattttttcatgtactaaatttgtatattttattttctgaattacagtatcaggaaaggccttgtattagttatctattactatgaagcaaatgatcccaaaacttagtggctgaaaacaagatacttcttgtctcacagtttctgtggagtagtgatctaggcgtggcttacatgggcagatctcactcagggtctctcaccaggctgcagtcaaggtgtttgctggggctgcaggcatctcaaggttcaactgagagaggacttgccttccagccctctcacataggcatctctcaggagtgcctcaagacaaggcagcttgctttcttagaactgagggatccaagagagaactagagaggacgctcaggtagaagctaccatctttgtagaacgtaatcttagaagtaacatcagttctactgtgttctattagttagaaatgggttaataaatctaacccgtagttaaggagagaggattcgatgaggctatgaatatcaggaggcaggaatatcagagaccattgtagagacagcctaccatggacctccaaaaaccctgcatagtcagactatctccagaaaatatgttggaaaaattcctaggtagaatttccaggtgaacttggaaagtgccatctccatctgcttcctacttctttccttctcttccctgggaaagtagggcagtctgttcatcagctcacgagtgctctgtacaatattctagttttcttccctgaaagtacagaactgctcctgtattacatcttcttgaaattgttcataacacgtcagtaaattgattcacttcctaatgatatgcacatatggacatgcctacgtttatgtattatttttattctattaattgctatttaaattaatgagtttcttcattaatgaagtatagactcaaggaagatacttaaaacataaaaatcatgttcttgatacacatattcttattgatttgggaaaggaaaatagtagacataatgttagttattatatgtagctgattgtctgaaaatacaaaatcaacttttttctcaaataaaataaaggttgcaaatctaataggacttttttcgagtaattattatataaaaaatttgatttcaaagacttttaggaccttggataattaattaataatattttaaccaacatatgtcaaatattttatttttgtttgataaatataaaattaaaggcttagtgaatacaaaattattaaagaaactttagttcatatcatatttcatgaattccaaagaataattcctttctattttgttttcatgtattaatgttcatgcccttgaccgctctttcatagacaatttcctcattctagcagctcatctccaggtgatccctcctgctgtcttgctgccgaaaagagttatattcctcaatgctttttaaatgcttcctaactgctaaccttcttacaagaatctggcttactgggagccaccagctgcccatgtggctcctaatttgtcacatttgaatgctgatatgttcatcgatttggccacatctttgtatacaaacaacagtaaattaactcttttataaagcagtttagaagcaatgtttggaagtcattttctgatgtcagttttaaagaaaagtaaatgttttctttatattattttgattttgaaaggttatagaaaataatagaagaaacttattataaagcccctagaaatcaagctacattttagttcatctgaatatgttcatgtaacttggtgaaattgaacatcttcatatttcttattttataaaatatgatttctaaacaaaattaagcattttatttaaagaatgtttttgtcactcaatgtaggtgacccttttggcagtacttttctgatccttgatatgttggtcctgtaacgtaaatccttttgtttttcccgtttactctaatactcaaatttatataagtgttttttgaatcaatgttcttatttgttaaaaaaaaaaggttgcaaaacattttattcatcagaataggtggctgtttttattcctgataggtatttggaattcttaaagcaccctttaaagagaaagcaggagaaggctcgatgctgagacttgaagatctgggggatcaaagatatgcaccctacaagtacatgctgcggctctgttaccgcgtcctgagacactcgcagcaggattaccggaaaaatcaggtcagagggtagcccccattttaaactgtttcatatgtaaagtatgggcaaggttctttggttataattctacagcatagaaagtaggaatgggaaatttcactttgaaatgaaatattttatgttgggcaatacataaaaatgatttgtaagtatttttgagttgtattgaacatggctttattcttccatatgaaattagaatcactgggggaggatgtcctgagtactaatatgtgcctgttattggttcctggtggccaggacatcctggatctattatgtaaggaggaatggaacatttttggcttgaggaacatgtgaggtacagcatcaccgtgtatggaccaaagaggttatagtttagtggaaaagatatgatgggagacaaagaaaagacacagagagaaaagatagagttatgggaattcaccagagggagagcccagtggtggctttgggaaccaaggaagaatacttggagaaggaagcctttgggtaggatgagaatcattttcataaattgtatgggaagaggtatttgtgaagagagatctatgaagtgagaatgatagatgctagaaaggacacgtttcccctaagatatttgcaactgctgaggtcagggaacccagatggatctaggggtacagctaacagttgccagttgcaagtgaaatttctcttaagtctcatttttatcttaaaaatacaaaccaggtggcgtggctcaagcctgtaatcccaacactttaggaggccaaggtggggggattactcaaggccaggagttctagaccagcctaggcaatatagcgaggcccccatctctacaaaaacgaaaaatacctgggtgtggtggtgtgtgtctgtagttccagctactaaggaggctaaggctggaggatcacttcagcctaggagttcgaggctgtagtgagttatgatcacactagtacactccagcctgagcaacagaatgagaccctgcctcataaaaaacaaaacaaaacacaagcttaatattttgcaatgtgttcaataatgtaaatgtctaacatacaattgtataaaattaattattgtttgataaattagggtttctcttaatccatttgagggcagagtgcatcactgtaagtttcattgatgagtttggtccatgaagaaggatggtgtgggagagggctggaagggcagggtgggctaagccactagggcctaggatgtcaatcctagaaggtggaggttatttgggaagagttagtagtatttattgtgtgcttactttgtaccaggctcagttgtaaatacttgtcatgaattaattcagttaacactgaattaagatgaaggatagaggcacagagaggttaagtaatttgtccaaggtgatagtttaagaatggaaccagtatgcaaacccaggctctgaatcatcacactattgcatcttggtagtttgaacatttttggggaagaaaaaaagatttgcttgaggaagactgtgttaaaatgttttggcttcacaattctgtttgaagagtaagaaaggtctgaaaagagtatataaaaacattagctagaagataaataatatggcaaggaataggagtaagagctaggggtgatataaacaaatccttaaatattgtctaatataatcctagttataaacacccttcttgctgatccaaatgctgtcactagaattatttttccggacttcattgggttcctttaagatggcaagatgaagtagatagtgttgttcatatttttttggaagaagaattaagtagcaggacattaaatggccttccttcaagcacttggaggcagtgttaggggatgctcccagtatcggaccctgagtttttagtggaggtctggagtggggaagggaaatgagaggctgctcaatgttttctccttgctctggtttttcttcttgggtttggagaaatacacttgtgagactggtcaccacttcacccgtacgagcagtgctgtattatagagattgacattaacagaaaaaatacctaacaggtctatagaggctacccagggccctcaggcccatcaggtcccatgatgtgcaccctccttgatggctgtcagcctttggaagggtacttggggccccttcccttttctatagccctgtgcttcgggatggcagggagccagctcactttggatttggttattctgctagtcagtagtaggttccctgggcgacatgtcttacctggtgtcagttctgtctctcaaggtctggcacacatggttctttctctctcccctctcagtcttggccagggatcagtgtgtgcgtacacacacacaaacacacacacgtgtgcgctcgtgcacgtgcccgttccctcccacccccccccccccacacacacacccctacctagtcatatcactcctttcaggtacatgtttatgcactttagggacctgccttctgggtttctttggagcatagagttagagcatagatgataaaggaataaagaatccccagcatttgttaagggttatattttatttttcttccctttctgttgtgtgttctaattgaatctcagtgatagctgggaaatgtttttctcatttctattgagttaagaatgcttggtagtaagcataaagcagctttctgattttttagaacattttaaaatgttctatattattattattatgtagtatatattatatagcattatggctataattactttgtttttctttatcttcacctatatgttgtagtcctaataggaagttcatttgtgacttaacactcacccatatatttaatattgaagatctatttattactatttataaaatttgataccacctctaatttcatttagttatttattaacatttttggatgtttgccttataccagagtatgactacagtagtcatgaaagtgtataaatcaatatgtatccttaaaatgatataataacagaagacatttactttacttaactggctccccaatacacaaagccatcattctgaagggccacaaaaatgctgcttagcatataattagatttgtgcaaccaatatcattttcaaggaataggtacattccagtaaattttacctaaggcaaaaccactttctaatctatcagttgtcttgtcagagaaacaaagacacatttccagggagaatcccaaggaatcaaagtaagaacctttcatggtggaagggggagaagctcaccagtcccatggcagtgtgagatgtgctgcttgtagatagaacgtgggagatgaacaatagtggtttgggatataggaaaattagtgtgatgaataaggagtagatcaaacaataacatgattgaacctccccagtggctttctcttacttttagcacaatctctttgccctttaccatggctcacaaggattcttttgacctacctctcaaacttcgactttgctttctgccccttaccactgcctagctacaatggccaccttctgttgatagaacataagcttggttctactacctcagggcctttgcactggctattcccactgcctagatggcttccctttaggtcttccaatggctgcctcgttctcttcattcccatcctagctcaaatgtcacttcttcagcataggccttcaagaaacatttattgggcaaatggatctaatcaataaagtgattaatcacattgccctgtttggtggctttttaaagataaaaagtatatgacattttaccattattttaaagaaaagatcttacagatcattccagcctattcacagaaaaggaatcaatccaagtccatctaggatcttcaggtaacaacccagatctcatgtctcatgaatgaaatatcaggcagtcattttcttttctataattatgcccaaatcattggctatgactttaagtaagagatagaagaaaagcctctgttagactgatgaaatccaaagttattgtgtcataaaagcttattttaattagatttatttttcccacttagcctctgttagactgatgaaatccaaagttattgtgtcataaaaacttactttaattagatttatttttcccactttggaaataggtatttccaaaatacctatactgataattatttctaggtgtataattttttagtagaagttcaaaaacgtatatgccagtatgttttcatgtctttcctcaaaaagctctatttattgaaaaatttacttgcttttcttttgagaaaatttttagtgaaccttctgttgtgaataaattaatcaatgttgttgaccctaatagaacctgttatttgtaagctgtttggcagtgcattctgacagcctttcttctttgcaggaatatattgctaagaatttctgtgtcatgcagtcccagattggctatgatattttggcagaagatactatcacagctttgttgcacaacaacagaaaactactagagaaacatatcacagcaaaagaaatagaaacatttgtcagtttactcaggagaaatcgggagccaaggtttgaaatgattcatgcggtattcttttctagtggagattgcggctttatgttttatttttagaacttttaaaagttagagttctttcacatcactaacttttatggacgaactatgttgggcttattgctataataattgtatataataaagagttattacctcataagagatcagagccctttatagacatacttaagtgtgattgattttcactctgaatcctcatgattttatagaactttatggtttctcaaaatacattcatatacattatctcatttagatccttgcacacttgtatgagatacactggttgtatattattatccccattttagagatgagaaaatagaagccgagtgagcaacttgcccaagcgtaccctgataggaatagaatacgaggtaaatcaagggcttctgactccacatcaagctctttttctgttgtaccatgctgccttatcttgaagaaatgagtgcagacaagtcaagccaattggcaatgtttccttagctaattagcacagcaaataaatgctagaaggtagaaatgggcctctgacttgaccaggtcatagtaattttcattaggtgtgtgctctatttctcttttgttcagtacagcattagctttgatctgcctttgttttgatattcagctctggggagactcactttaggggagatgaatgattttctaaacataagtcacggtgctgtgggtggaatatcataaaataaatagaagcaaacacatcctttttgaaacaagacttatattaaataaaaagaattgtatgtttaatttgtttctaatgatgcagtagataaacaacacattagacaaatgttgtgtggaaataatattaaaacatataataagtttattttattatattccaaattatgtctttattgtgatgcttttataaaatgctttgtcttcatattccatttaatttttttcttttgccaggtttttggattatttgtcagatctgtgtgtgtctaataccactgctatccctgtaactcaagaactcatctgtaaatttatgttgagtccaggcaatgcagacattctcattcaaactaagtaagcccagataatggatgcatcattttcctgttgattatttgtaagcactgtaattctttgtcatatttacaagtgtactttttagtagatttttgtatgtgctatttatttgaagggtggtctcaatgcaagcagacaaccccatggagagctccatcctttcagatgacattgatgatgaagaagtttggctctattggattgacagcaacaaggaacctcatggcaaagctatcaggcaccttgctcaagaggcaaaagaaggcaccaaagctgacttagaagttcttacctattacaggttaagtattatagacaatcttacaataattcccagtctcacatattaattgagaactggttctctgtagccactagttaggtatctatgaagaggcaattttaaaagtcatgtcagaactagggtagctgaaatatttagtattgtttaaaatattcaaaataaaagttaacatttatattttctgcatacaccacttgtaatttcctggtttctcactagcttggaattattgtgcagccaaaggctttgtcctcatattgagtagagtggaggcagatgagaggcatgttaggacctaggtgatggagttgagagggatatagacatggagctaaggaaattgatctggctacaagggtagctcagagcaagtaagccagtagtttagtatagagtggattatgaatatgtggtgacctagagcctaagagaaactggtgcctgtagttaacgaaagttcagccccggaatatggcagcggaagtactgaaggcagttcctggtggtcaatatattgggagcaagaacctagctggcatctttgagttgcaggtatagaaacccaaggcagaagccttggggccaagttgggcccaaatggcaagaatcagacaaagacagatgacgctttgtgctccctggtttctacagctatagcaaccaaatcaaaggctaattcttaatctcaaaactgggctgataagccaagtgactcatgccatttggactgatcacttttggtttgggaactgagtggggcaaaacctggagtgtagacactagagctagaagctgagtgaggctggcgaaggtggagagagatggtttcatgtgagctgttacccatagccttcagcctgagtgcagtatttgtcattctaggaaacccagaatggagtgcctagtgacactctccagcagacacattttgctgaaacaagtaagaggtattgtaactgaagggacatagagacagtttcatatatgtcttgtcatttgatcttaatggttaacatactacagtcaagagtttgactccaatatcatgaatgcttggaaatacaggtgtcttaaacatagatactgattggtactatgacgtttaaagatttccttgagataagacaataatgtaatatgtttaccatttttaaggtaccagctaaacctctttgcaaggatgtgcttggatcgccagtatctggccataaaccagatttctacacagctgtctgtagacctgatcctgcggtgtgtgtcggatgagagcctgccgttcgacctccgagcgtccttctgtcgcctcatgctccacatgcacgttgaccgggatccccaggagtccgtggtgcctgttcgctatgccaggctctggacagaaatccccacaaagatcacaattcatgagtatgtttggaaaaaggtcttgaggctttggaattcatcagatgaactccacgtcaaatgtctacagttttgaaatgaaacatgtggaaaggcatttgtgtatcctgtcttgggttgttaatcttctaaatgcaaataagatactcgttttgaagggtgaaatgataactctcagtggtaataaaggcactttctagaaaacagtaaataatattgatgtaatgagcaagaattgtaagtacttaatattgtggtagactgatataactgctttacacgtgctaactcatttcacaatagccccattttacagatgaggacccagcctctaggaaagctaactaatttatccaagattatgcacccaggaaactacgtgtgttttcctatttttaaatgattgcaatcagtttaacttgcgttatcttctttctctatttccagatatgattctataacagactcttccagaaatgatatgaagaggaaatttgccctgacaatggaatttgttgaagaatatttgaaagaagttgtaaaccagccctttccttttggggataaagaaaaaaataaactgacatttgaggtactttgtccctctaatatttaggatgttttggtaactgggtagtttagttcatgaaggtattattttctctgctttttttttttttttttttgagacagagtctcactcggtcgcccaggctggagtgcagtggcatgatctcggctcactgcaagctccgcctcccgggttcacgccattctcctgcctcagcctcccgagtagctgggactacaggcgcctgccaccacgcccggctaattttttgtatttttagtagagacggggtttcaccatgttagctgggatggtctcgatgtcctgacctcgtgatccacctgccccggcctcccaaagtgctgggattacaggtgtgagccaccacccccggccttctctgccatttttagaagatagatttggtgctttgatgtccagtacaaaacattttatttataattgtctattaattactatttcccttgattttttgtttcatttgtgtaagattttttgcatgtaataaagaaaggcagttttgcatattttgtaaaatgtttggatacttttttttatctctatggagatgtttttattttcaccaaactgaattgaaatactttcagtttggggatgtagtgacaaaactagagaaaggatgctgttacttgataactggtgtattagctacctactggtgtataacaaattactccaaaacttgcagcctgaagcaacaaacattatcatagcttctatgggtcaggaacctgggaatagcttagctgggtggttctggctcagggtctgtgatggggtagccagcaagctgttgactgggattgcagccatctagggctggacagtctgtttctaaggtcactggaggggttgttggtggccacacctccttgctggctgttggcacctcagcttcctgccatgtgggcctttctgtaggctgcctgggtgtcctcatgacatggtacctggcttcctcagagcaagccatctgagagagagagagagagagtacaagatggaagttgcagtcttctgtaatctaatcttggaagtgacatgtcatcacttctgttggttacttggaccaactctgatacagtgtggtagggggagactgtgcactggggccacatcttggaggtagactctcgcacttggaatgtcctgtgcgatccacaagaccacaaagcagcatagggaacatagatttctgggcaaatttcttggataatagccatttattaaggtaattaattgatgcaaccatttattaagtggcatcctgctgacttaaattacttaatgtttaattaggatgtaaataattctagtgtaaattttgttaagtaccttaaagcactctgagtcttgcttggatttagttctagacttgaataaatcaaagttcaagtggttgcttttgcaagtattttaattcctaggtgttaaagaattaggaagtttagaaattgctgtgctaatttagataataaaaaagccaatgtttatttcagtacccaatttttttttccactctttcaccctccccctccccgcttttttttttttattaaggtggtccacttggctcggaatcttatatactttggattttatagtttcagtgagttattaaggctaacaagaacacttctggctattttagacattgtacaggcccccatgtcatcatactttgaaagattaagcaaatttcaagatggaggtaagaattttgggaaatgtgataatatcattgttattacttggaagtaagataaaaaacaaaactacagagaaggggttgctattgtgtacctgctaatatatgtgtgcatatgaacacaattcctatgacagggctgagtgataataaggtggatttacaaacatgcatctctgtttataatgctaaagctttgaaagatgaattcataaggtcagattccatctttagcaactaacattatagccaagccacttgtgaaaatattctgtgttaaaaaatgaaaacatcttgatgtttgtggtcatgtggttcaagcaattctcctgcctcagcctcttttatttttacaaatacagatgaaattataaggtgtcaaagagagaatagatttgaaggctgtgctccacagcagagcttagacggatgcaaggaaggccaggcacggtggctcacgcctgtaatcctagcactttgggaggccaaggtgggcagatcatgaggtcaggagatcgagaccatcctggccaacatggtgaaaacccgtctctgctaaaaatgcaaaaattagctgggcatggtggcgtgtgcctgtaattccagctactcgggaggctgaggtagaattgcttgaaccagggagtcggatgttgcagtgagctgacatcgtgccactgtactccagcctgacgacagagtgagactccatctcaaaaaaaaaaaaaaaaaaaaaagaaagattcaaggaaagggctgccaaagtatcacgccagagaaggagtgaatgccacgccagtgtgggaacctgtggagtgaagtggataagagaatgggttttcaagttagagtatctgtattcaaatcctgccttgaccatttataaggtacttgtcttctctatgatttttcttttctcatctgagatatgaagatggtaataacaatatccttctcacagtttccttgcaagaattgagggaatgtatacaatatattcaatggactttcaacagtgcctgtctcataagtcaatacaaagtttttatgacgattgtcttgggttggataccctaaaaacaccctgatctagaggcttgtttgcagaaggtatatcgaagagtgcacttggatatgtacctgtaaggaagtgaggaaggtaggactgtgcaggcagagctcatctgcaatgcagttatgactgagacctcagctcatcctgtagggagttttggagctgggatgctctttggaattgtcacaaattaaggcaaagggggccaccctttgtgtctttgtatcagccagctattagctacttggcttcatcctggagggggctgtgtaacattgggtaagagtctggcctagtgagaggtacagctgtaaatagttagcaacaagaatgcccagcagctgggcccttaagggcctcagccttgaaaaggggacatgggtggagcacaatagtatccactacaacatccactacagtattaaaagggcaaaaccagaaacctaatttcagacataaagaagaaatacctagttaagaattataaatgagcaacttacagtaagctgaagtaattaattgctgctgcccaaatctcaattccttttatagctttcaaaaaactgtacaaatcaataagaagccaattgaaccacagaaatccctcaccttcagcataactagaagcgaggggacagtgcaaatgctagttactgtaagtagaaaaataaacattcatttttagtacagctgcctggtgagctcccattgcaagctttgaggatggtgagtggtttttggagaaactggggaagagaaaagggatcgtgtgcaaagggaatgaaatgaaattgtatgaaaatcacccttagaaagagaaagtttatctaggtgtgaaaatatggaaaaagtatccaggtagataagagcaccaacttaaaaggaagggacttgaaatagcacagggagcagctgtggaaaagcagtgcttctagggatgaacaaggttgcaggtaagggaagggcaccccttcgagtcttttggtgaaagaaaaagaggcaagatggggagatctagaataccacaagacaaaagaaacctgaaacatcgatggacataccactcctccaccgacctctaccaaaagccaaattttaaagaaactgcacttcatgactctgacaggagggggcgatgttgaacaagagatcctataaacccgctccttgtggatcctgtctgctgaatgtgtaaatgtcatcggtatcactatgtgaaaccactgtaagaccaaaacagaatggaaaaatctaaacacctcagtggatggaaattcctctctgaagagtaactgtgaagcagaagaatattgtaacatggtactctaaatggaattaagtagcttcaagcacagtggactatggaaaacagtttgattcataaattcaaaaactaagatcagaaatggaccaaaacccaagaagaaatgaaatgaaaattgattgaacttaggaaagaaatagaataaaatggttggctttatttattcatttattttttaccaatacagattaaattataaggtgtcaaagagagaatagatttgaaggaaaatcaaataggtgacactgaagaaaggcaggagaacaatgaagagaatgacaatgatccaaagaaacaagtgatgagggtgagagggaaagaggctgaaatggaagaaaggcaaagaagagccaccatatgaataactggagtccctgaagaagaaaaacaagaaaatggaacagaatgagtatttaaaattgcaatccaagagaacatttggaaataaaagacaacctgaatctacatggtgtaattatccagaatggtaatctctaagagcataataagatgattatatatagtatacattcagaaagagaataataagggtttcagagaggaaccacgaaagcaaatggagaaaaaaggaaagcgtatatgaatattctttactattattgcatctttaatgtaaattgaacattttataaaaataaatctatgagcaacatatgaatgagaaaaagcaaagaccaagaaccgtagttgttaatcaaagagcagggacatgcaggggtctatattaattccgctgcctgaatctcactagtgagactccttttaccactcccagagggtacataacacttgaaatgtccatactaaagctgcttgttatgcttttacaatcttcaatctaaactaaattattcttagaaagctagaagttgatcctgacttttgatctcactgcttacaatctgccttcagtgtttcaccatgaagagtattttattaaagacatttttttttagagcagttttaggttcatggcaacattaagaggaagatacagagattttttatttatcacctgccccccaacatgcatagcgtccccatatcaacatcctccactagaggggtacatttattacaactagtgaaccaacattgacatcattattcccaaagttcatcgttgacattggggttcactcttggtgttgcacattctatgtatttggacaaatgtataatgacacgtatctaacattatagtatcgtacagcatcttttcactgccctaaaaattctctgtgctctgcatattcaacccttctcccacctcctcaccatcccctggcaactgctgatctttttctctttccatagttttgcctaaggaaagtactttttttcttggaaaagttgttaccttgtttgctctctccaccgtcctgtttatatctgccctcaaagacacataaatttaatttctataattctcatattttttagtgaattccactgacttctagataccttaattattctttcagcaatctgataataatttattaatttatttaacaagaatgtattgaagaattactacatgccagacacagttctagtcactggtaataagtaatgaacaagataaacaaagttgttagccacagggaagacaattaataaataaatgggcaaaatttctcctttctcctattgggagaaatagtcagattatctatctgtctatctatctataataggagaaacagccaggttatctatctgtctgtctgtctatctatctatctatctatctatctatctatctatctatctatctatctagtctatctatcctgtaacatctgataatgctgtgaagaaaaataaagtaggtcaatgatatggagactgatggagtgagggagggtagaattttgttttaagtttggtgggcaatctctggagggatttgagaagggattgatatgatctgatcatgttgactgctgaatggagaatagagaatatctatgtgggcaaaaatgtcgaaggctgagaaactgtttcagattaaaggagattaaagagacatgacaactaaatgcaatatgcaattcagtactggatcctggattaggagaaatattatctatagaagatattattggcacaagtgatacaatttgaaaatggattgtagaaatatggattgcaggttatatttgaatattgattatgtcagttagatttcttgacttttgtaattgcactgtgcttagctaagctaatgtacttgtttttagcaaatacatgctgaagaattgaaagttgaaagggcatgatgtctagaaccaactttcaaatagagcaggaaagatgtgtgtgtgtgagtgtgtgtgtgtgtgtgtgtgtgggtgtgtgtggagacagatgcaaatgtggcaggatttgtgaatctaatcaatctgagcaaagtctatgtgggagttctttgtactattcttgcaactctttctataaatttgaaagttttttaaaacaaaaaagttaagaacttaaataattaatctggtaggaaaacgatttatgttatgcaaggtgacaattcaaacttcaagaatgatcttacaactctactaggagatgtgttattaatattatagctgggttctctcttagactataaattcctaacaaaagttctgttagactgtataaattcttaacagaagaagcaagaagaaacacttttctggaatctccaaatatggagataggattgtcaagcatgggaaaaattcctgtggtgcagggtgagacaaaggtcgatgccagagaggaaatcccagattgtggaaagtacctagagaaaaaaaaagaaatattattttaaagatcaactgttaggagtcatagcaatgttaccacattacaatactctgtatcatcatcttggctctttgatatctaaatgatttggattgtattttcttcttttttttttcatatggactcctctcatactgtaagtatttttctcttttaatgaaactttatcttcaatgggaagtcatttgcaaagtacaattaaaaaaaaaaaaaaaagaaagtggttttataaacattgttgctagatagaccagttcctttaagtaaatgatacagttctgtatgctcatatcatgtcaggaaaattttgtgtactagaactacatcttttttatccttacttcccacttactaatttttctccagcacagttggggttggacatgcagaaaaatgtgtttggcaggtcagacgcaggagagcagaagaggaggcatatctagaaggaaaaggctttacagttcctggagttccattttttgccagcctcagtggcgccaggcttaaataggatgtgcacgcacagcattcatttgttttttctgggaaatcctgtagctttagatgccagtgatgagtgtttgaggttgtagagatggctggcttggaaagtggcaattacagaagtttttttcttctgcatccttggtcacacagcagcccacctcagtgtcattgtaagttgtcctcatcctagatctggttgggggtctgcgtctagcttccaggctgtggctgctccctgtcacaatggcttatagttggcacgctcagcagaaattgctaggctcagaagcagctttttatctttgtaccctaaaggtggtccgttcagaaaatgattgaggcttgctcatatggagacacagggagctggcactgctgtggccttcactgtagtgaaatagaagatcagatcttcaggactatcaatccaatacctttcattggctatacatttacttaagaaatattgttttcaaacaaatgtacttgctcccaggaggctgtgtggttgagtcaatttgctttgcctaatacttacgatttgctctcagtgattttaaatgcacaggcaccattcagtgtaattgatcttttgagtagaaggattatggcaagccatgttcttctttgtcacttatagaagttaaaagcaaatgcacatacaagctgatgaactggatattttccatattctttgcaaacatttcacttttagaagcatacatctgttttatacttgctaaaggatatacaacccaaagctttctatttctactaataattaagagcccttttttcttttacaacagcatgggtatattttattctactggagagtcacttaaatagttgaggacaaatgtgaatcccacttacacatcttctgtggaacagcatgatatgtgtataactctgaatcattcgagtatcatctccatgtgaatatgcatgtggttagaatagaggagtggacacagtctggaaatggtttgggtctggtttgttatttagttatcctgttaatatccttctacctatctgtgcttgctgtttgaacgggactggggttcaactttggatctccaacatggaacaataaagtctacatcgttcagtgaactttgggcataattactgtgtctaggacaccactacaatttcttttcactgttgtcttcctgcccatccttgaactcaccataatttgaaaaggcagtagatcatagaaaactaccaaaagaccaaccaagagctaaatagtttcttcatagcttctctcattttgcttttgctcaatttcaaattcttgggagtttccatagctaagcactgaaatgtgggcctattcccagtcaggaaccagataatcctttttgttggtatatatgttatgatgtagaaaatgaggagtcacttaaaaaaaattcaatggagaattccatttatttgtaggatttctttttctttgaggattcagagttggaaatgaagtgcctttggccttagagaataagatacaggcaaccacaacagcctggaattatcctcctttcctaaaataattctgctgtcccgagtgacttacagccctgtggacccaacccagggtagggcggagacaggaggcagggtagtgagatgtgctttgaatctatctatgtccaggagtaccccttgccctaggagatttggggaacaaagtaagaggatgtcaactctccatctcctggcaaagagccacttgcttgtgcagtttaattttttgtttgtttgtttgcctttatagggactgcacattatctaccttgaagtgctttttctggcagcatagttactgttaaaaaggagaagggaaattgagatgagaggggcggggcagaaacatttttaaatattgctttatgggtgagaaaggaagaaaatatttgcagacaaaaaaaaaatctgccaggaaataatttcttcttttataaaactacgaggttagtctaaatatgatctttgcaatctcttttagttcaaaactgattatttgaagattagtatgtaatcttcctcgttcattgaatggcgttcttcttttatgtgtgttgcaaaacaacctttttagaaaatatctgtgaagcttatcttctgattaatagctatgattgttctttgtaagacaccagcttgaatgtcctgaaaccagaagccctagtccactggatatactcagagtatcttaccaaaaaaaaaaaaaaaaaaaaggaaagaaagaaagggagaaaaataaagacttaaccgagtgtgaggtgagaccatgaaaaagtgtgtatgtggaaatgggggatcagaaagaatagaaaagggtttagtataaggatcaaaaccaaagaacacatacgtacaagctagtgtcctattacagactcttcccagtgttcatctcttttgaatttttcacctgactgagctcttttcaggtctctgcaaagcagttaagtttgcagtagagttcacagtgctaagaagtgttagcaaagtttacatgcaaagggaaggcacaaccaattaccgtttatcacttgaaaaactcgatttctggacttagcacttcccagcaccatgctgcctctgggcattcaagcttattcttcttgagatggctcgattctgtctgtcctccctctgtccatgctctgctttcagtgaagtccctttgtttctgaaagaactatcttatctccattatgtaccatgttccccacacttacccatcttccatatgtggttcctttctccctacaccttctggccatccaaatcacacactcaagtcaagggaagctttagactctaagaaaaggcaggaacatgggtataatcccatccacagtggtaggtttccttcttgtccctttgtgtctgtgtgtattgtatcagatgagcatgtacttctcataacatcttgaaatccttgcactgatttttaaataacagcagcaatgaccacaattctcggcaactctagaattacgtattgccagttgtgttcctcaggaagcagactctgggagaggattagcatgaagaagacttattagggagagctcttaggatcaacaccagtagaatgggagggaaagcaagattgagaaagggagaagttgggttgtgatgcagtttagtggaggcttctgggaggttgaagttgggatgtcttcagggctgtctccattagggtgagggggctgagcctttatgtccccgtaggcagctctggaatgggtgagtgaccgtgcttgaagtacctgtcttcagactagttgtcttagtcggcctgggctactgtaacaaaaataccatagactgggtggcttgtaaacaacaagcaattatttctcacagttcaggaggctaggaggtccaagatcatggttgatatggtttggctgtgtcctcacctgaatctcctcttgaattgtagctcccataattcccacgtgtcatgggaggggcctggtgggagggaattgaatcatgggggcagtttcttcctgtgctgttcttgtgttagtgagtaagtctcatgagatctgatggttttataaaggggagttcccttgcacatgctctttgcctgctgccatgtaagatatgactttgcccctcctttgccttcagccatgattgtgaggcctccccagccatgtggaattgtgagtcaattaaacctctttcctttataagttaccgagtatcgggtgtgtctttattagcagtgtgagaatagactaatataatggtgccagcagattcagtgtctggtgagagcctgcttctggttgatagatggtgctttctattgcctgggccccacagctcaccagggcatcctttgaaatccaggtggaggcagcagctcctccccactcaactcccccacagctttgctggacacagtgcatgctgtaatggggtccactggagccatacctggggcagcctaggagcccagtcacagggtatgggaaagtgaagctcatgatgtgaggtggcaccccctcctttgaaatctttttggccgctagctccttatattctgggcctgtgatgggaggggcatccctgataatctcctaaatctgctggggtcattcttccattgttttggacagtaggtcctggcttctctttaggtggctaattcatctccccattgtcatgataaatagcatctggcttcccttgagatgcctgatccctagtaaactctttacgaatggtcacttggccacacttccaaacagactttttcatgtttttcaatatggataggctgaggattttccaaaaattcaagttccgtttcctttttaattagcaattccatctttaaggcatttctcttttcttatattttactgtaagcagtcaggaggaaccagacgttctgtcaacactttgcttacatatttttcacccaaatattcaatttcatctctggcaagttctaccttccataaatcagtagggcatgaatacaactcagccaagtttattgctactttatacaatgatggctcttctgtagtttccagtaagatgttcctcatttctatctgatacctcctctgaatgacctttaccatccatatttctaccaatgttctgtttgtgaccttctatgaagtctttaagaatactcttagagaattcaaaaagtattagagctacatgctttctctgtagctctcctcctctcctctgagacttcacagaatcatccttaaggatctgtttatggcaatgttggctttttcttggatgcacatgaaaactcttccagcctctacccactacccagtttcaaagcacttctacattttagatatttgttatagcagcatcccacttcttcgtaagacaattttctgtcttagactatttggactgctataacaacagcaacaaaaataccataaactaggtagcttcaaaacaacaaacatttatttctcacagttctggaggctgggaagtccaggattatggtgcctgcagatttggtgtccagtgggggtctgctttttggatcacagatggcaccttcttactgtgtcctgacttggggaaaggggcaaggggaatttttcttgggcatctttcgaaagagccctggtcccattcatgaggactcctcctccatgacctaatcacctcccaaaggttctacttctaacaccatcaccttgggagagagtatctcaatgcatgaatttcggggggacacaaacacaggggctggcagttgagtgctgtcttctgagtagcactccagcagcttggggagtagacctccacttctgaaagggaatctgggcaggagcatcacagcatccaccacaattatcttcctagaaaatgccctgattggaaacattttgggtcaagactaagatcttgtcttggtccattttgcacagcaggccttttttggaatgctgtttttcagatgctgaggaacatttctgtgccattgtcatgttctgagtctggttctcttgtcagctttgtgctatgctggctgcacctctaagtcctttctggattaatgagtaatatcttttgcagaatgcctgagactgggtaatgtataaggaacagaaatttattgctcacagctccggaggctgggaagccaagggttgagaggccagcatctggcaaagatctccttgctgtgtcgtctcttagtgggagggcaaagagaaagcaagagtgtgagagagcaagatagcgctaaacttattctttcacaaaaaacccactcctgggataatgccattaatccattcataagggtggtgctctcatgacttcaataccctttaaaggtcccacctcccaacttcacaacattggagatctagtttccaacatgtgagctttgggggacacattcaagtcatagcaggtgtcataggaaatagagattatggagaaaaataaaaataaattataacatttaaacatgtaataaaattctagacatgaaaacaatggctagaagcttcctatttccaggtgccccagaatcactggcatcagaaacctgctctaggcagcaagccttttgcaggatgctgttcctcaggagctgagaaagatttttctgtgccattttgaagtcctgaggctggttctctcaccagctttgtgctatgctggctgtgcctctaagccctttctggcttaatgtgtaatgtcttttacttttctgtttgtttgttttttccttctaagcttttataagttttataaaaagtatctgtatgactattggactttcttttagttgtcaacggtgcctaaaaggactctcctcattccacctcccagcttttctctgtgtcaagagggtgtcaaacacatgctctacactagatcatgttccttttaaaaatcaaatgcacatagtaaagtagggggagaataactatgtaacggatgccaggctacacatcaggcaagggatttctatgtaaaggtatctattacttatatagaatacctagcacacctctaggtcttttgcatatttttattgttaatccttattgcagtccagcgtgtcggatattatggtcctgattgtgtccaggaaataagcttttcaacagcttatatactttgcctaagatcatacagcttgtatgtagcttgctggaaattttgaattcaggtttctttttctttttctctcttctttaaaaaaaaaaacctacagctttacagttgatattctttctattattattttattgctttctttatacacagttgacttcctcatgtgcaaagactcttttctactttttccaagtttcccaagaaagttcagcacaacgtagtacatatctacgaaagagttttgatttggctggaagttatttttcaggtcatattaaagagagattttttttttttttaaacaaagaatcactcctttgtgaatggttgtttggcttgtctcagaaaagtttcaattgcaagtcttaaaagttttaccagctaaagatctcttgaagctaagtattcctcttcctttcctgaaataaatttgattgttctctctgactctgtgttttgactctttctccacattccaacgtaaggatctttctaaatcacatactctacttctttatttagctctcatcatctccagagaataataactcagctctttaaattggtgcccaagggtcttcataatctgagttagacatctccagctctgtctcctgctgtttccccagtaatactaagcaattgtatctccttcgacacctttctgtgagctactcatatgagtatctcagatatactttcatatctcactgttgttaggatgaatgtgtgtgacatgccttataaagcatttatgcatttgaagcacaaaaatatttagagaccctaatatttcaaatatatacttgtgtctttcttaattttatgattatttttcataaggttgtcttttccaatagacttatagaagactctatggttcttagagttactacatagatgattcaataacagagattcagatttattgactgagagtatcatactggggggaaaattatcaaaatagattctatttctggttctatgggggacttgtaccatgtctaatatattactatatacctaataggttttcaaaaatatttattgagtgaaatgaatttaatatatgtaaattatatgctttatacaaatatgtttgaatcaaaacaatattactagattgtaacattctaagtatatgtttttttttaattaaatttttttttaagttctgggataaatgtttaggacgtagcggtttgttacataggtaaacatgtgccatggtggtttgctgattgtttttctactcacattgcctaactgagttaatagggcaggatcaatccctaagaatgactttacaaataatgagaatgactgaagagggtcatgttgttctaagctgtctactacagttatttttctgtagttataaatattgcttgagcctcagcatctgatgtcttcaagtgttaatacacttgcataggctccccagttctcacaatctctggtgacctatgataaggcttattgttagaacccaacacaaacttatagaatgctggcatagacccatttgactcagcaatcccattactgggtatatacccaaaggattataaatcatgctgctttaaagacacatgcacatgtatgtttattgtggcactattcacagtagcaaagacttggaaccaacccaaatgtccaacaacgatagactggattaagaaaatgtggcacatatacaccatggaatactatgcagccataaaaaatgatgagttcatgtcctttgtagggacatggatgaagctggaaaccatcattctcagcaaactatcacaaggacaaaaaaccaaacactgcatattctcactcataggtgggaattgaacaatgagaacacatggacacaggaaggggaacatcacactctggggactgtcgtggggtggggggaggggggagggatagcatcaggagatatacctaatgttaaatgacgagttactgggtgcagcacaccaacatggcacatgtatacatatgtaactaaccagcacgttgtgcacatgtaccctaaaacttaaagtataatttaaaaaaaaaagaatgctggcatagaaaggaaccatataaattatctatataatatatgagcttcatatcttcatgcaacacccattacaaatggtcacataggatctccttgaacacctagagtgaccaagattttacttccgcaaagggtaggcctttcttatttttcatagctctaattattaggtcttttttgtttggttatcctatatgtagacttccctctcacttccagcaagcagccttacttctgttgcttgttgagctgcacagaaatacaacatcccttccacatgtcaggtctttctgtgcttgaaaatggctagcacatcacctgcgtcccccctcctctctgtatagtcctatgcaattcctgtagcagttcctcttatgactcaatctaatttatcactgatttgactggcacagaagcaaagatggctacattcgcctcattctgaacccttttataatgtagcctaggtgaaaatgagtgttttgttaacaatgacatagtattgattcctactaaacttgaactcaactaaaattctaatttgttttcttttacatcacattttcccacatcatgtacttgagttggttttctttggccctaagcatgtagcaccttttatattttgaatttaccatgttggatttaacctgttattttcttcctatttgtgtagttttggaatttggtagagtcattcactatattagccatcctcccttgtttcatgttatctttgcatttgagaaacatgctatctctgacttcacccaagtcaatgacgaaaatactgatctagtcaaggcaagaacaaagcagcaaagaactaaaggcccttctgtgctttaacattgatcagttacccagtattctttggcataatcacttaaccaaactcatacctatgaaactctacattagccaatacatgtgtctgtggtgtgagaaatcaagagcatcgttgcctttggtcgtggggctggggagaaatttggggggaattgactgtgaaagggcacaagagagctttctagggtgatggaaattttcagtaactggtttgcatgtggttcgtatggtatatgcctttatgagaactgctcaaacctttcatttatgatcagtgcatttcactgtaagtaaattacatttcacttatgaaaacagcatgtacattcatttattacttccattaccaactattaatcattgaagatcagttttgcaaattgaaatcttgagatttggaatattgaaatgactttgtcaatatttgacagtgatgaaatccaaaataagatgcagaacacagccactattttatatgaattgctttttcagttaatcctttgaataacacttctttagtgtgtgggatgtaaaacagttttcttctaagtagtctacttgatattcaataaaagatggataataacattactacactttggttacatgcttttggttggtttttgttttgttctatttctaagcccttgtaaatttggaatctgtaagcagtctattaatacactgtattcagtggtgttttatttagaatgaagaaaattaggtatcatattatctgcttcttccattaagtattctttattaaacactcttctgaaggacatctccatttagagtcaatattgtgtttcgatcatgccgtattataagacattatgaactataattatatgatgaaaccacatattcattagtaaggtggtgaccactataatggaacataattaaatggagaagagttgtttttcagaggtgtagcgaaagcatgcagatgtcctctacttttcatttttgaaataataccttacaattatatggtacttttttattgttcatggctttttttgcacatattatataattttattcttacaagaaggcccaacctattttataggattaagattttgaacataggatgatgacatgatttgacaaatatcacacttctgtaatctaaatctttcacttcgttcaaaacctcgttaaaaattgtatatcctttgtgaaactgtctttcactgccctcactctaagataatttcccagttaaaaaaaattcctaagcaattttgtgtgctgtccatgctatactactaccatcatatctgtcttgtacttgttcttaatttttttatgggcacattttatgttttcctgaccatattgtaaattcttcttcctttcttatatcttcccacctgagatgtccctggtatagagccagatgaacattaggtactttatgaatactttctgaacaagggctgcttctaaaattaaattgtataatataagcaaaataccactggtagtatgtggcacatgatatgtaataaaagctggttgggtaagatcacttcagaataatgtgagcaaatttatcatatgattaatggaaattctacattttcagtacacagttttaattggaatcttttcttctgtaattgcattagggctttctgaattctagtataaaaattttggaactttgtaaagtctgttagtgaaccaacctggtgtgggaaaacatgattcatgctgagatcagttgatgtgtacttgagactctgccacttcctagctatgtaaactggaattcgtctcccaacccccaccgtgctgtgaggatccaatgaggtgaagggtatatgtggcctgtggtctagcaaggtacacacaatatgataagcccctgataaagacaggtttcattattttcccttatctcattggtatctattttattaattttttccttttaataaatttttaagtaatgtgaaattatgtatgctttttgaaaaaagggagaagtataaaggaaagtaagcaaaaactcaacttgatgaaagatgaagtacctttaatgagacccaactttttatataaaccttattacaataagtcattctcatttttaatagttcattttgttatccaatctttgttattcatgcgttactttgacaaacatttattaaataagagttgggcatcggacactattccaggtgttagaaaaaggtagactccctgtcctcatggaactcgtgttttatgttgttggagagggggactgcaataaacacgcagacaaatatatgatatgatatgagacagtgttaatgccatgaccgaaatttaaagggggtgcatggattgagagtgatggaagttcttcagagagggtggccagaagaggtctacctatggaggtgacattgcaccacaaatcagaaaggagtgagggagcaagttgtgtgaccgtctggacacaagaacacaaggcaaagttatagcaagttccctgtaggttcggcacatggaataaaaaccatgcatgtatgtactacgtagaactagctatccagctttccaaaatactgtgatcttacttggaattgggactgctggttagataaaattgctttctctggctgtttaatcttgatcttccccttaacccaggttgctaccatattacctactgctctgtggttactagcttaattaaggctttgatcttatgctaatgtttttgttttctttgcatacagaaaagtccttttataacccagaccctcagccactgggaggaagtactgctccagggaatgtttgaaatagaaaactgctctagttctagaaagtaaagatattttccagcaagggcaggtttataaggagctgctaagctgggatgggaaataggaagacttccagaatcatgtcttcatggttgaacatcattcggtttcagatgagttattataacagcagatgcatttattcaaatccaactattaaaaatatgtttcagggaaaataatagtttttggattatccatttttggcctctattatgataaaacattgagctgattttagtagtcatagaacaattaaatgactgtgaacaattattcacaaaactcttagaatcaaatgtgtctgttatctcttataaatgctgagaatgtttcagaaatgtctgatatctaaacaacaagaaaattcaaattatcattttcttatgtgttcataagagaaaagcatttctaataaaaagagagaataaatataactttaaataaaataaataccagcagacttaagtaaatttcaatcaatattctgttaaatctcttacacctgctataaattcatgtagctgctagtggttgttgaacccaatagtgtgatcaccacagtaaaattatttctgaatagggcaaaattaaattatggtcagcacagctgtagtgttaggttggttaattccttattgcttttcactttcctgaaatgggcagtaggagcttggctcactggaacaatcaaagaacaaagcaatgtattccccaagcattcccagttactgctctcagtatgcatttgctatacctgtcttttagattttttttcttgagggaattaaggttactaaaaatatctatgtaatcatataatgaaagaacctgaaaagttgaccagtcattctttctaagcagtcccttcctttttttttttttttttttttttgagatgaagtcttgctctgttgcctgggctggagtgcggtggtgcagtctcaactcactagtacctctgccttccagcttcaagcaatactcctgcctcagcctcccgagtagctgaaattaccagtgcccacaagcacgcccggctagtttttgtatttttaacagagacagggtttcaccatgttgatcaggctggtctcatctcctggcctcaagtgatccacccgccttggcctcccaaagtgctaggattacaggcatgagccaccgtgcctggcgtttccttccttcttactttgtacttagcaaagatgacttccatattttcaaattatctcattacactttgtacacaaatgccaattctggctgctgggtttatataaaagacacagaaaagctgaatttgtaagcattaggttgttcagagaatttatattatagtaggctttttcactgaaaactttccagtcaatattaactaattatggttgagaagtagtacaatttctttttttgcaatgttgaggattaatcacctctgatttatctcaacagtttagaattagaagtttttctctggaggaatggatattagaagctttgcatggctgtgatttatgcagtgtctgacttcatgtttttcaagctgtaatggttcacaattttagcacttctcatcaccaccaagcaaatccagaaaatgtagcatttttaatttgaggcctctgagctggccatacatggaaatgtcaagtgaggtttgtggcgaccacgtgccacaggcatctgagaatgtggtatgactgagtgaaccctcccatttcattgacgacatgtgttacaaattactatggatctggcctctggattttaattccttggtgacaggatctatatttgggggaaagaattgtctgggctaactttctgtgtagtaatcatttggattaaaggattgttttccatgcaaatctaaataagatgcagacactgtgggtgccaaggatttgtgtgtgaatcaggggtaagaataacaaaggagcctgttctgtattagtagtgagaaagcatctcttggaggcaaacacgtatacatacttgaatcaagtctcagataaaggtagtggttaaatatcgatggctcaaaatcattgccaacaaccagatgtgcctccctgcagtccatgtagcaagcagggggagggatgttgaaatactcaattgctatgattgtttgagaaccacagacaatgaagcattctgcctcaaggctattctgatagaaaagaggggctggctcaaatccttttgcctcaattttgtccgaacttggaaattacacttatatatacattttgtcgtgttttttggcttatgcaagtagcagtgtaataaaaggtctcagaccttcaaaatgaaaacttctgcctggactatgccactttaggaaaaatgtaacttctttgtgtactctaagatgtattactgaagcactaccctcttacacttaaattgattccatatacagataagataatgaattttcaaaggcattttaccttttcacaatgtacagataatagtctttaccagtggcttaatggtaattgtggtctggaccattcagattctcttgtcatcttttacatattttctttttatttgtttgcctttcgatcctgtaggtattaccatggtttacattcttctcttagagctcagagttttttttttttaataaaaatctcatcccatcttatttccatttctctttctcttggtttacgccctgagacactgagggaaaggaaaattcttagccagattcttaggcctttgcttaaggcagagctccatgaacacccacgaagcaaagaccactgtttggaaaggaatggagacagccattcttttgcatccttattgcttcttgtgggaacttagaagtgagaagcagcattcaggctggagaacataaattgtcatagtgttaaggaggatccttggatacagctatttgtggtcagtgtaaggaacgtgtgcatgatacgaatgatgacattttatcagcaaataaaggagaagccaaattcagaaagagacggaaagagcgtgatccctccctcattgaaaatgatcatgtttgtcactagcttgtttccataatcacctcaaacattattgctttctgtggattttgagtaatggttttctattcaaattggatgaaggaatgggaagtgtattggctaatgcatatgtcttccccagatgagactattttttcttaaaataaaggtaacagtcctcctcacaagctctttttataagtgttatgaaaggaaagctaaaaaatccctggtttgaggatcagattatgatgctggaattcaatatctaaatgtttttaggcagtctttgtatccccacttgcaactcactttatcttggcgattagtaatcttcttttgcattattgtaaaagcaagggcctattggtatgacagttagtaggacatactgtgttacagaaggacctgatttggatgttagagcaacctgctcacctttgttacatgatttgaaagcattttctgaaaaaggaaaatttccatttttaaaagttgtcattttgaaacatgtctgcaatatcttaattttatctgtaaagaaagagcccaaacaatgcttatgctattctgtcttatcctgaatccttttcctggctgcttttcagtgtggttgtgactaactgagttttatagttacatgatctccaggggttgtgtgtgttgacttacggcattttctcatgccaggaaacaatgtgatgagaaccattcatggggtgggagagatgatgacccagatggtactcagtagaggctccatcttccccatgagcgtgccggatgtgccacccagcatccacccgagcaagcaagggagccccaccgagcatgaggatgtgactgtgatggacaccaagctgaagatcattgagattttgcaggtgtgttgcctaacagaagctaggtgacaaagatgtaattttgcttattgatttaacttcttaccctttttgttccaaatcactgtgtaaatattctgaaatgctatcaatataattttatttttttaagttaatgacaaacctggtaaaaaatatcacacagacgctatttaacatatgaatcacatttgtccattcccattaaatatactaatgatcatatctaacaattgtggggtgctttgaggttgataaactgctttcatgtgtattaaaaaaaattagtattgtccctgatggaactttaccttcatttgagaaggatttcagagcaagcaaagttattgattagtttccagctcttttcctatttttaattgaattgaacatgtgattccatatatctagatttattgttttagcaagaaagacaaataaaattttatttcttattaacaaaaattattaatcattggttttggtattttatatgtgacaatccctctctgtttttgtttctaaaggacaaaggaataactagaaaaaataacctagtctaatgcctaattttaagaatttaaaggagataaattattatttcatgcccattggtttagtgaatagacttcccattacgagagctataaattcttagcagtttttaagtttgaaaataccttttgtgataccttaattatagcatttattccagatttggagaatggagtttgaagttttcaagtacctattaggaatctaggtacagtttactgtgtctttcatcataatttaatatagactgagctaccagaagtgggttagtagtcctttaagggtctgtacattgttcatttaaagtaattagatttataatcataaaaggtttcacagttcctctaggaattccaaaggctgaatcctgagaaatattggcaggcctcccaatgctgtgttcatgaccctgaaaaatcgtttaaagttttcctgttcttaaactgagaaagatagcgatcacctgacccatggacctactgatccccagcttaccatcacctgactcatgggacaaactctaaaatacgtgacctcattttagcccacatttacagaaaaaaagcattagaaaaacaatctccaacagctaaaaaaggatgagatggagcttctacggctcagcagtccggggctgattcatttctgcagcgtctccttgaaccgctattcactctgattttctatccctgtgtctgggccggctccaccgtgcgtatgtgtctgagtactgtttctgaatgtgtctttcttggaatggctcttcaggaatttctttgtagccctactccttggtgctacaaggacttcaaggtcctgtgccttgtgccagctcctctcttccccctgggtcttcttttttttttacccccccatcactttgtgtatctctctcagcctctctcttttcatttctctctcattctctctctctcttcctggccctctcttaattctttttctctgcctttgtttttatccttccctttcctcctttctttctactttccacttgtttttcctgattaggcgtattagagaaatgaaagttttaattttgattgtatttatggaatacaatgctgcatgtaaacattgtcaactgaaagttagtttcatttgtttatgatttatcctttactttaaaaaataggattttaaacacccttccatgtgaagcatctgcagtccagctctgccccctgccttctgctcatggttaccaaatcccatgccctttctcagtcctcttttcccatgagctgtctcctgccctgcaaatccctttgctaccaagaatcagttcaatcaatatgtgttccagccctcaccacacgttcttaagagtctctggtgtttgttttcccctctagactgtaagttcttcaaaggcaggattgagatccttggcacctttttatgcccttagtgccttcctcaatgccttgtttaacgcatgtctggtgaattaaccagctgagtacagctgacatggaggatgtgtccataaaaagcataaaagtctagcaaaggctgggtgggtcgggggaggagagagagagagagagaaaaagagaaagagaaagagagagactgagacagacgaggacagagaaagggagggagggaggaaaggagggagattgattcagattgtgactggggaaccagtgaaagctgcgttaaaaaagaatttaaactggaacttggaggattttttttttttttgagacagggtcttgctgtgtcacccaggcagaaatgcagtggcacagtcttggctcactgcagccttgaggtcgtgggttcaaatgttctcccacctcagcatccatggtagctgggattacaggcacgcaccaccatgcctggctaatttgttgtgtttttgtagagatgggacttcgccatgttgcccaggctggtcttgaattcgtgaggtcaagcgatccctttgtctcagcctcccaaagtgctgggattacagccatgagccactgcccctgagagaggatatcttaaaatgtaattattatgaagtggaggagaatattcaaagtaaagtggacactgtgagcacctgtgcggaggcaagagcggaagtgcaggcactccagtgctgttagaaccggagagaggatgagagaaggggcgtaggaggagggagggatgggacacaggtggtatagatagagatgaagttagatgataccatgaaatgccaatcttcctaaaacttgggtgaccacattgtttactgtccaaatacgacacttttgagaatgtaggggcaccattaataattatgctgaaacaaaaggttaaacagggcctctctcaggcagacagggacagatggtacctatgtaaaaacctctcctttgatctgcagcacatcccagctttttcttctttgatttctgttgtatttagaccacatgatttagctctcaatagtttcctaattatgctaacagtgctatatttttttcccaactcgactattggctttttgagggcagtaggcttcacgtgtttgcattccctgtggcacctagcacagtctggagccttgctaggtacttagtttctgtccgtgcatccatgaatgagaacaatgacagcaacccaaactcaaggaaacacaaacaccagtgaggaaaatccatggtgtatagatgctgttacttaaactgtccttttagaacctggctttaggactgatcatggtatagtcacagtcatactattgtagctgaattattgccctactgtgtaagaatgagggtcacacctccaacagtctcctcccagagacaatggcactctgtaaaatgttcagtaaaatgacgtcatcattacctcttcatccagacccccacgatgcctctagctggaatattcagagagcaatcatagggagtcaaatgttctttccaaaaattgctttgggattttactgacattagctagtagaaatgaattcccttgcttagtcattgctgacaaacatgtggcaactggtgttaaaagcttctaactagttcctttgaaaggttggtacttccactgttattggtgtgttgtgaattgcatttttaaatactatgctaatgaaagaaatttatgttgttcttaatgtttcttatagtttatcctgagtgtcagactggattataggatctcatatatgctgtcaatatataagaaggagtttggagaggacaatgacaatgcggagacatctgccagtggatctccagacactttactaccatcaggtatctttttgtgacagtatttactctttttattttatttttctgagaacttgaaagtacctatcatattttaaaacataattatattttttgtgctttttaaatttttttattatactttaagttctgggatacatgtgcagaacgtgcagatttgttacataggtatacacgtgccatgttggtttgctgcacccatcaacccgtcatctacatttggtatttctcctaatgctgtcactcccctagcccgccacccaccgacaggccctggtgtgtgatgttcccctccctgtgtccatgtgttcttattgttgaactcccacttatgaatgagaacatgcagtgtttggttttctgttcctgtgttagtttgctgagaatgatggtttcctcatatttttacgagacaaaaatgtagatgtaatctccactaacgacatcaaagaactgagacagattgtgaaataactctcctagaatggtgtggagggtgtttgctgtcgtttgttgctaactcctatgaatgccttttcctttgtaatcttcaggactgggacatactgtttactgtgccattttacagaggagaaaaccaaggtcagaaaggttaagttacttgccaaaggtcctgaaagtagtggcacaaggattctctctgaggtctctccagctcgagagtccaaatcttttcagcatcatgatgttttggtgaaaatccaagagaagtttttctgcctggatcaaagagcagtgcgaaatgtagttatcagaaggataggtgttttgaagagaagccgttgcctgatccagaataaagacgtggcattccccaaagacttgaatgtggttgttggtctcattttgtgtgtgtggattttttttaaaaaaatttactttgtatagttataaactggaactatatttcaattttcatatttaaaaagtgtaaaaatgaagctaatttatctctgagcactggagcataacaaaagagcacagttatgattgtaaaaattttgtgactattgaaagaactttagaaaaactaagaaatattaaattaccatttttttttttggacaggtcaggccaagtcattataggctgaaaagtatgtcttattgaagatttagccggctaatggaattcttttcgtgagaataggatttgtacacagatgtgaaacttccttctaactgccaccactgtgacattaggaactctcccctcttcttcgtccatcaatcagttaggaatgattcagtgattacaagcatgtagttaaaatggatactagaccaactgtcctgctgtctgaatcattagtcccatcaaaaggcagcatgccgctgcagaaggacttgagcttgtctaagcaagacttctcttctggcacctttgcaatggtgttgtttttctgcttctcagaagtgtagaaccccaaagggctatttccaggaatgatatggcagaaccaggaagtcttgctggcggttgcattgacagtagcataaaaattattgactcccagaggcctggcttctggaaacatgagttttaagtgtcagtaaagtaccagagggaaagtctaggggcaccccagaaaaccctttctctctacctgatctctttcctttttttgtaccagtaagggatacctttctggggagaattatttttccacttttatatcttactgtgtttctttttacgctttggagatgagaaataagtggtgtattttatcatttaaacatgttaccttggccaggtatggtggctcacgcctgtaatcccaacactttgggaggccgaagggggcggattggttgagcccaggagtttgagaccagactgggcaacatggcgaaaccctgtctctacaaaaaaatacaaaaaaattagccagtagtggaggcgcgtgcctttggtcccagctactcaggaggctgaggcaggaggattgcttgagcctggaaggtcgacgctgcagtgagttgaagttgtgccactgcactccagcctgggcaacagaacaagaccctgtttcaataacaaacaaacacacaaaaagccccatgttatcttagtaaagttatcttcaaaatgttagtggtgtgggacagtaaggaatcatgattggttcacatagaaaaaaaaatgccctttcccacaagaaaaagggacggaattttagtaatagtaagcttaggtaaaaagaccatggtgtttggaaataaccatataataacaaggctaattgtatgtatattttgattctttaaagaattatcctcccatttatcactcatttaaattatatgtaagtatgtgcatatgtatgtatatatgatctatatatacacacacacttctctagataagaggcacctttgtaactggtgctttctgatcttttagacatatttttgattacagcaatacattagtttaaaacatagtttacattaaaaaattacattgatgtcttagtggaactatattgtgatttttttcaaactgttaattgacttaaatttttttaatttttaatttttgtgggtacatagttgatgtatatatttgtggggtatatggagtattttgatgcaggtatacaatgtgtaataatcatatcaggataaatgaggtatgcatcacctcaagcatttatcttttgtgttacaaataatccaattatagtcatttagttattaaaaaatgtacaacaaattattattgactatagtcactctgtatactagatcttactcattctgtcatactatatttttgtaaccattaatcatccccactccgcccaccccactacctttcccagcctctggtaactcttattctactgtctatcgccatgagttcaattgttttaatttttagcttccacaaatgagtgagaacatgagaagtttgtctttctgtgcctggctaatttcatttaacataatgacctccagttccatccatgttgttgcagatgacaggatctcattcttttttttaatggctgaatagtactccattgtgtctgtgtaccacacttctttatccatttgtctgttgatggacacttaggttgattccaaatcttagctattgtaaatagtgcctccataaaaatggaaatgcagatatctctttgacatacaaatttcctttctttttcatatacacccagaagtagaattactggatcatatggtagctcaatttttagttttttttttttttttgagaaacctcgaaactgttctccatagcagttgtactaatttacattcccaccaacagtgtatgagggttcccttgtctccaaattctcaccagcatttattattgcctgtttgttggataaaagtcattttaactggggtgagatgatatctcattgtagttttgatttgcatttctctgatgatcagtgatgttgagcaccttttcataaacctgtttgccatttgtatgttttcttttaagaaatgtctattcagatcttttgcccattttaaaatcagattattagtgttaattgacttttggtcgaataaagaaatgaagacaaagatattttcacatcaattgatattaatatgactattatggctcctaattaaaataggataaagaagagattttaccatttatctttgcagctattgttcctgatatagatgaaattgcagctcaggcagaaactatgtttgcgggaaggtatagtaacatttatatatctttatcttacttgtgaataacattttacttagaattctattgatactttgatattgttcactctatatctatttatttttagaccctctattgttgctaacataatttctgccagaaatgaagctgctaatttactctggaggagaaagcatagcttttctttaggtcaggtaaaaaaaaggacaagagagatgagatcagtgtattgaactttcctctgaattctttgcttttctttcctcaaataatgacagcccaagaatgccctttaactcccctggtataaatatcactgagtcttgtaaaacattgcttccctgaatcttagatatttgaggcaagaaagtaacttctttaatgttatcattaactttatatgtaagaaataaagccattttctgccaattggaaatacccatgattaaataaaacaagacacctttgacatgactagcctcctttgccatcaggaatcctgccgtttattgttttaatattgtttgttcttcagaaatgaagttaatagtgatcaaaaagaaaaattaaaatgtttaagctacaaattattaagcttctggtgctcatttatattacagacttgacatgagaccctaaaaacagtctgtacagtagtctttccttatctgctacggttacattccaagacccccagtggatgcctgaaaccacagctagtaccaaaccctgtatacactgtgttttttcctatatatacatgcgtatgataaaatttaatatataaattaggcatactaagagattaacaacataactaataataaaacaattataacaatatgccagcatcaccactcttgcactttggggccattattaagtaaagtaagggttacctgaacaagctctgtgaccctgcagcagtcacctgatgactgatacggctactaagtgactaatgatgggggaacacgtacagcgtggagatgctggcaaagggatgattcatgtcccaaatgggacaggcaggatgacacaaaatttagaactcgtgaattatttatttctgaagttttccatttcatattttaggaccatggttgaccatgggcaactgaaaccacaaaaagtaaaaccacagatagagttgggtagggtagtggggacgactacactaagcatcttattgcagtttttgttgttgtcattggaaagacaaacaagaatcaagaattaggggcacaaaaagaggatttttatctctagtgaacatttagtttagtttttatattatagtactagtttgtggtgttgtattttcctattgaagaatttcattattccctaggagaaatgaaccagtatatgatttcatcttgaaacagatggaccttttgttccagtggaacctcacccagagtcctcatacgccacacctgtggccactctggtgctggttcacgcacatgtgcgctggcctcccccactcctccccatctgtcatgtaggggtctgtagggccccaggggaaatcagtcatcggtgtacatccagcctagcacagctcctcccataaatgcttttggattgatgcagatgcccatcttttgtctatgccaaggtgaccaactcatcccagtttccctaggaacccctgagtcttggataaaccgggatgtttgatcacccctgctttcatggacagacacaagcttttctttatgattgtttcctcatcagttacatgaggaaaacaaagaaaatgttttcctgttcacttcctaatttggtaaaacaaatgatatacctctgagaatacgtatacaattctaatactgaagtgtagatgttatataaataggagtcactttagaaatgtttttggttttatagaaaagaaaaaaatccagttcaacttgacgatgaaggaggcaggacgtttttacgggtcctcattcatctgatcatgcacgactacccgcctttgctgtctggagccctgcagctgttgtttaagcacttcagccagagggcagaggttttacaggcatttaagcaggtaagattgaagagccctcaatgcatccacagcaaaagctctgaaagtgttaataacatccaacctgacttcatggctgcagaggtaatgacactgtgtggcttttcctggagacactttctatttttaaacagagacatggccttgtctatgccaggacgtgatctatttagaaggtattccccacaagtgattttttagttaatgtctttaaaacaaatgaaaggcaccaagatttgggaaggcactgggagataataacatgttaggaattttgttaccactgctattattttatccttaaattttactgatgaatttgggtaggagcaccaatagccctgaaataattattttatgattgaaaactgcataaatccaaaaaaacgaactgttatggatctaatctttttctttgtggtctttgaataagacatcaatcttgagattattaattagtaatacgtaagtgcttacatatgtttcactatttatttaacataatagggtattgatcatttaggcagttttacaggaatatgttaaaagaatatgaaataaaagggtagttatacatcaaatacgtatatgtatatgtcatataatacatgtaaattataagaaaataaaaacttgtatgatgaggtttagattgtatctattgatattttctcccagttgtttttgtttctgcctcttttcaaacagagtctcagaaaaattaacttcagcagtgaaattaaagttagggtatcttttaatcttaaatcactttgaaaagttttgctagggctcacttaaaaaaattataatgtgtgaaaatactggttaagtgttcacacttacttctaggtaggttttcatggtcaatatacatctaaaatattcataaatattctagaaatagtgaacttcaactaagattgaaattcttctgttttaggtgcaattactggtgtctaatcaagacgtagataactacaagcaaatcaaggcagatctagaccagcttcgactgacagtagaaaagtctgagctatgggtggagaagagcagcaactatgagaatggagaaataggggaaagtcaagtgaaaggtggtgaagagccaattgaggttcgtttcaagatctatttcgaaatactcccaatgatgtcttttaagtcagatatataaccacatgctctacaatcaaaattgttcataaagaaaaattctgttctgagcaacagagcacaaaattttcatttgctaagttgtcaattaactccgtaaactggcactttgtttagctcttatcaatttctaccacttcttacctcatctatctagtgtttcactctttgtcatttccacggtaaattctataattcagcaatcaagaaaataggaaggagtggaaggagaaaaaaggagtggaccctaaactgagacctgtagggagaggtgaatttttgtggacccttttgctgtggccatttttttgccaagcagtaattcattcctatcattatgcatatccttatataatatataaaagtatctaaatggaagaccaatatgctttattgccagtatgaaaataccaaaaatctaaagagtgactgtcatcttctgttgtattggcttttttagtgtgttaattagttgctgttttcacatttcactaagtacctataaccacttaaaaaatgttaaatactgctttagtagtcatgcttagataaagcacactagtaccaacatcataattgttaatacaaaaagttttgtaaatgcctgtctggtgttttatatagttgttttttaatctgcaggcatataagccgttttgatgggtttacctgccttagcttttgttatttgttggagtacccaaaatattgtgaagtgaaacgtgaaaacagagcaagagataattaatcaaaatgcttctgaaatgctttggaagtttgggacaaaatactggaacgtgggcttcattgcacactgacgtctactgggatttcctttgcggccctcgcagccacaagtagatgccctttatttcccttttggcttttaagttccacatgagtttatctcattggcagaagttgaattgaatttagaacttcagctataggggaatttgagaaaccagctctgtgatacagagggaccgtgaggggtgggaatgcttgctgaatgccaggtaataaagtgcatcataggaaggacaatgtgtaggttattagcatgggttttggaatcagacaccccagaatttgccacttggtatatgtgtgacttcgagcaacttattttcattctctaagttttatttttattgactatcaaatggacatcatcatggtacttagctcctggaattgctgtaaagattaaatgaggaaaccctatgcacgtggtaagtgtgtcagttaatatggcttcagtgggaaaatatgaacaacatgaaaatatatacaataaaatgacatattacttaccaacaagtcaagaagtaagactccagctttaattccttgcctcagtgttgtcatcatggatcagctggcttagttttgaaaccagtctttctcctgacggcatcatggcagtagcattctagatatcacatctgtgcacgacaacatcaagaaggagtatctatttctgggtctcctgtttaggggcaaggaaacctttcctagacatccctcaccttatttcatgtctctttggccagaacagggccagatgttaaaactctacaccagtggagtacaggattagtttagattaagtaaaagatgtcgcccaagctaggatacaccaccctgaattacctgggagaacgatagatggccgaacaaaactggattcttctagcagggaagaataagaaagaatgttggttagcaaccaacagtgtttttcaacattagcattcagtcagtgtttgttgtaattattgtttttatgtgtaacacactgtgttgtttactatggtggatatggaattatgaaattttagagttacaagataattgtagggataatcacctccagttccctatgtgatatatgtgttctctatctctaaatatctcacctgagtgacattatttctttaaacaaagcaaacttctgtagctggaaattcagtaccacctgaggtagcatattctgttgatattaaggtacagcttaagaaatagagtattgccagtaagaagttgatgtgctccctccctatataacagaggaaaccactatcatgaatttattttaacattttccttgcttagtagttttaccatgtgtctgtatttctaaaacataagaaatatatgaggtatatttatttagcctattttgtacatgttttcattgttcatccttgttgatgtataactgcaactcattcattttctctaacatatattattacatttatgcacatgtttatccagttagctgtggatggacatttgggctcttcccggttttggtgttttaaaagaaaatttgctactacaagcagtgctgctgtgaaagctgttgtatgtcacctggtgcacatgtttgggagattttttgggatatctacataggagtaacacatgcagtatgttcccctctaccagacaatgccagttgttttccctccactagtgtatgagtgttcttctagctccctatccttatgatgggtgtttttctcactttcccacttttgatgattgagtacacttgatatattatctccgctgtgattttcattttgctgaattagttatgaggttgagttttttaatgtttatttgccattttacttcctattccagtttagataaagctaaattctacacaggcaaatagttaagtcctaccgattcatgtgtacttactaataaggttaaaaatattcattcacttcaagtcaggtaatgctataagttcaaacttgaacatgatattttatttcttttttttcttgctttactgtgtttgtagtattttcaagtacaaggtaaaatagaagtggtaataatgggcatccctgtcttatttctgattttaaagggaatggttctaatatttcactattgaacataatgtttactgtacattcttttatagataccctttatggaggagcacattctcttcctagtttactttttaaaaactacaaatggttattgactttaattaaatgtaatttacacatctattaaggttatattattttttatttaatctgttcacctaaatgacataaatcttaaatagaacttctaccgtagtaactttgcattctagatttaaaatatcttggtgatttgtttttacattgctagattctgtttactaatactttctgtagaattttacatctctgttgccagtgaaattagcctgtaatttttccttccttccttccttccctccttcctttcctctttccttccctccttccttccctccctccctccttctgtccttccttccctccctccctcccttcctccttccctccttccttctctccttccttccctccttccttccctccttccttccctccctccgtccctcctttcttttcttttttctttccttttcttcttttctttcctcttttcttttctttctttctttcactgttcctatcaagcagtagtattgaggttacactagtcccataaaatgagctatagaatattcctttttctttgtgtaacattagaaggatctgttcataaatgtttggtaaaacctgtctgcaaaactgtctggacatgatatttacattggggaaagactttgactactgattcaattttttaatggttataaattcattcaaattttccattttgagttaatttgttgtgcatttttctagccatatattgaaatcttcgaatttattggcataaatttgttcatattcttttgctatcttttaaatttctgctgtattcatagctttgtatccctttttcattctttgtatgttttgctatggctctcttcttttctctagctctatccagctcaatctttccagagttttatgtacagtttacccttgaacagtgtttgggggatggtcaggggtgctaccctcccgcacagttgaaaatttgtttataacttctgactccctcaaaacttaagtactaatagcctactgttgactggaagccttactgataacacagacagtcaattaacatatattttctgtgttgtgtgaattatgtagtgtatttttacaataaaataagctagagaaaagaaaatgttaagaaaatcgtaaggaaaagaaaatatatttactctctattaaatggaattggatcatcataaaggtcttcatcctcatcatcttcatgttgagtagattcaggaggaggaggaagagggagggttggtcttgctgtctgaaggggggcagaggtaaaagaaaatctgtgtataagtggacctgcacagttcaaattcatgttgttcaaggtcacctgaattttactcatctcttaaatatagtctgttttgggtttgttgagattctggatttgtttgctattttattatacttatcctactatactctatcgttttatgttgacagacttttcgatttaaaaaaaattggtggtataattttcttcaaaggagctgcattccctgagttttgacaaatgatatttttattatttttcaatattagatactaaaaatttttccattgtgagttctttctcttagaattacttggaagtgagtttttaaatttccacatgcggccgggcacggtggctcatgcctgtaatccctgcactttgggaggctgaggtgggtggatcacaaggtcaggagatcgagaccatcctggctaacacagtgaaaccccatctctactaaaaatacaaaaaattagctgggtgtggtggtgggtgcctgtagtcccagctactcgggaggctgaggcaggagaatggcgtgaacccgggaggcggagcttgcagtgagccgagattgcaccactgcactccagcttgggcaacagagtgagactctgtctcaaataaaataaaataaaataaaataaaaataaataaataaatttccacatgcataggcaaaatttaccttttttgttaattgaattcttaattaacttgtgaccagataatttagttattatgatatcatttctccaaaattcattgaggtttgctttttgacctattgtacatccaggttttgtaattgtccattgtggcttgagaagaatgtgaatgggtgtaggattcttaatagatgactggcaaatcaagcttattaattctgtttaaatactatatttaataatatttttattttcttgacatatcaataagtgagagagatttgttgacattttccactacaatggtatgtttatcaatttccccttgcatttctattagtttttactccatgtgttttgagactatgtcattagatgcctgtaaatttgaaattattatatttttactgcagaacaaaagaatttattaactgtgaattatttcccctcacttctgattattttatcccatgtcttctggcttccattgctgctgttgagaagtttgctctgttaaatagtggtactttaactttgaaactccaattaagttcatgttaaactttattagtgaatatattactatatagtacatatctgttcatttcctttttacattttctctacctatgactttgtatggcatatggataatttttttagactcatctgagtctctcttcaagtctgtcttctttgcagttttctctaccaatttacttttaaacttcagccactatatttttttatacctgaaatttcatttttttcaaacctgaaatttgagttttttcaaatatatttggtcattttttatcatgctttgttgttttctaatttttgtgattccctatggctgttttatggtctgtatgtggtaactcggagatccgatgtacttgagattttcttgttattctcactcatgttgtgtttcattatatttttgatcatctttgattatgcgctcatatcttttttcaaattgacttcatttttagagcagttttaggtttagagaaaaattacacagaaagcatagagttcccatatagtccctcttctcctctctctttctccgattgttaacatctagaataagtgtggtacattcattataattgataagccaatattgacacagtatttttaaactaaaatccataatttattaaggttcattctttatgttgtttaactatgggttttgacaaatgcataatgtcatgtatccaccattgcagtgtcaaacagaatagcttcattgccctaaaaattctctgtgcttcacctatttgtctctccttctggacccctgagtccctgccaaccactgattttttttctctgtaggtttgccttctccagaatttcatataattggaattatataacatgtagcttttccagactggtttcttttacttagcagtatatgtttaagttcttccatgtccttttgcagtttaatgcctcattttttgttattgctgaataatagtcccttgtattgtttatccattcacctattgaaggacatcttggttgcttctaaattttggcaattatgaataaagctgctataaacatttgggtgcaggttttgagctcgtatcttttgaccttagtcctggggttgacatagggtatgttttcctgcttagagtatttgtgattgcctttgcctgttggcagggggcgctgctagcctgagaccacattactcccatcctatatacctattttaaggcaggagttttgggtttagctccccaaactagacacttgctcagagttcccttagtctttgggttgcagatctagtattgtcatttgccttcagggaaacttatcttgtgcccttgttgcttggagctctctggtcaggtttcaggttacatttttcccttagaagatggagggtggggtctctgggagttgtcctttcttttctatgggcccagaaatgtacttaaaataggtttatatctaagatctagttgttttgtaataggagggttctttgcagttttaagttggccattcttgccaaagtctttgggttgtatttacttcaggtgttccgtgattttttattgtcatgaacccacatgctttggaactttgtatgtggaatttctctgaggtctgtagttaaggccttattgagattttatttgcctctgtgaagcactgtgggacactacattctgtaaccatattgaacataccttttggcttgggtcttttgggacccctttagattggacattctggtccccagtcttgagtgaaagtgagcttgtcttgtatatgggagcctcaagagaattttttcccctcttttgcttttgatgagcaccaaggccaagataggtgcccttttgctcttctgtgggccatgtctttccctggtttatcattgtgggtatcacccttaggtattcctgactctatgccagggtctctgatcagaccttccatcttgcatgggatctggattttgtttcctttttgccgtgtgtgtgtgtgtgtgtgtgtgtgtctgtgtatgatatagcaaaactcagaatccagcttattaggtatggactgatgccgtcagagccaacaatgagtctagtgcttgattattgctctgaaaattttatgtattttcagggtttctggccttgctactataaagagatgttttaaatattttatcaatcatttttagattttatacaggagggatttctctgcactttgtcattttctgtttgaccattcttaacaagagacagctctttgttttgagcctgtgtatttgtctcaataatacctgttcaaacctatgctgggtttggggcaacatgaatggtcacacttaatgaactgtcatgtttctccagagtaaaatctttctttcaaatgctgtgtaaagtgtacatttcagtcccgttgttttcatgctaacttgcctttgtgcacacttgaatttctcctttccgttcttaaagttagatatctggactcaaatctcatattctacttgccctcaacgaacgaacacacttcatgaacacccaaaaaatagggtgacaaagtagttgattaaatactgaactatgtagtacagaaaaaggagaggccagcgtgggcctgatgactgaaagaaggcctcactccagattctgcgcataggcctattctgaaggactgggaggagttagcatgtattcaagaataataagagaagtaaagttcaagaataagcgatttgtatttgcaatgactggaaactgggagcctgtgaagattcttgggtagagaggtgagcatactattttggaaaatttagtctgacagaatccggaatgcttcagaagagcaagaggctgggttgggacacccgttaagaggctgttgtacgaattcaggtgtgagcttctgaaagcatggactagtgaggtagcagtagaaatgtatgcaaatgggtgtattgggaagctgggagaatggtacctatataatgaattaatataaggggaacaaaaatgagaaactgtgaagttactaatttatatacagccaaataatctgtattatgcaataacccagcagccaaagatagtggcaatgtattgtaaacaggatgaaatatatcacagtatcaatggaaacagccagtagcaggcagcacacacactagcaggccaatacgaacaatactcctttgttgtttagtaaatcttacaaaggctgtaaacacagcaccatcagcattgttctaaaacagctcataatggtctaactttgtgcctgcttagatatcagaagaccagataactttaatgtgattcttcattttgagaataaaaaatatctccaataacataaaagcgtgaggggaaaaaaagttttttccctcagtggtaaatttggtatactctgttgacaataaatgtgaattgatggtctgtctgctaacactaacaaatctcagtttataatccaaaattataccattaccatacttgatctcttataaataaggagaaggggatggatttggttgtctattaagcccattgcgtccctcgagcctagcagctttattatctattgtatattatagtgtttccctttattaaacctatcgtccccagcattaaaagactgtaccatcatttctgaaagcttaaaggctaaaatataacaagttgacaatatcagtagcattaggagcaattactaattcatcactttcaaatatgcattgccttctaaatataggaaggagagattaactcaggaaaccgtatccgagtaggttaagtcaggattaccctttacgttcatccaccgctttatttagggttgagatgcaggtcacgtgggcattgcagtgcttcagaggaaagttcctcatgttgtttattttgattgttaatttttcttacagtgattttgtttctctatttgtgtgtatacctatatttatctctatatctatctactcacctatatatggttgccagcttctttttctttacttttttttagagatgggtctcgctctgtcacccagctggagtacggtggccctttttaaaaatttgacttagactctcactgatgtaaagtctcatgcttaaactgtctatctagtttttacttcaaggactatatagttcattttcaggttatttaattggttctttttcatatccatctattctagattcatatctgcctgtttttacttcataattatttttgttcttttaatggatgtgtgatgtaaggaacagaattaactaaaaaatgtccctaggggctcactctgggttgtctggacaacgaggtggctgggactgtttttgcagatgaggagtccctttcttccaaggggctgtgtactgattttggcttctcataggacccgtggcttcttcccctcagcagagacagtccaatttctatgggccatgggctagtgttcgaaagattcctgtaaacaacaggcactgcctggtgccggaacagtttgtgtgtccctttattgagacggttacgctccagcttgccccataggtagttactgtggtgttgcggggagtggttgcttggaaatctagacccatactatccagcggggcacccagcactcctgtgcggggagatgggaggagggggcacctgtgccttctcttctcttgctgttgcttggcttgtagcctgtcctttccctgaaaaggctatccttcattatccatgctgagcgatgctgtgacataatcctgaacactattgcatggcacatggcaaccacagaggtacccactgggcatgagggatgctattcctcactatctctatgattattttaaacatacctacttacaaagcctgtcagaaaagctcttgattgattatatttcactggacatgatatattattattattgagttttttggttgacatttttagtattaatgttcctcataggagtttgaattatagtttgcagatttatctttatttattaattatattactttattaattatgaattaattccttccttccctcccttccttctctttccttttctttgctgatttttctctagttctccctaggtacaccttccctatctgatagtttttctattacctccacatctcattactttttgaaagcaaaaactgtattccattctttgcctgccgcttctgatcttttttcctttgatgaagcaagcaaagttgcaaatccctgtagaaggatatatattaagaaggttctccttttccaagtgttggtatgagattctgtgcagtgggaaaatagttctacataaacttgtttcttcagccaaacttgtgatcgattagctgacttttgacagaatctggtagaatgtctaaccctgatggcctgggacagaagcagtccatgtgttctagacagaatcttgcagcttgacctgaccaatcagagacacagtggtaatttcatgcagagcttttattcattagttttggacagtgcttttctgaattttccttttatggaatctgttttcttgtctccagtttctatttttgcctcagacctcattgtatatttatttgtttatatcattatacatattcccatacttatgtctgagcttattccactgaaggtgattgtgacagatgagtttcaataaataagccccttcacatgacatacatgtgaaaaataacttttggtttataataaaatgcttgttttacacattcttatcctatttggttataatataaattcttaaatgtaacaattatacttccagaatgtgttatttgaattacttggttattttatctttttctatgagaatttgttcccttctcattttctaaccacatttaaattgatactgtttgagtataaacttagtatttcccttcatgctataaataagttactatcttttttttttaacttttccatttgttctttttgttgtagacagggtcttgctctgtcattcaggctggagtgcagtggtgcaatcacagctcactgcagactccacttcctaggctccagcgatcctcccttagcttcctgagtagctgggaccatatgtgtgcaccaccacgcctggctgatttttgtattttttgtaggcatggggtttcaccatatggcccaggctggtcttgaactcttgagctcaagcaacccacctactttagcctcccaaagtgctgggattacaggtgtgagcccctgcgcctgtcctccacttgttcttaattcaatacaagttgttagtgaagattctatgtacccatatggtttcttttattcagcaagtggctaacgaggaaataatagtgattgattcattcaaatcagagaatacatttgttttagatcaggcaacaacatttctgtaatgatttcttggggaacaagtgagtgtaaaaggcagtgctgattcgtccctctcacacattttatacatacaccccccttcttacaaccatgtccgtctgggtgagctataaccctattgtgactaggggagcttccttcatacaatgtatcagtatcaaagtcagtctctaagggttctattatgttgctgttttcacttcctgtacagtgcttttctgttgaccaaatgccattctgttgaccaaaaggttccccatgctttctacattttacataatactgttgagtttttagccatccctggagttacatcagaaaatttctgggacatattgctgtatgataataggttcctgatgtgttttttttttttttttttaatttaaaagtaaactttagtgtcaaaaatgcaaacttggggagcgcagaaagatcacacacaaggctgccacttcacacacttggaggggttgcacagcagccgggcagaggggcccctcacttcacagactgtggggcgggccaggcagaggccctcctctcttcccagacagtggggcggccaagcagaggagctcctcaattaatagactgtggggcagccaggcagaggcgctcctctcttcccagcgagtggggcggccaagcagaggggttcctcacttcacagactgtggggcggccaggcagaggcgcacctcacttcacagacagtggggctgccgggcagaggtgctcctcacttcccagacggtggggggcccggggagaggcgctcctcactaggttcctgatgtgttcttatgaaagcagttactagttacattaaacatttccagtttttcctaatacctgtctaagcaaagatgctgcaccccagtggcacgaactttttttattaacttatgtattatcagagatgcagattgtaaaggagatttgggttttgtactagaacatcaggttaaacattatcaaatactaactaaaacgacatcaaatgagtcaaaaaatgccattattttatttatttatttatttttttgaaacagagtctcactctgtcgcccaggctggagtgcagtggcacgatctcggctcactgcaagctccacctcccggattcacgccattctcctgcctcagcctcccgagtagccgggactacaggtgcccgccaccactcctggctaattttttttgtatttttttagtagaaacgcccggctaattttttttgtatttttttagtagagacagggtttcactgtgttagccaggatggtctcgatctcctgaccttgtgatccgcctgcctcggcctcccaaagtgctgggattacgggtgtgagccactgcgcccggccgccattattttatttgtcttgggacggagcaaaaggaaaaaaggtttggggtacggttatggatatgtatgtattctctagaagggtagagctttgctcctgacttgaggaaacatctggaaggaacttacctgcaagtaatgctggtcagagcctcttctgcccattgtggattttgaatcaagccttcaagcagccttaggtgcttcccagggaagcagaaaccgacaaccatgataccaagatcgtgcaaagtagctttccaggcaaggtcatagaagttgatctagggtgatatcttcctaaatgactagtacatgatgttatcattagatgggagggagaaaaaaatacctccttatcccacagagggttattcagttatctgaaagaggcaatatttattctgaacagcttcaactacattataatctataatctgattggcgaatcaaatataaaagaccggttattaaaatttttttttgcatgttttgaagggaggtgaggatagaagaaggaaagcatttggcacctgaagttagggggtgggtggctggtttatggtgtcactgactggtttaaagaatggttgcaccagagaaggctaccagtacagatggtgagcagaaggccttgcagtcttgctaacttggcaactttgctgaggatggacctccttaaacttcagtgggatagggataaatagaaggcatgcaccaagttattttaatcatgcagctgcagatgtaggcagctctacattgtaggatttggaaaattctatttttaaaagcatgattgcccttggttaaattaaggagctggattcccattaatcagtgccagtatttatttatttattgagatgggtctcactctgttgcccaggctggagtgattagcacaatcatagctcactacagcctcaaactcttggctcaaatgatcctcctgcctcagcttcctgagtagccagggctataggtgagcccaccatgcccaactaataattttttttttattttttatagagacagagtctttctatgtggcctacgctaacctcaaactcttggcctcaagcagtcctcccaccttggcctcccaaagtataggggttataggcatgagttatcatacctagccagtgctaaaatttagtttaccctatagttcatataatattactttcttatataatttttgctattgatgtaaaagtttccttgcctgatgcaaaaaaaaaaaaaagggaggaactatctttagaaccaatattcactctttgtttctctgcctagaaccctgatgccacccaatttctagactattcttggtctcttgtttttgaacctactgttttatgttatggtatatactatgcaattaaaaatacagctaccgctaagatcactgcactaagctgtttcccatattctattagggggaataaatttaggttctctagatgataagaagcagttacaataaaatgcaaggacgtttggagcatcgtatttatttttcatcactattgtcaaaaggatcatttggagatgtgctacgagccttttactgttctaagtgtcacacttttttttttttctaggcccattcagctctgggatgctgcataagtcatacttctacattttgcacttttctaatattttgtcattagaatagattcagggttttgtagattaggccagtgatgtagggctaaagtttatagaatgtaaagcattgtataagacatgaagaatacagccaatttcagctctttcagaaggaaaacttttggagcacctttatttagaccattttggcatcagaattagaaaacaaaacctaattgtagttatatagtttacatatttctcaaattaccctgatgactgctttggaatcatccagatgttccatgggtttttgttcaatttaattaaattgaattattttctgaaattaaaaggggttgtttgttgaattttccaatgtcgctgccttttgttgactgctagcaattttaaattaaaatcattatttttcaccaattcccacacatacagagtttagcattgtctatgtgcttcacctgggctgaactaaagagtatgactttttgtaatgtagtacattttacctaagattacttttcttaaaacaagacagttgctttttcttcagattattgcttgaaaaacaggcttaaagatatcgaccaaagcttcacctgcctttttaacagctttctttaaagttgacatacataaaaaatatctcttttctaactaagaagctttgtcaatctttagagctggtaatgtcttaatcctggtttgtggtacaagtgtgtgtgtttgtgtgtatatgttttagtatttcttctcttacagaaaaaaaatgaaatggccttttaaaaatccagccttcacctttgtgatcagaaaaaggaaatctaattatatttttagcttttgcagtttctacttctcatcaattaactatttttgctatcaaatggaaaatctgttttatactctgacctctagcctctttccatctaaatagttttcattcatcttagccactgggttgtgttttctcttctacattggctttactttcatgtatagtttaacactttctcatatatatatatatatttttattttttattttttatttttattttttttttttttgagactgagtcatgctctgtcgcccaggctgcagtgctgtggtgcaatcttggctcactgccacctccgcctctcaggttcaagcgattctcctgcctcagcctcctgagtagctgggattacaggcatccaccaccacatccagctaatttttgtatttttagtagagatgggccagactggccagactggtctcgaactcctgaccttgtgatccacctgccttggcctcccaaagtgccgggattacaggtgtgagccactgcgtccggcctctcctataatttttaagattcacttcatgattaatgtcttgcaggtaatatcctgcattcttttctctcttttatttacctggagtggtggttggactgctttcatttctgtccaaatattcattatgatagctaggcgatatagctctggagtctaacttagtaatgttttgaaggctttcagtgttttgatcttttactttttgcatttccaattctagtgagtatgagtgacaagtggtcagcaaggtagaagctaacagatgagaaagagtcattaaagggtagaaactgctgttttacaagaaacagggatgaagcagggagaagaggaagaagagatggaatttttgaattcatgcatcaaaaattttgttcttggagacacagtggggaagatagacaggtttgtggatatcactggaaatttttgaatggaaaagagaaagtgtccatgtagaggcatttctgtctatacagtaaaatgggaggagggggtcacttgttaaagtgaagttgagactgggagcctcaggacaatatttgccagaaaagaagcaaaagaaaaatataaagctgagtgaggagtgttttggctcaacgtggattaagttgctctgctgcttgaagcctttcatcagcactgtttgattagcaaggaaagtatttttttctttcttgatgtttattaattttgtgatttgtcctggagcacagtaggagaaacaacttgggacaaataaatcatatcaattggcctcatgtatctttgtaactttttcctgagcttaaactagggtcccctttaactgcaagcgcctaacaccatcattatagtcaggagtttagggtgttctggacccacattgaacttgacatgcctcccaagtgcaattttgaatagatcgtaaataagggaggccatcagaccccactctgattgcccaatctttgcgatggaccctgtcagttcttgccgttttccatataactagtgtgcttgttcttgctgcagtacctttggctaaggtgacttcttcttcacctggcaaggcttttccctgctcatttaaacatcctttatgcctaagtagacagttttcatcgttctagaccttgccttaaacttgacctccttcgtaaacttgtctaaagctgcagctgttctctttctctctctttctgaatagtgaattctgcccagttcaaatctttattgatatatttctccctgttttcttaggcagactgtaattttcttgtgagaaggaccatatcttctttgtatcccttttagatccattcaccatagtctagtgccaggtgtgcatgacgtcttcataaatgttcagagtggaattttttgtcactggtgtttgattttcataaggtgacgccagtagttgatgtttcaaatatgtccactccccatatttgtgatactacagataatagttattataattaagtatctttggtgtttcaggttttcttaataagctttattaatttggtaatttaaacattttattttaatttgctttttatttttctctcttcattttcatggttctgtatgttggcccggagtcgtgactcttaaggatgccatggtaacctgtcagagaattgttgtgttaagttgttctttgctcccttctctgagatgtgctcagctatgatgatctgctccatcactctttttttcttgcagttcattcctagtgattaaattatcttttatgccctgtattttcactatttcttctcatataggcaatataaagccacagcatgtctgagatatatatgtctcatatggatatgcactaataatatgtatgaaaactttacaatttaactcatataattataggtcattccagttaacttgtcattgggttctcactgggtagcggtaatttgcatggctcagtcaagccaaggaactttttatgcaataaaaaagtacaaaagaaacatttaagttgaataatagatttattacaaaataattacaaaatatatttattatttaatacaaaagaaataaatgtaacacaaagctacaaatggcataaaagtacatatttgtgttccttttaggaatcaaacattttaagtccagtgcaggatggaacaaagaaacctcagattgacagcaacaagagcaataactaccggattgtaaaggaggtcagcagatacaaaatattcttatataggtttatatttgcatgccaaataagttttgcttatatattatacttaatattgttatttattatatttgatgctttccctcttccttttaaagattttgatcaggctaagtaaactctgtgtgcagaataaaaagtgtcggaatcaacatcaacgattactgaaaaatatgggggcgcattcggtggtgttggatcttctgcagataccctatgaaaaggttagtcctggttattttttgttctttagctttttattttgatacaatttcaaatgttttgcaaagttccaagaaattttttctttcttaattattttagaataaatcacccaccaggtgccccatcacccctgagcccttttgtgtatgttttctacaaacaagggtacactaccatgtcaccacactagagtcttccatatcaggaaagagcaaggcactttactgccacctagtccctacacgctactcagatttctccctttgtcccaattgttttcgacttgaaaaaaagatccacttcagaatcatgcgctattcggttgtcatgtttatttaaatctcttcatgtgggaactcccatgacattgacactcttgaaaataaccagttattttgaaggatgtcctttaatgtggatcatctgatgtttcctcgtgattaatacagttaggcatctttggcagggacataaccggagtgatgctgtgttcgtctcattgcttcctatttgttggtgcacgattttgatttgtcccatgactgatgatgttcactttgatcaattgattgaggttgtgtctgccaggtttctctgatttttccctttgtaattcccttgtaattaataggtattttgtggagcagttctgtgaaactaagtaaatatcccattcttcatcaaactttcaacttattcatttattgtgtttatttttatcagtatgggtttgtatatattcattttattcaataggttataaagggttctatcattatttattttgatttccagattgtctcagatttgaccagtggagttcctttgagctagactatctgtcttctaacatcacccccaccattctttgattacttccttgctttctggcacaataaaatgttccaggttcatcttgtattctccttgcttcgactctagaatcagccatttcttcaagaggccccatttccatttggtgggaaatggtatttaggagcaaagttctgagaactgagttctcagttcttattgctttggggtgttgcccccataggccctctaaataggcaaagctagggaatatgcatatgtatgggtgcatgtagaaatttatttaatattaatataaaataccactgaaaacatgagtccatctgaattcgtaacaatgcccacatgacaaatggtacaatcaactacatggggaaattttaggtagtttcactgatgttgtcacaagaccacttttaagaagacaaatttgcttctctgtgaattttgagacttaagtttcttgttaagattcttataatcaaatgatagtagcttagtataggactttggaaaatggcaatgaataaggatattcactattaagagtgttaagaaagagggggacaaaaaggaggagaaaatagaagagaaagcaaagaggaaaagaaaaagaaataggtggaaataagagacaaggtaaatagcaaaaggaagggacagagagattggagagaggaagaactgagatgagtgagtaataaatatatatacagagaagattgacagagtggaggaagagaggaagtttgaatagagaggaaatagagtgagagcagagcaggagaaaaggggatgggagcagaagaaataatagataggaaaagaggaaaagaagagaggagatggaatagatgtgggagaaagagtaggaaaggaagatgtatgagaaagagagtgaaatagagtagggaaagagagacaagaatagaagcagcatgatggagatataggcatactgcaaaatgagacatttaaaggaagggaagaattatggggactggggagtacagcagagaagggaggagaaacagagaaagatagggacagagaggaaaggaggacagaggaggtgtggagataaagcagaggaggaaaaggtggctatgtacagagatgaggaaacgtggtggacagttggaaagattggggagaaagagaagggctgtgaaatgaagggggcattggaaaagtagagcagaatagaatcaggaggaataaccaagagaaggtgagaaagatctagaaaacagagaagagggacaggaggggaaactgggagaggtgtgaaacataaaggacacagagaaaggagatcaaagatgggcagagagaaaaatggtatgtgggtgaaggagagatttttgcataacatttgctgtctcctatgtttgtttctatcatgtgctattctttaacttacagaatgatgaaaagatgaatgaagtaatgaatctagcccatacatttctgcagaatttctgtcgaggaaatccacagaatcaagttcttcttcataaacatctgaatttgtttttaactccaggtgtaagtattttagtggcttctagtatttctagtaaagtgtgcatcaaatttgtctcagtaacattcatgaagagaattttgttacacttccttgcttcatttttttttccttgtggaaattctctctccagaagtgaatatcttttttttttcattaaggaaacttttaaagaaacttgaaaaattgcacaagttttacatgcaaatgacaatgtattttatacgtatatagttaaatgttagggaaaagatatggtagaacaaagaactaactcacaataccatgagtaaggtaaatatggaaaactcagaggtggagtttgcccttgtctgtaaaatgtgtttgagcagattttatggaagacctaattttgaattcataattagtctcaagaatactgttgccaatatgttgcactttatgataataagctcctttctccaactaaattcctctgtgagctcagttttcttttaatggttaatgatctcatcgcattttttgaaagacatgcacagaaaattcactgtggcttcgtataaaatataaaactgatcacaagcagggcaattagtctaagtactgtagaatagaaaattgatcttgtcagaattacaagggcatgttcctctgtgtttagctccttgaagcagaaaccatgcggcacatcttcatgaacaattaccatctgtgcaacgaaattagcgagagagttgtacaacactttgtgcactgcattgagacacatggccgccacgtggagtacctgaggtttttgcaaacaattgtaaaagcagatggtaaatatgtgaagaaatgccaggatatggtaatgacagaggtatgttctcagtttgccttttatcagcttcacctaaacagtatgttcaaatatgcattttctattacagtgaaaaagcccccaacaacataggtttggaaaattatttaatttaatcatgactactcaagtgcaaatatattttgctttaatttagtgaagcaacatatcttaagttggttttatgatttttctaagtttgtttttctttttgacctataatgaatttgtgtattttaaaaaatgggtaaaatcctatgaaatgttgtcgattgtttggaatgaaagtgacaaaattttatatttttaagtttccaatgatataagaaagacagattaaactgtgcttttccagtgcctttattgctctgtttctgaaacatagaatgggtgttctctgctgctatttgcagaaagctttgaagagaatcaaactaagtaatacaaactacctaacagtgattttttttacaacatgtggaaacttactacttagagtaagttacaaatttcagcaaatgaatagatgaaggtacttcatttctttatttgcctttttcatgtttatgtttgacattgagtgatatttatgtaatgagtaagttactaggaagcaagtatgatacattggagaagtagcagcttaaagagcccgttgattaaatcaccgctctgtgaccaaatggttctctagtggcccatttgggttaagggagcttccacccatggctaccaaacagttacatggtagatttttattggtttctgggcattttcattatgacataccttaaatttgggaatggaggagatttccataatgattcaaggagtccctcctgccacttagaaatcttaaaattaatttagcttaaagccttgaatttttttaaatgtaaattattgttattaaacattttaaggaacattttaagcttgtaaaatgcacctttttcttatctgcatttgcctacacattagctcttcattgtctggaaatgtgagaactaaaggattttgtgttatgatcagcaaggaaagaattagaatggggaagcagcaacagtgaaaccatccctatgatactgttgggtgaagtgtttctgtgcacaaagaagtatttgtaatattatgttaatatataatacatatttttgatacacatacattctctttcaacaacactttcaaagtaagccaatgaatcggcttatagatttaaatatattgtcactttaaatataatacctagagaaaaaaattgtatgtccttagttacccaccaatgtatctcacactggggttagaaaattggtactgataatagacaataagatactatggagcttgaacaataaaactgccacctgatggaattttctactaaaattatataaacaaaatgtgaaggaaaatttatgtcttaaaagaccctacctattcatatctttgtttctctcggttttttggttttagttttctacttatttctcttaactctgcttttaccttcattctctgctgatgccttcttatgacacatggaattttgtagacttttgtagagctgtaattagctcaatgtacttgcttccttatgtagtcattattgcaatggatgaggatattttactctgctttagtaaaattatgagatttcttgtgctttggccatggagtctcccaaaaaaaagtagaggaaaataactttatttttttacaggtttaatttcagtgtgatgaacaatttactttcatccatgttgtttcattcttgccctatctgctgcttccacatcgcctcaactggttttgatagcgttcatagctggttccttggcatgggaccataatcttgtcaccaccctccccaagcatagctctgtctttgccgtattatatatgtttttacgaagagatatacgtgtttccagatatatcaagcctttggaaataactgcaaggatgaatgttcggactgctacatagactctcttattatcatttcagttgataaatgggggtgaagacgtgctgatattttacaatgatagagcatcatttccaatccttctccatatgatgtgttcagagagagaccgaggggatgagagtggccccttagcctaccacatcaccctggtggagttgctggcagcatgcacagaggggaaaaatgtctacactgaaatcaagtgtaattcccttctcccgctggacgacatagtgagggtggtgacccatgacgactgcatccctgaggtaagcctggcaaaagcttagcagctctaatagaatcattattaatttttgaagtttatctaggtgccagaagtcccccatactaatatttataatgagatcatatatttagtcagggaattgtatttaactatataatttggaaaatgtaaaagagcatagaaggtctactttttaataagaagttctataagaagttctgcaagatgataaactttttttttttttttttttttgagacagagttttgctctgttgcccaggctggagtgcgatggcaagatttcgactcactgcagcctccacctcttgggttcaagcgattctcctgcctcagcctcccgagtggctgggattacaggcatgtgccaccatgctcagctaatttttgtatttttagtagaaatggggtttcaccatgttggccaggctggtctcgaactcctgacctcaggtgattcacctgcctcggcctcccaaagtgttggatttacaggcgtgagccaccacagccagcctatgagaaacttttaagaactatagccactgctagtttagtggaagctactagacagctctcttcaattctaaacatggccatatgatcaaactgaaaggtttacttgaaactttagtatgtacttgagcataaaacaggtgcttcaaaaattattcataaccattgattggagaggctaggatagtgctgcaggaccacataaaagactctgcaggtttacctggctttatggaatagatgcattcttgaaaatatgcacacacagtttgctttattcccacatcatttaccctctgtcctagtttgtttctgatgatagaaaaagtctcagtagcagctggttgtctgccaataggcttctattaatgaggcatccaggaatgtacattgcgataatgtctttcttttctactgttgggaggggattggaggggagggaaggagaggggaagaagaaagaaagggaaaaggagaggaaggagaggttgcttttgactccttgtatctcaaatatgataggcttgttttgcataaagttctttctcacagcaatggttggcccagggggatggagtactaggccccgtgttttcacccttaggtcagtggactgttagcaaaagaagagaaatgagaatactttctggatagacaaaactatgctatgatctaccataaaaactaacagattttatgttaacctttcataattgatatttgaaagtcatcaataaagaaaactaactttcttttgtatttgaaacttgcacaggttaaaattgcttatgtgaactttgttaatcactgttatgttgacactgaagtggaaatgaaagaaatctatacaagtaaccacatttggaaattatttgagaacttcttggtggatatggcaagggtaagttagattttgactactgaagggtgtcaatagatatttcgactaaatagtattaagcatctggatgaaaacttgcagttaaattcactaccttttgatttgttgcattcattcataaagttgtgaataaatttcagaagattgtgagtgagatttaatgagttaatatatacacaaaatacttagtacattgtagatgacaataggtaaagtgttcatttttacctttatgagtgactgtgtttgtctgttattaaatggaatcttagtggcctctttatattggttagagaagatatttggcagaggtcaatttgcatttaatctcttattctaagtgcaattacaaagcacagatcaagagacctaaagaggtcttgactactgctttcaggcagataggtacttgaccagccgactgaggacttggccttgctcgctgttgcctattcaaaatcttctttggaagtgtactccagtaatttaatcatctggcattttcactcgtgtccaccaaattatattcgcttattactgtttgttttgttgggggctgttggggaggacatgtggagctggttggcattttctagatactgcctgacatatgtttttgctctgttaatattgagtaaatgaatgagtgaagaaatataagaaagaaggaatatctttgatggacaacacaattttctttagcacatcttagccttttttttttgcatactgaattatcataacagccagtgtctaaaaaaaaatctaattttccctttaaagttatgggacttgaagttcaaataaagtttcactaaagaagacagtatatagataactccttagacctattatgaatgatggtggctggactcagcccctttggccttccaacattcctgagtgctagtagctttgtataggccttatatagatgtatttggaggagaaagattagtgaagtccatattttcattatctcaattacaagaacagatgctgttatctgttagctcactgcctctctatacctttttctgaaaggagggatgacaaggtacatccttgtcatccctcctttcactgcctgtagactcagacatgtaagagcacccttggataatacaatgaatcatacgttattccagaccacggactctttttatttagccagggtttccaagtgaaatgtgcttagtttacctttggtgtggtgtagtgtggtgagtgaggtagttcctgttttacttcatttccatacagctaaaagccacttattgcctatctcaggtaaatatgcacctgtagagaaatcgtcctgttttatgcagcatttaacatagtactcatatgtgtccccattgaccttgtgaaaactttgtttctgaccagctatagtatctccagagaccttcaagtaaggagtgacttccatgccaatgactaagctttaaaactgcacgtgcaggaggatattaaagagattatagactgatttgcggagttgcacagtgctactgactaaagataagcttgaaacagatcaaggtcacattgtaggcagcatgagctataaagctgaaaggatttttattttttaaaccaaagaaagccaatgataacttccattgattatgccacctgagaaataccgttttcaccgatgtatttgcaaggcaaaggtgtacagatttacattctttttttgaaaaacacaaaaaaaaaaacaaaaaaaatagcaatgattttaactattgcttaattggataattaatgttatttattatattaaagctctaggggaatttcaatatcttcttgatctatttattatttatgtctaaccacaataacttagctatactgcaaaaaggtttttaaaaatatttccctcttgtttatattttaaaacagtagctctctaatcccttcaccagggttgacaggaatcacctttcctttttcagggaaggaaatagaaacctgactttttcatatctgggatttctttctctccccatgaagaaagatcagagtcaccagaaactttcaaattcaagttataaaactaagtgtggttaaatgaatagaatgtggccttctaggtaaattttcagttcagttgagcagtttttaagctttagtgagcatcaggcctagctggagggcttggtgaaatacagattgctggtccttgtccccagaatttctaatttccataaatgaaagactttacatttttaacaaattcctaagtggtgctgcaggtgctggtccagggaccacactttgagaatcactgtagtagacagagcatggtagctaagagtagggatttcaaaagatttagccagaccagagttcgagtccagactgtgcctctcagtagctcagtttatcttgggcaaagtacttaacccctctgggccctgagtttcctgatttgtaaaatgaatacaataaattcacattccccatagggttagtgggagaatccaatgagataatgtgtataaaattcttagcacatattagcatcagtaagagagttggtaacatcatccatatcattgtatccagaggaccattcagcatagggaaaaactagaaattatgtccataaagctggacatccacaacagtagttgacatgaatagccacgtatgagataaaccaaatccagatgttccaacaaagttatgacattctggaagaactgatttatatccatgagaaatgatgaaggtaatctggaggaaaggaatttggtaagttgaacctaaagaatcatagcatcttagggttggaagagactagtagtcaaatttatatacagttcatagtcttcagcacttactcaaatatctgattaacaatgagcttactacttttttctttttctttttaaattttgtggataaatagtagctgtatatatttatgaggtacaggagatattttgatacagccatataatgtgtaatgaacacatcaaggtaaatgggatatccatcacctgaagcatttatcctttctttctgttacaaacaatccagttatatttctttagttattttaaaatgtacaagaaattattgttgactgtagtcactctgttgtgctatcaaatattagattttattcattgttttcaactgtatatttgtacccattaaccatccccacttcccctctgccccactacccttcctagcctctagtaaccatccttttattctctatctccatgaatttagttgttgcaatttttttagtgcccacaaataagtgagaacaggcaaaatttatctttgtgtgcccggcttatttcacttaacataatgacctccagttccgtctatgttgttgcagatgactggatcacattcttttttactggctgaatagtactctgttgtgtatatgtaccacattttctttatccattcatctgttgatgggcacttaaggtgcttccaaattttggctattgtgaactgtgctgcaacaaacatgggagtgcagatatctcttcaatgtacaatttcctttcttgtgggaatatatccagaagtgagattgttggatcatatggtagctctatttttagttgttgcttttttttttttgagatagagtctggttctgtcacccaggctggagtacagtggtgtgatctcagctcactgcaacctctgcctccggggttcaaccatctcctgcctcagcctctcgagtagctgggactacaggcatgcaccaccatgcctggctaattttcgtatttttttttttttagtagagatggggtttcaccatgttggccaggctggtcttgaactcctgacctcaagtgatccacccatctcggcctcccaaagtactgggattacaggcgtgagcctctgcgcccggctatttttagttttttgaggaaactccaaaatgttttcccttgtgattgtccaaatttacattcccactaatgtgtacaagggtttccatttctctacatgctcttcagcatttgttattgcctgtcttttggataaaagccactttaactggggtgagatgatatctcattgtagtttcgatttgcatttctcttgtgatcaatgatgttgaacaccttttcatatacctgtttgccatttgtatgtcttcttttgagaaatatctattcagatcttttgcccatttttgaatcggattattctattttttcctatagagttgtttgaggtccttatagattctggttattaatcccttgccagatggacagtttgtaaatattttctctcattttgtggattatctctttactttgttgattgtttcctttgctgcacaaaaggctttttttttttttttttttttttgagatggagtctcactctgtcacccaggctggagtgcggtggtgctatctcaggtcactgcaacacctgcctcctgggttccagtgattctcttgcttcagcctcccgagtagctgggactacaggcacctgccaccactcccgtttaatttttgtatttttagtagagacggggtttcaccatgttggccaggctggtcttgaactcctgacctcaagtgatctgcccacctcagcctcacaaagtgctaagattacaggcgtgagccactgtgcctgacctgaagccttttaacttaacgtcatcccatttttccgtttttgctttggttgcctgtgcttgttgggtgttactctagaaatttttgcccagaccaatgtcctggacagtttccctgatgttttcttgtagtggtttcaaggtttgagatctcagatttaagtctttaatccattttgatttgatttttgtatatcatgagagataggggtatagtttcatttcttctgcttatggatattcagttttcctcgcactatttattgaagagactgtcttttccccagtgtatgtttttggcacctttgtggaaaatgagttcattgtaggtgtgtggatttgtttctgagtcctcttttctgttccattggtctatgtgtctttttatgccagaaccttgctatcaagtttttccttattacattttttgcctagttattttttctccagcaacacaaaataattcagttaaagatgtgtttactataaacacctcctcactattcttgctagtgacctattttgaaacgacaaaattatataacttgaagaaaatgaagatcatcttagttggtctcataattttgcctgtggcttctacagagagaattttctgggtgactctcctagctagatatagagtgggagggctgctgtagcatcattcagtgcttttccccaacagctggtcagatattttctgatagccttcatatctcccatcattttctccatgtctttcagttattcctcttctgatatagtttctgggattctagtttcaacatacttttgagatccctctagtttctgtgttttgttgaaaggtatgacattcaggatggaacccagtacttcaggcagcagatgacccagcacagtttattttagtagacatttggagaaatgtatatgtgtgtgtgtgtgtgtgtgtgtgtgtgtgtgtatatatatatatatatatatgtttatttatttatttatttattttttatttatttatttttttttttgaaacagagtttcgttctttcactcaggctggagtgcagtggggcgatcttggctcactgcaacctctgtcttccagtttcaagtgattctcctgcctcagcctcccgagtagctgggagtataggcccccgccaccacgcctgactaatttttctattttaagtagagacagggtttcaccatgttggccaccctggtctcgaacccctgacctcgtgatctgcccgcctcggcctcccaaagtgctgggattccaggtgtgagccactgcacctgacctgacaacaatattttttaaaatgcaaatgaaattactaatagtaatgaaattagcactcataccaccttccatcattcttctcttgtgtttctggagtcagcactaccagggtctttttgtctgtccttgagtaaagctgtctaaagtcacctttttttagtatttttcattttcctattggcatttccttgtctcttatcttgttaagacccatacaagaaaatctttcccaaaagattatttttaataaactggtgctagattgtttcacattcttattccattctaatatcctgacagagacagtatccatgtcctgtaagcacaccagatctaggcaggcagcgatgctattagacccatggaaagttgttacactgtctttcagagcatttaatgacagcccactttgatctatgttccagtgcagctaaaactggtgtttgtagggcagaaaagcttttctttggctttataactgattgttgttgatagtcaggggatttgagtcattattagaaggcacgtaaagagggtagactatggtcaatgttagcctcagactatattttttctttgaagatgtttccaattttgctatcaatgtcaggatcctataaggaccaacagtactctaagtgatgtactagcagaatgaaattagaccaagaaataatttaggaggctcacctaactctctgtcatgtcagtatcccatcagtcactggttaacaagacaaacttgtgtatttcactttcaggtagataacttgagccatttttttgatataattggttttattattctacaactttgttaacaactcttatattgagtcaagtttttacttaaaatttttgctcccttaacttaccaaataaatatgtaagaggttggagtaaagatataatttatatgcacattgaaacacactttcctagttctttaatttggtgacattaagtcaatttaaaaaaataattttcttgaatttcttaagttgaatgagctattaaaaaatctcattcaaaagggctcattttatatggtcttttaactaatatttcagggaagtgaagaagtataaagtattctataacttatacaaggcttcttcccttggaccccaggatgtcaattccactctatttgccacccaccacactgtccactcctcagtctcttgtctgttttctctgcaccttcccaacttctaaatattggagtgtgccaggctcagactttggaatggatcccttctctgtctatagtcactgtttgctaatctcatttactctcataactttctatggttctcctgatgtctagtttcacatattcaactgtctacatgacacctccacttggctgtctaacctcaaactctttattcattcccatgcctcactctaaaataaccccttttcaagactgtagcatctctataaatggcaattctattactcactctaggcattcaggcaaaccattttggtgccatctgtaaatcttattttcttctacccaaaatccagtccttccacaaattctgcaagttctaaccataaaatattccaaatttgactactcctgaacactcccatcacaactacgctaccccaagtaccattctctctcatttggatgattgcaatagcctcataacctgtttccaagcttctgctcttgtccctctctccatctattctttatctagcagccatcatgattgaaggaggtggaagaggaggtggaggagatggaggagaaagggatgaaggggaaagagagggagaagaaggagaagatgatcgtcactcctctgctcagattcctccagtgacttcctgtcttgctcagaataaaacccctgtgtgacttagcctctgccctatgaccacccttcttccccttgtcctcttattctccccctagctagctatctgttccatactgtggcctccttgctactcctcaggtatgccaaatgcattcctatctcagcaactgtacattttccagggatgctggacttccctgtatctgcataacttcttccttttcctttaggtttttccttcaaagtcactccttcagagagggctttgccaaccaccctatataaaataacaggctcttttctttatccttcttaacacttgcttcatttttctccatagaatttattaccacctgacatttacatatatatatatatatatttatttgtatttcagtaggaacaaatgaaagacaggaattttatctctgttcactgctgcatacctgacctagaacaatgtctcacacataatagatactcagtaaatatttgtgaaataaataaatgtcatatgaagctaaaaatatttaaaaagtggatttgaaaacaaagaaaatgtggtctgagcatagaattaagtaggcaaaccaatggaatgaaatgaatagccagaaatagacttttgcatatataatatattaatatataataaattatcacctattagtggaaagggattggatatttccagggattggtgaactttttctgtaaacagcaaaacagtaaatatttcaactttgtagactcctattgccactattatgacaattactatagagaaaggagtcctaggcaatacaaacatgaatggatctggctagatttgatgcatgtgctgtattttacccacccttggattattagtaatagaaactctattagaatagtggtttttatatattttgtttactgatggatctcaagtatgtagaatattcttggcatggaatagacactcaataaaaattgttgatttgaagtaaaaatgactgttgatgacactgactatttagggtgaaatgaactcacataatagcaataattgaaatggatttcatggctaaatagaaaaaaacctgaaccagtaaaaatggatggaaatgtagataatatttatctgtctttagatgaaagcaatagatgaaattagctaaggaaaatcatagccatttcagtgtttgaaaatttaatacttaagtacataaaaacatcataaataaaaatgaaaaatatcctcacacttgtaaacccagtgttttgggaggcccagttcagggactgcttaaggccagaagcttgagacccagcctgggcaacatagagggagcctgtctctacaaaaaaataagctcggcatggtggtatatgcctgtagtcccagctactagggacaccgagggaagaggatcccctgagcccaggagtttgaggctgtagtgagccgagatcatgcccctgcactccagcctgggcaacagagcaagaccctgtctctgaaaataaatgaataaataaaacacatcaaaatttaaatagctatggtacagttttaaaaagggtaataaccaccacatgaagaacttatatgtatttataagaaaaactcttaacaatttaataagaaaatgggaaaaaccaaacattcatgatttatagaacaggaaatacaaaaagttaataaacctctgaaaaatgttcaaatattaataatttttaaaataacacaaaaaataagatccaattttcaaccatctaagttgcaagcttggaaagataatattaaatgttggtgatggttcagcgtatgtatttgcatatcctgctgatgagagtataatttcatgcagcctttctaaaaagcgtttagaaaaacccttcatacttttctaatgtgtcaagtaatttaccctccaaaaatctgtccttgggaaataattagaaatgctataaagggtcaggtgtagtggctcagacctgtaatcccagtactttgggaggctgaggcagccggattgcttgagcccaggagttcgagaccagcctgggaaacatggcgaaaccctgtctctacaaaaaatacaaaaattagtcgggtgttgtggcatgcgcctgtagtccctgctacttgggaggctgaggtaggaggatcccttaaacctgggaggcggaggttgcaatgagctgattgcaccgctgcactccaacctgggtgacagagcgagactccgtacttttatgataatacgataatatgtagtaggaaatagcttaaatatttaatatttgacaaacggttaaataaattattatatatctatatgatggatgttaaagtcactgagattattttttgagaatttttaataatgtaaaatgcttaagcatgaagtataaaagggaagatgtgaaacacataatctagaatggtttcaattatgtaaaatatatatggcagaacaaaaatattagaagaaaaaattccaacatgttaatcatagtcttatctgaattataggattataagtaattttcatttttccattttatattttctgtatttttcagagttcctacaattaatatgtattggtattatgaaaatgttgtctgtttaaaaaaagaatttcgaattctaagaaagccagttgagtgtatgagctgatgattcacataaaaaggagatatagaaagcaaatgcttgcaaaagttttggcctcacaaataacggaatgcaaattaaaataaatatgagatatcacctcagatatttagaggaacatttttactgtttatgtaaaatactaaagtgatcttaggatttgtattccttatgatcaaaagtatgtgactggctctagaggtgccctgccctgtagagtagccgcttcccaactgtggctatttaaatgtaaattttaattcagataagttaaaaaaatgtagaaattcagttcctcagttgcactagtcacatttcaaatgttcagtaggcacctgtgtctaatggctaccatattggacatcacagatatagatgatttccatcattataggaagttctgtaggaccgtgctgctcaacatatggtaacttatttaccatagacgatcatccttggaagggtagcagtcacttttagagcagaagagaggaaggacatcatatatgcaaggggagaaaatcagacacaattgtatctagaaatttcacttaacatctgcttgttcaacaaataattttagaatatctgttatatgctgaggtgctgcatgtccagtggtgaacaagacagagttgttcctggtgtccaggagcatatatcctaatggcagagacaacattttacttgctcttcccacagaaacgttgatggctgcttccaacttcagttctttgtgaaatgttgccttatacagagataccaccaagctgtttaaataaacaggaatccttgaccatccccaccctgcctgctacattccctgtaccacttgccctgctttatttttctctagtctgttattttctttatttttactacttagcatgttatatatttattaatttgtctattgtgtgtctctcttgattgggagaaagggtctaatagagtagggacgttgttctgtttgattcattgttctaacttctagtctaatatgtagcttcaatttaataatttgtgtccttattacgtctgacaaatatatagtaaaattcatctggaagtagaagaagacaaatatttcaaaagatggatttttttttcttggaaaagacagtgatggtcgacttggttgtttcaagttgtgaaacatattacagattgggaatcatttcattctgtggagttaggttaaaatatattttttaaaaatccatggagtatattagagatttggggagagatttaggtactcattagtgacacactataagacaaacctcaggtaacctaggaatgaaacaggaattaatatttaataaatgttttgaggacaattgaatatccgtatggagaaaaattaatcagaattcataaattaggtcaccttcatcaacaaattgcagatattttaaagagttaaaaactagaataaaaatgtatggactattctttttaagagggagtttttttcttctttatattaaatattaataaatagtaatgaacaaaataaataacagtgcctgaatgttgaaaagtagtttacacaatgaaatataatgaaatattttaaatagaatgcaaaaatacatatgaaatgacaattgaaaagagctcataaaaatatgttaaactcatactaaatgtgcagtcattaggtttttggaaaatggtttacagggcttgaactgttggtgtatgacagaagatagaaatgaaatgattccatgaaaaagaggccaaccttgttaacagcaagggaaatgaaaaataacttttaggtataattaaattgataaaaacaattataatttactggtatagcagtcagttctcgtaggaaacacatggcacatttcaagaaacgagggcagatttaagaagggataggagagtactgagggattttaccacctctagaccctgaaggcacatggagcaggcattattactagatcctggggaaagcctggagacatggaggaagggcttcagtagcagctgtatccagagaacacagaagcccctacaaggagagggagatggggatggaggcagaggtagagtaggtgcctgacttctttctcttccactctgtaatctcctgcaagagcctcacattagctgaatacaaccagagccccaaagcaaaagctatttggtggtaataagggaccatcctgtgtatctgtggatagtttgttgatagtattgtaaatttattattttagaggatcagcccagcaagcagtataaaactgtctacataccctcatctggtgattcctcttttggtgaaatatgccaaaaaaatctgaaagtgaaaacagtaactttgcacaattctttataatagcaaaaaaaaatcacatcataaaagatgagcaagaaggaaataactaagaagataagaaaatgatttgtaatattggtaatgtgtacctcaactcattccaaaaatggcttaaagcatgatggtgcattagaattatggaataaatatagctttttaaagtaagtgtttagataatggcagtacataaaagtgttttataggaaagaatgttatgtgaataatatgtgcaaatggattaaaacttttaaactatatgtattgcacataaaaagatcatttgatatgatgtaattttacttgagccatggccaatctattgtaaagagaaaataaattaaaataaaagaaaataaagaaatattcatatgtatgaggatcattttcctgaaaaattttaaaatattttaataagtgcttcctacatttcttggctgtccatgatattataatataagatgcaaggtgaaatgttatcattcataggggacaggaaaaacatcttgaaaaattatttgaatttcttgtttaaatgaactgaggactaggttccacatagctttgtaaaacacagacttttcataaccctggattttgaagaaagtcttgatccagaaatagattattttcattaatccactgactaaaaagcaaatttctgggtggttttttggcaagtgcccagttgcagaagatgcagtgtggtatactctgatgactccagagagccccacgcaattgcatgaaatgtcactgaatgagggaggtcgtttgttttggttatgatggaattggtctgctacctcttcaactttattatatttttaacctatgtatcaggaaggttcactgtaaagccagtgttaggaagatactaaaagaagtaaatcctaattcttatccatcataggaagatcaattttatattagatctgggaccatgtaaattaaattaaattttaatcctaggttagatgttccaggaatatagcccaacctaaagttaacctaaaacaaaataagagtccttaatccctctttcatttaaaaatttactaaattattaattcatttcacaaacgtttgttgaacatcttgtgtatgccaggcaccatgttatatgctggaacaataactagaaggttacataatttgacataatttatttccgttaattgcactgttcctgcagttatcctatgaaattagataccctaaaaatctttaaaaacaaagtcaggtaggggtcaattaatagatgaggaaaaagtgaactgctcagatgggaagtgacttagatgcaaaacaaaccctgttctctttctcccgcctccatttggcaaatgctggcattagtgctcccagatctcaaaacaaaagccccaggacacatggtttgagaaggaaaatgttctcttttatgaatttgtgtgaaagcttttaaaacaatatcagattaagtgacattgacttattcttttggttaagcaccttattgaaaatttttaaaaattacataaaaatttggatggtctaagaacatctggaacatctggccaccatattaccaaccacaattttgtgaaaatttaaactttctttctctgctgcagtttttcagtcttttctaacattctctgcccaccactcccacttctttttctttttatctctatgtttttctgtcttttcaccagccaactttttttcatgtgtttttaattaggtatcttagcttttgcaatttgttcatgctgacattgaaatttacagcaaaatgcaaaatgaccaattactgcctcatttcatcagatgtaaagatcagagcacgagccagggatgctcttttctggtctttctccagcttcagcattgtctctttggctgagaccactctgagaagaatgcacgcaaacctatacttccatgcttcttagataatccatggatgataacatcaaaattattgggaagggtttgatttatcttctcctacctttctgttttcctctccagatgctttctgtgtttgtgtcctccaatttgagtgagggttgggagtgaaaatgtttggagttactaactaccattaatcacctttcttacacttagaatgactgtttcgtctttggtctcttacattgagtggaaaagtgttctccagcaaagccaagcttggaggctgagggagaggttggtgtgcaagagaagggagaagcaaattaaaaagaagaggctgggggtctgtgaaagaattctggtttcaaggctgaaatgacaggctaacttgatggagcagctactgaagattgatacaattatcatgatttcaggctgaaatgcttctcttctcagcaactttaaaaagcagaagaaatgttactgacaactatttcaggacaatttttaggtggttccaatactgaattgtggtttaaaaatgtgataaaacatattgagttgttttattttctctccaggtttgcaacacaactacagacaggaaacatgcagacatctttttggaaaagtgtgttactgagtcaataatgaatattgtgagcggcttctttaattctcccttttcagacaatagtaccagcctccaggtaagttaaacaattgcaaagcattctgttgcaaagagtttctcttatttgagtaggagaaattttttctggtcaggaagtcatctcctacacttcagatgtttattcttctcttatattatttactattatgcctctttctgagtttaccaaactttactttaaataaagagacctcatctttaaattgaattatttttcctttttctctaagcagactaagaacttcatatctgtatgttgattgccaggtgttgaaataactgcacaattaattctttaaatgatagacattttgcccctaaagttttactttagtaacttatcctaaaagaattaacaaagatttatgtactaaaacttctaattcaaatatttgtaatactaaaaatttaatcaattaaacatccttaaaaggaggaaaagctaaataaattatgatatatctgtaggatggtttattatatagtaattaaaaatcatgttttaaagggaaaattgatgaccaagaaaataaacatgaagtaatattaggccactgaattccattatagtattatccaaatttgtttgtgtacagaatatataaacatacatgcataaaaaaactcagggagtaaatatcttcaaatattgatactatatctctatgttgtagcattcttgatgattttcatttctgtggtccacaaatattctacagtgattgtgtataactcttctaaaaatatcatttcaattatgctttctttagggaaaaattttaaactattagatagaaccataggaaattgtttctgtagttcaaaatggttgtctcctctacttgcccatcatatgaaaccaaaacaaaccaaccaacccagaaacacctgcttatttgctcatgggaataaaccatggattataaaagatattcatgtcattggcttcaggaaatggcatatttttttctgattaagaatataattaaaatgaaaataatcaatcccctatagtgtgtagcatcttgcctctcatgaagagagtatctaataaatgtttcatgaatgagatatttattaactagcactgaaacttgaaagattgtattttattttattttgatgaacctttctgagaatgcatagatgctacatcagggctgttaatggtttagcatctctttttgcctaccttctttctggttttagacacatcagccagtttttattcagctactgcaatctgccttcagaatttacaattgcacctggccaaacccagcgcagaaagcctcagtggaatcctgtatcagaactttggctgaagtgggtaagtcatagtttgagttttacttatttttacatttcttgaagaaattaggtttttggctaatgggcaacacaagcagcttcccaatttacaacttaagaaaaccagtatgttttctgttaaactgaagagcagccatcagcaaatgattctgaatgttgcatactttttgggaggaggatataatcattatattaaaaatcttaaatttaatattattgcatatggaactttaatatggctcagtcagattttagaggattttagttaattgttacctcagatttcattatggaattgtcttgtctattaagtggcctgacttgctaataccttcatatgacataggactttttgagggtcttgtagttttccaattttgtttgaagtgtgtcaatattcaaggcttcagaaattacaaatgaaattgaaggcaagggaattacagctaaaggaaggtgagtagattctagaagagtttctcatagattcttctctgtgtatgggggtggggtgtcgagagagagagagagagagaaagttaataagttaattagggccattcccccaatggtggaggggagaggagagaagaaatgcacacttggctgtactgaacaaaaaaggaagagcttgatcatcctttcaactaatggtggctctgcagacattgggaaaggcagtttgtagcgtatttcattatcagtcttcatcactgttaacatttgttgggtacttaccatgtgcaatgccagccatttacatgcattatctcatttaatccttagataggttttaaattatttacatttgatagttaagaaaacagagagttttataggttatgcaatttggccagggttatagcatacctcaacaaatatgtgagaaatgaataaatgacttaactaattaatgaccatttaaaatgtttttagtcatttctccctgtttgcaatttgacctaggttattttatattaacaaaatttagtgacagccctgattttgatttgaatacaatgaaaggcagttataacccaagaggcttaattgaaaattagtggaactaatagactaataatacagttgacttaagtaattaattataaatgagtattatacttaacagactttctgtataccacaaaagagaatgtaatatgaaaaagacgtcattatcaatagcaacaaaaacattaaacatctaagggtaaacaatatgagagaataaaattttactatattgaaggatataaaatattttaataaatagagaaacataatttcttgattggaaaattcaactgataaagatgccagttctcctcagataaactaataactttaatgtttccacacctggaaccattctttgcacataccctcctcacctcagagcccacatgagctgggatcccccttggtgggccacaccccacaaggatgctgtccttttgcagcttggcctctgctaccctcctatggagggacattgccctcatctctggtcttagtctgttttgtgcttactctgttttgcactgctataacagattacctgtgactgagtaatttatcaagaatagagatttatttctaacagttctggaggctgggaagtccaggatggagaggcgtgcatctggtgagggccatcttgctgcatcatcccatgggggaaggcagaaggtggaaggcaagagaggaaaagagagagagagagagtgaaaggaagggggctaaactcatatttttattagaaacccactcccaggataattaatccactcataacagcatcaattcatttatgagggctctgtcctcctaaaagtcccacctctcacctctgttttattgaggattaagtttctaacacacgaacttcgagggacacaataaagccatagcacctcccttgggctggtgctaggtcaggctgctgctctgcaggggatccccttcacctggcttggcctctacctctctatcctgggccactcctttgcatggatacactccttgactgtaacccccaacccaggctgctcctcgcatggacaccctcctcactccacttgagttctgattctctgcaggcagtcctcctacatagaccttccactcccttttgggtccccacattctggagcgccatggctcttttgcacatcttacccagcacggacacttactgcgctgcgctcctcctaaagattttagaactgaatggtgtgggaggggaagtgaagaggtacaggaagaggaagtggtcacaatatgtatcatatcaagaataaagaaggacacacaaaaataaagaaggagaaataaagaaagagaacgtaatttttattttaaaaggatgcacagaagaaagtgttcagagagataaataaaattttaatattgattatctctgagtggtggatggatgatgtgtggatctggttttcttcttcacacttttatgtaatttctgctaatatattactttcaagttataatgaaacagcagtaaatgtatttttatttgggccaaatcggttaggaaacacactaaccaataaaagataaaatcaaaggaaaagcaaagaaatatgatggtgttaatttttacataggaatacattgtcttagctgctaagtatttttctttcagtatttcacatattaaggtagtctcttctctttttccttctttctctctcctcttgttcctcctcctctacccctcaatatttagcaaacgcaaggcagggaaataccagttggccctacacagggcgtagcgggcatgttgttgatcacatgtatacattgagagaaaaagaacttggagccacaagtgaaattccatgttgtgactgctttctgaattctgacttcagtgatactcattgtgtaatccaatcagttcatgcatagaattgcagagatttgggggcttaatatagttactgaaactatattagtctaaatacatcttttatttctaagtaataagacttcatttcctaccatgtccatactggccaaagcattataatttaagaggaaattttagttccttttcgtatgctataaagacatgtgtgataagtctaaaaaataattatatcgaagggtataatcaagataggtgaagagtgaggtttccatatcaatctcagttttctctttgtgagaaggcatgccttcttcgttttccttgttggtcccttccatctgaacagttaaggctctggaaattctgtccccactctccttctgcatttgttcttcccctccccttccccgcatcgtggcctcattaacccttcattactttcttcttggaccactgcaggaaattaatgttatctccttctgtctttccttatttagataagcctgataccagagtaatctttctgaagtgaaattctttgtcggtttaaaaaatcaacactacatccccaaccttcagcaacatccctttgcctaacaacctaaggctagattcctcactgttacatctaggatgcccccacatggctcacactagctttctcgagtttccaccattgccactcctcagcatctttcccattactcgactttttttctgctcaaattcctccatagccacccttggctcctacatccaaatctgaactcaccccattcgtccacgtatgcctttcttagtgtctgtgatatggtttagacgtctgtcccctccagatctcatgtggaaatgggattccgacgttggaggtggggtctggtgggaggtggctggatcgtggggacagatctgtcatgaatggtctagcaccatcccctcggtgataagtgagttcttgcttggtgagttcccgtgagatctggttgtttaaaagtttgggacttgccccgactccttgctcctgccctcgccacatgaccccgtctgctctccctgtgccttccaccacgagtggaagcttcctgaggcctcaccagaagctgaataggtgcaaaggccatgcttgtatggcccgcagaacgacgagtcagttaaaactcttttctttgtcaattatccagcgccaggtatttctttttagcaacacaagaacagcctgatacagtctaatttcattctaacttacatcatcacaagtactattcttgtctcccatattagattttgatgggcaactataaagcagctgtcaaaaagaaattaatagaaagttgttacctaggatgaaggtgaaaagcagattctgcttaatgatgattagactgtatgctttttggttgtttttggacgctggtcatagaaacagagaaccaaagtggaacacattcagaagtgaaccctcagtcgtcaagggatctaaaatcacctcactttagtgattgaaaacatttgaaatatttagacaaagaaaagaaatctgaggaggaacacaataattatttttaaacttttgaaggttagaataggctgtttttttttttttttaacaggttcccaaagacagaattataactcatatatggcagctgcaagaggcagatttctgtgctacttgaaaaagtaactcttttgcagttagtactcttttaaaaccttaggggtcacagtggattcttcccttttgtttactctcattaaacacagcagcaaattctgtcagacccatttccagaatctctctttttctttctcttgtgtcacccttgtccaaatctaccatcatcggacatggatgacagaagagtgtccttactaaatgtgcccctgcaatccattgcctgcacagttgttagaggatcttaacatgtaaacctgagcatgtcactcacccactgacaactccccactgcacttacaaaagcccttcctcatctgagctggtctagtctgaccttttcccatcaccctccatctcctccaactctgctccatccacactgaccttctttcggagtctcatctgcttcaggcatttcctcacctgaggacatttgcatatgccattccctctgtttggatcctcttcctggagaatgtcacttgctggtttcctctgtcagtcagatctcagttcaaaatataagggctcagtgaagtattccagaacaccccccatgcagtgtctcagcttcttcctgctccttatcatcttagaccatttcattttcctcttagctcttgtcactatttgaaagcagcttgtttgtttatttattgcttctttgttgtctgccccacccccctttagcatgtaaatgataaaaagaggaactttcctttcttcaccactggagcctgaaagtgtttgttcttgactaagcagattaataagtgtttgttgactgacaataatccataggctgggagtttcacagagtgaaagttaggcttagaaaggttaagtaacttgtccaattaataagtatttgagttgggtttgaaatccaagtttcagccaggcaggatagctcatgcctacaatcccagcactttgggaggccaaaaacaaaattagctgggcatggtggtgcatacctgtagtcctagctacttaggagcttaagtgggagatctttactgcccaggagttcgcagcttcaatgagctatgttcgcaccactacactccagcctgggtgacagagccagaccctgtttctaaaataaataaataaataaataaataaataaataaataaataaatgaaatccaagtttcttttgagtacgaattttatgctttatcatgttgccccaaaagtcctgtcttagaaagtcctgacatataaactagaactatggacatttggcttactggagtcaaaagacaaaattacaacaaattttatttaaagatctaattgccttttatttgccactattaccatgtcaaccctgtttctactactctcaccaatactttcaacatgaaactagaaatttaggttaagtcagaccaagaaccttcaaagccccaagtaaggaaaccatacttaatttctgttaaccaaaaataaggactgcaagatcttatcttacatcaactgaatgcaaatcaatcactttaattgagctaactccttcctagattggtgggatccaaccccacgaaaatttagccaacagctaaataccctagtcaactggcttcagtctacttaacgattccattctagaatcaagcagcacctcagttgctttttagacagaaaagggctgaagaaagtagaaacaaggaacaagaagcaaattggccttttcaaagttcccttccttaaagggttaaaaaacatcgtgccaaactaggccccttttaatggattgccatgaatctcctgttttcttggataaggcccatttcagagttctgcttgattatgtggcacttagcatgaatgacttcattctggcctggtctgctggggcctagtgcaggaggctagatcaaaacaatggcctcccataaaactttgttgggtggggatctgtctgacattttacaactcaggtgcaaaattatttttgtgtttcagcaattctttaaaaacacacagaggcactaaagtttagcagaattcaaatatgcaagaatttttaatattaaacagaacaagggatatgcatatttaaaatgcaacaaagtcaagagagtactttgtttataaggcagattttcagtgcatttccaagttggtaaacacattgctgtcaatgtaaagatcaattatagtcatatttatataacattttatgatttgtaaattgctctcaagtacagtagctcaactcatctagcatcaaaaatacttcattctttttcttagttgtacatggaatacaaaaggtagtaaaaatcagcagaagcactctctaagtcagtgtttgctttgctgagagcagcaagcatttactgagtgttggaaaatctagtgaaatctatgatgtggacataattcttagctccattttatagatggggaaatgacgttatcagggtttggcagctttctgaaggtcacacaggtaggcagggcctgagccaggatctgaatcccttctgcactgacgtgctagcggcattaacctctcctatcacaaatctctgctctgctatcacaaatcagtttaagcagatgtgttacctgttttataccgtgtgcattgtggatcaaggtggtaatttaagctatacatgagacaaatatatagagttttcaaataaagtaaaaagaaggtgaggagctagtgaactgagttataagggttttgggaaagtcctttatagaaaaagaatacttcctatcatctattgcttttcctcctttcccttgattgctccagaagtttgctgtaactttatctattgccattaatgttttgaggctatgatcctctgtgagtttactatgtcatgtcgaatttttctgataaaacttcagaagtttttaaaactgaagccacgatcaattgtgaatataccatgtatatcatgttagatttttctgataaaatgttttaaacttttaaaggctaaagtgcttttgaatgtctttttatatgtagaaattactgatatttacctccattgttacgctgtcttctaagatgtaggacttgaaattgataagaagatacaagcttttaagtgatcataaatgcaaattccccagcaaagtcattacatgcagggggcctaactggaatgtaaggtataaacatctttatcatcctctgccctcaatgagctaaattaagggtgatggtgggagcaagtaaggatggagagctctgcagtaaatgtacaccatggtgttcacagagatttgagaaacgttcagggcattaaggctatgcgaatttttttaatgcacttggtcaattgctgttcctcagttgattcgtttatttgaagtaaaatagcacatggtagaagtataggactttgagaaaaagtatccaagaattacttccatattattcctcttaaaaaagaattttgttccatgtgtttcataatcttcaaatgatttgggggaattaatgctgggtactttgttggcaacataatctattttccaagtggaaattccataaaatatcttttacaaatgttttgaataataaacatcaatttacaagccaacttgtcccaaaaaattgtacatgtagaaaatattaactctttcagaagagaaattcagtctctattaaataaacattatatctattttaatctatctaaggtgttgtggttgattttagaaggagcttgacatcatatatccctgtgatcacagtttttaaaaactcaattattactaaaaaaattaaatctgagtaagttataaaataggacaatatcatacaatttttcacatatttattaactcaactgatttataatgattcctcattatctgaaatgcattattctaattttgggggaaatgcaatatgtcaaaccatgttttctaccctcgattaatttccagtatattaggggtagatataacatgtacagaaataacaaagcagaataaaagtaagtcccctacctgttataaaattctagagcctgaccttgtctatagcacagtaggtactcaatgtatatttatcacatgaataaaataaatgaatacaaataaatgggtgagtatctcattcttctctttggctgcataacatcccatttcatgactattaaaatagatttaacctcactattggatatttatgttgttttcaatcattttgcacatgtgaataaggtaaatacctaggaatagactttttgggttatttcacttctgacggatgctgccctctgtagagattgttcaatttacactccaccagcaatgtaggagaatgtctttcttcttcagtgcgttagatttttgccaaccttgtaagtaaaaatatttttgtagttttaatgtgtgtttctcttttttatgagtgaggaaaaaaacattaaatgattgatatttccttttctgtgaactgtcacttcttgtgctttccttatttctcctaataggtttttttcttaataatttgtgtaaccatttttaagaaaatgatctctttgcctataagtaacaatttttttctctttttttcttttctgatttttttttttttgagacagagtcttgctctgtcgcccagggtggagtgcagtggcatgaacatggctggctacagccccgactcccctgggttcaagtaatcctcccatctcagtctcccgagtagctgggactataggcacgtgctgccacacccggctaatttttgtatttttttgtataaagagtttttaccatgttacccagggtggtctcaaatttctgggctcaatcaatccacccgccttgacctccctaattgttgggattacaggtatgaaccaccgtgcccaccatattttttttcttgccatttgtcatttgaacttttatttattttttggcatgcaatatttttaaattttcttttaggcttttaaggttttctttcatcttcggaatagcccttatcagtctaagatgttttttgaattctcatggagaattttcatagttttggtttgtctctttgtgttttgggagttgctgtttaaaattgtgagctatctgggatacatttagttgtgaggtataaggtgtggaaccaactttattttttccagatgactaatcaagtgtgccaatactagttcttcaataacccataaaaattacgtgcattattcaatgtaaggattaattgaggattcactcagtataatttgagtgccaaacaggaaagatgaatttaatatatttgatgttcttcctgtttatgtatactggtgcttcagtacagatttattctgggtcctttgacatgatacaggaaatgtgccattctctgtccctgccattccactttcctgtgctccacctgggctatacagtagaacttgacaaccaaccaggttttctaattaatgcttacactttctgttgcctttcccccctacctgtcagtttatctagctaagcatttttctccatggcacctatcactgcattgtttgtattctcagagattttggtctggcagataccatcagtaattccatctaattaaaatttttttatataataagcaatatttaataataataattagaaatagattttgattacatcttaaaatcactgcaaagacttgtcatatccagagaacttccgaggtttataagcctaattagacagttgcctaaaaataaaaaaaattgtgaataaagatagcctattttagagaactgttatctctaggcagagctctacaaaagataaatgcattgataacaacccatcctctctcttattagttttttaagggatccatgtacttacttgctgacagtgtatccttaacaaggtgtatctcaattgcgttccaacttagaagtgaactaggaacaagtattttaaaaaatattttaaactttaaagtgaccctttgtattaaagtacatagttggagttaatgctataggccagaagaatggctaactgtagtaaatttattagctcttccttattgagagacagatggggcagagaataactgctaatcccaagaatacattctagttcacattttgacattttatatatatatatatatatatatataatatatataatatatatatatatatataatatatataatatatatatatatatataatatatatatataccagaatttttctagcttagtaaaagtaagctaactttggattgtgtttttgattgcatttgaaaaatattgttctatttattaatgtccttgtaagtgaaatgataaattaatgttttcattttttagacataattttcttttttgttttttctgctttaatttttaaacaatggacagctaaattggcattgttaattttggttttggattagtatttatactatttggacagtgcagtgaatttatttccgaccatatctttagaaatacttgtgtttttacaattgtttgaaaaaactttgtctacaaagcagactgattttgactcaaaaaatctttttctcaattgcatagttaattttctattattgcctaaaaattgtcatttagctctgttcaaagtttacctacagttgtggaaagtagtatattttaccttgctaattttcattgtacagttcatgtgaagacaggagactagataatatcaatcgaaatgggatggtttgagggaaacaaaaaaacctttcaacagagtttgggatcgtggagtctccccagcctggtttgtccatggtgctggctatagaagaatgtgttccatcagcagcttacaagagattctggaggtggatgagatttccctgaagtcactaataaaaaggctgcattgttaataacagaggtgctgccattgaactaaattttcactggtgtcattagaaaaatattcattgagcacttctttgtgtaagtcatagtcatagcagcaacacttatttgatggtcaatttcacctaatgtacctgattcctaaagggcagataaatcccaatctcctccccaatttgtttaaatgtcagtggaaacttgtttgtaacatgttttgagaaacattttattttcgttgcttagaaaataacatagaagcagtattgtcttctgtttgatttttgaatgtttagagcaaacccagtttatgtgtgaagcagccagaaaaggatgaaaatcttgccaggatttgatcatggtgcaggattaagtatttataaaactatgtgctgtttggcagagttgaggccatctgtccttcagatgagacagaagtgcagttgcactgctgtgtgtgaaagacataaacagagatattgcatgctttgggaaagggaagcgtatcatgaatattaggaaaacatttactaaggaaatttaagcagtggtgaaattgattgtttaaggttgccttatagctgttattatttctataaaacttcagagtgagtttttgtctacattagtacatgtttttggtgtggctagtgaaaattatctattttctttcttcctttctttttcctttccttttcctctcctctcctccttatccttctcctctcttctttcctctcctcctcctcttcctcctcttcctcctctccctcctctccctcctctccctcctcctcctctcctctcctcctcccctctttcctctccttctcctcttacctctccttctccttctcttctcctttccttctcctctccctctgcctctcctctcctctccttctctttcctcttccccttctccttctcctctccctctcctctcactcttcttttccctctccctctcctctcctcccttctcctctcctctccttctcctctccctctcctctcacctctcctctttcctcctccttcttctcctctcctctcctcctctcactctcatctccctctccctctcctctcccctctcctctttcctctccttctcctttcctctcctcctctccctctcctcctctccttctcctttcctcaccttctcctctccatctcctctccttctcctttcctctccttctcctctccatctcctctccttctcctttcctctcctcctttccttctcctcttcttcacctctccttctcccctcccctcccctcccctcccctctcctctcctcccctctcctctcctcccctctcctctcctcccctctcctctcctcccctcccctctcctctcctcccctcccctctcctctcctcccctcccctctcctctcctctcctctctactctcctctcctctcttcttttctttcctttttagagacagggttttgctgtgttgcctaggctagatgcagtggctattcgcatcacagtgtactacaacctcaaactcctggactcaagtgatccacctgactcagcctcctgaatagctgaggctaccattgcatccagcaaattgtctattttcaaacaagtttttgagtatctttaagcttcagagaatttccaccagctggtaatattatctactatttgctttcctttcattatatgaagcaagccagattatctatctatctgtctgtctgtctgtctatctatctatctatctatctatctatctatctatctatctatcatctgtctatctattcatccaatttttttttatcccttccttcctattttcattcatttaaagtaagccttctggggactatcattataattttaaatatgatctttatagttctgctataaccatttaggacaaaaaatgtagcactatgatattaaaacttttccaagtagaagagaatttcctaaccatggaaatagctgatggatcttttttcatttgtttctaacttaattttcttcttcagattcatacttagttgccatagtttctcatatccatgtggacatgtaaaaattatttgctctttttttagagtaattttttcatagggggttcattgaagaatttctgagcctttacgtattttgaaatgtttttgtttgggaattacatttgatttttagtttagatggacataaagtccgtgtttcaaaatttttcatctataaaggtattggatcttttagcattcaatgctgatgatgataagtctgatgctagtcagactctttttaggaatcatcttttctctctggaagtacttgatattttctccatactattgacatttgtatatttttctacggctggccataaattagcataactgtgtagcttaaaacaacagaaattttagtgtctcacaatttggagactaggagtctggaatcaagggttcatcagtaccatgctctctctgaaggctccagggaagaattcgttccatgcctttctcttagcttctgaggtttgctgacaatctttggcattctttggcttgcagctgcataaatccattctcttcctccatcttcacatcgtgtgtgtccctcaggtatttctctgtgtctctccttcccttcttataaggacaccagttgaattggattggggcccaccatgattcagtatgacctcaacttaacgtgattacatctgcaaagaccgtatttccaaataaggtcacattcagggggagtgatgattaatacttcaacatatactttttggggatgcagttcaacccaaaacagcattctaaaattctaccagaatacggccaatatgcttacttaatcctgtttaacatattgtggacctttttaatttggagatgtacatgtgtcttaagctcaaggaagttgtcttatattgttttcttaataatttcttctctcacattgtatctgctatttctttctggaacttatatttgttagatatttaaattcctgggtttaccctctttatttcacagtctctctgttttattctgctttttgatcttttatgcttaatttttagaagattccttgacttcctttccagattaccaattgtgtttctatcagttatttttcagccaatttttcacatgtttatgtatgcaaggacattttaatttctaagatgtcattcttctttctgattttctaattttttggatgcagtatatactcaaattctctgaggacaataattaggattatttaaatatttcttgcttttccttgagtcatccctgttttcactaggattggttattcttaatggtattggttttccttgtgatcctaggtggtgtgttcgtaattaggaaagtccgtaatgactggcataggtttccactgcagttttaaaggcctgtttccttcctagaattcttgtataaatgacagggctgacctggaattctgtatgagaggccaaaggctgaccaaatgatactcaggctttcctttaggctgtgtttgtgtttgtgtgcgtgcatgcatatgtgcatgtgtgtgtatagcagaggcagactgggaacaccagtaaatgttaagtaaggagggctttgcgcaggagttggagaatttaatatatttcctctctctgctggtgctgcctcttctctctccccacattctatcttttttttttttagatggagtctagttctctcaccaggctgcagtgcagtggtgtgcaacctctgcctactgggttcaagcgattctcctgcctcagcttcctgagtagctgggattacaggcatgcaccaccacacccagctagttttcgtatttttagtagagatggggtttcaccatgttggccaggatggtctcgatctcctgaccttgtgatccgcctgcctcggcctcccaaagtgctgggattacaggcgtgagccaacacacccagcccacgttttacctcttacttgatggtctctgccattacttcaagctccattttgcttctctatcaagttctaacacctgcatttggcattctgtccagtcaggtattctactttcttgagagaacatttcttcatttctctgactttgtcctccaggtaaaaactgcttctgccaactgctatgtctatgctaatcagagggaggagggccttagcttcccagctcttcagctgttattattttttttaatccgttgtcattgatttaatttggataaaatatagaaaaatatatcctttgtatcttacctttgtcttttttttttgctatacaagtttttcttcatgttttgtgttatttctttttttttttaattatactttaagttctagggtacatgtgcacaacgtgcaggtttgttacatatgtatacatgtgccatgttggtgtgctgcacccattaacttgtcatttacattaggtatatctcctaatgctatccctcccccccttcccccacccctcaacaggccctggtgtgtgatgttccccttcctgtgtccaagtgttctcattgttcagctgttattctttaatgagttgccccatatccctgctgcactttgttttggttgactgcacacctgggaagaccttttctaactctaatctcttgtggggcagtttcttctcttctttcgctgatggactaatcccatcttcattttgccttgcaaaaatgcttcaacattactgctttctttgtgacaagcattctcaattttcagtattgttgtgatgtaaacttgttaaaatataaatttcagcagatcttgggaagagagcagatctcgggaagagtgccctcttccaatgcagatgttttacactcttcaacttgttatttctattctcagatgtttcatcacatacaattttgtgtgcacacaaacactacttaaattaatgaatggagtggaagaattatatcgtgtgttttatgtctgctttcttatttatgttggcatctgggaaggtacaaatatgctggttgttatacagtgtgtttctgtattgatgctgtataaagtacatttcaagcatgaatcattaagaaatcaaataagttcttgaatgtttcatgaacccactttactaattggtcttaagaattgaaatacattcaggttagaagcttttacagttatataaaacaagttaatggcagagtttaaagatttaatattttttcttttatgtttataagattgtatggataatatgtaagaaactttagtcaaattaagagggaaatattttaaatctttctttttcagcaaaaaatcgtggaattgccattccagtggatttggacagccaagttaatactcttttcatgaagagccattcaaatatggtgcagagagcagcaatgggttggagactatcagctcgctctgggccacgctttaaggaagctcttggagggcctgcttgggattacagaaatattattgaaaagttacaggtacatgaaagcgtgaaatagcattaatattttctaaattatattttttaaaaatatgtagtcacataaataaaatatggtttaaaatatcaagttctatttggggaccaggccttgctttacaactctctactaccactgctctttttaaacatatagcttccatatgtcgtgagttattttttaatgagtgtatattaataactctgttttgatagtatagtagtgaatagtgggtcttaatatcaaaataatgatcataatagcaatgataacactggtaaatcaactaaatattcataatcttgcttcaacttatgttttagtattcccttctaatcctttggtcagaatgatccaagcaccttgctcccaaattacttgtatagtatctcactcctgatttaggcctggaaattgtattagtttgccagggctgctgttgcagaatgtcacagacttggtggcttaaacaacagaaatttattttctcatagttttggaggctagaagtccaagatcaaggtatcagcaggtatgctttctcctgaggcttctctcctgggcttgcacatggtggacttcctgctgtgtcctcataggctctttcctctgtgtttgcacatgtctgtgtcctaatcccttcttcttataaggataccagttatgttggattagggcccgctcatatgaactcattttatcttaattacacttttgaaagccctagctctaaagacagtcacattctgaggtactgtgagttaggccttcaacatatgaaatttgggggagttctaattcagcccataatagacatcttcccattcacataattagtagaatattgcatggagttgaattggggtatagtttgaagaagttttttttctacaaaatggccaagacattaactgaaataaatattatgagaggtaacatgtagatgagtgttatacgggattagaaggacaagttagattcagagagtatgagaaacctaaatggtgtgagacattaaaaatttgggggaaaatgccattataagtggttcttgatttgtaggatagggttatctaaaagagactagaggaagagggactagtgagaagttacttaaggtctaagccaggtggtgatatggatgaaatgaagaaataggtgttgcagataataatgaaggcagggtcagcagacctggggctcttaggtggaagtagagacagggcatgagaggagtttaagaggccccgatgattagagactaggtagtatcattaagactgtttattttaagagcagaggagaagagaatgcaataggagggcaatggaaaatacagtgaactagggtagcaggctactgagtatattggaagttaagtctatatttgaagataatagttggagcaaggatagtggttggtattgctaaaagagaaaatacagtgataggagaaaaaaaaagaacgccctatgagaggctaagggtagcagaatggccacataaagagtgcaagaaaaaaaagtgggtcagaaaggaggaggatcaggagagcaaagggagtggaacatttcagaggagaggtatatagtagtgccaaccagcacagagagggtgtgccttaaacttcttttagtaaacttcttttaatagattgatatccattaagtaagtatttatttagtgaaaattctatgctagccactgtgtgaagtgctaaagagagagccatggggtctatgctcttctgggacatgcattctaactcattaaataaatgataaattgttggataattaaaactgcaatgtaaaaaatagaacagagtaacagcatggtggagaattactgggagggtggccctgtaattgtgaagttcctctctgccagagtaacagttgtgttgagatatgaataatgaagatgaataatctattccaagatttaggttcagatagttttatgggaaggaaataggaaatgcaaaggtgcttagacaggaggttgatgggtttgaagatccaagaaaagcccactggggcaggagtttagtgagtaaaggaagaaaatattatgagataaggggccaaatcatgtagagacttacatggtgctatggctgtgccctgagtgtttgtgtcctcccccaccccaaattcatatgctgaaattctaacccccaaggggatagtattaggaggtgatgtcttctgggagttgcgattagagtccctataaaataggcccgtgcaagctcattcagcccttctaccatgtgaggacacagcaagagaagtaccctctatgaaccaggaagtgcatcctcaccagacaacaaatctgctggtgcctgatcttggactttgcagcctccagaactatgagaaataatttctgttgttcataagctactcagtttaagctattttgttatagcagcctgaacagattaaggcacatattaaggcattttaattgtattctatgtgtgatgacaactcattgaagattttcagcagaggagaggctgacctggtttactttttaaaagatcactgtgaattctgagtgtattataagatccagacatggaagcagtgaatctagttaggtagctttgcattaattcaggcaaaaggtgatggtagcttggcttaaggaggtaacaatagtaatgcagagaagtgtattaattttgtatgtatttagttgtagaactaatagaacttggtggatgaatcgatgtgttgtaggataatggaaagaagaatcaaggatgactctggttttgatatgattgtgttatttactaagataggaagtaatgggagagaaagaagttgaggctgagttgaaattaggagttctatttggggaattttaaagttgagatgcctatttagatacctaagtgagtgtgtcaactaggctgttagataagtgagtctgaagtggtttagaaagatgtccatgctggaaatataaatgtgggagttccaacatacagatgttattaaaaccatagaattggatgagatttctcggaagaaaatgtagatagcaaagagaaaaggagcaggagctatcaagagttgatgaagaaatagtaaggacgtaggtggaaaataaagtgtgatgtcatagaagtcaagagcagaaagtgtttcaaagagcagaaaccagtgtgtaaaatggttaggagtgattaagatgaagacaggcaagtaaaccactgagtttgggtgatgatcacagctaactggtgctcaataataaagattactagcatttatatggaataagtggcctgtatgtgttagaggatgttctatgcacttacctttaatccttgcagcaaactcacgtgattgttagtatcattatcctaagctttcaagtggggaaacaatgacttagggaggttgcatagttgcctcatgaccaaaataagagttaaagacagaattcacatcacagcagcctgagtgctatttgtttaatagatgaaacaaagaagaggtaatctaaacaacagggacatttaattaaatattgtcatatttgataaacatgctctccccacttttatataatatctagttttcccctttatgctagttcccattagtctcttttaattgttttcagacatttctcagaaagcttatttagagtggttgaagtagaaatgatcactttttcagaaagagaaagaattaaaacatgaattaacataatttataagaaatcaagagggtgacatccccatctgtgcttctgtagctaagagtgacaataagcaattggcaatgttctgcttgataaaaatatgccatagctatgggtgaataaattgttcctttatgtaagaagttagtttttttttcttctaatgtagtttaaaaataaaatgggggtgctttaaccattaaagaatgtttaggaaattatgattacctgcagttcattttagaaacatatcagttaagatgctttcagctttaaataacacaacattcaactaaaagtgacttaaataataaagaccatatcatttcacatagcaagaaacctggagctgtggctttccttgagtttgctaattgtaggcctgggcccctaaaaccaaaggtctgtaggcattcagcttgatgctggtctcccagggtcacacgagggctgtctcagatttcggattcacaccctcaagctgccttgagagcagtaggtggttttgaaagaacctccccacacaccacatgtaccctgctctctcagctgacttcacctgatgtctcattgactgggactgtgtcgcataatcatacctggacagattgctacaggcggaaatgggataaccatgcctctgcttagagtaatcaatcttgaccctaagctgagggggctcatcccctgagaatgttgtggcctgactcagaaatgacattgagattctgttagcaaggaagagagtgaagaaaggctgttgggtaggtgaccaatagggtctctcaaaaaatataatttgaaattctgttgaatgtcactgaacccatgtatagtactaatattgcttcaaataatatttcagtgactttccccattggatgaaatgattcattctgaatgaccaatgacacatgggaattttttttttttcaatttgagacagggtttcgctctgtcacccaggctggagtgcaatggtgctatattgcgtcactgcaacctccgcctcccaggctcaggtgattctcccacctcagcctcctgagtagctgggaccacacgcgcatgccaccatgcctggctgatttttgtatttttagtagagacatggtttcaccatgttgaccaggctggtccccaaatcctggcctcatgcaatccacctgccttggcctcccaaagtgctgggattacatgcgtgaggcaccgcacctggctggaattttttttttttttttttttaagctgttccctgggtattcccctaatttattgcaaagtaatgagtacctctcatgtctccattataatcctaggcactgcagggcacatacagtggcttaactgacttttcctctataggtgtatatccttagaagtcttatagctacctgtccgtcccttatcttataaacaaaaacacacacacacacacacacacacacacaaaaaaaaaaatagagacccaggcaatattcttacataaaaccagactataattatggcacagacatttgctgctatggaaatagaggggcatctataaaattcccattagtattcttgagcttgtcttatcttcgaaagatgaaatctgacttacgccttcatgtgggttctcttgtgtttcattccctaggatgtagtggcctccttggagcaccagttcagcccaatgatgcaggctgaattctcagtgttggttgatgtattgtacagtccagaactgctgttccctgagggaagcgatgcaagaataagatgtggcgctttcatgtcgaagtaagtggatccaatctgagattctgctagtgtcgtcaaactgacatggcctctaacatttccgctttatacttcactgatataaaatgacagtccgcaaagtatgcgaaaggtctaaaatccatgttaaaatatactgccagaataattaaattgattcatttgaaattttattttggtgaaggtcaagttatcatattttactaaatttactgaaaataaagtgtgtcattatggggcacaaagtatcatgcaaaataatattttggtcctaattcctttccataattatatggtgtgacctttaaaaaaattcttgtttaaagtcacttattttcattaacatagggagaaaggaaaaagagctagcttttattgaggtcttactattgtcatatgtgtttaactattattttatctaatctgcataaacacccagagactgggaggtcagcctgattcagagaggagattgctgaggaccacgtgtgcttcaggtgcagggttagtaagactcagaccccgcacatggccatgctgcctggatgatcctcatctgccgctcttccgtttactgatgtttcttagcgtttgtggtattgcagatctattatagctgatatgtttaccctagagtatcttcatcttaatgataagtgaaaaattctcaagggagatgtgcaaggataagcagttgtgagaaaaagcataactagttccagaaagaagagacttgtctttatgtggagggcacgttattgagggggatccgcaggtcgtcacatgtagaccctagatggccagtcagaaagagggtgcttggtcttcctgggaagagtatctggatggagagtcagtgagatgagcttgccaagccccttgaccatgactcatcccagctaattcctgtgtggtagagggtattaccaaaatagatctggaaacctcttctatcaactgtgatatatcgaggcagagattaaaggactagggcacacaagaagtgtgttcctttctttcaccatttaagctggaaccttgggagtgaaaacaaggtatgggatgagaaaaactgactacagggatcatgttgaagaataggtggggtttttatactatggccagaatcaggtatttttggctttagactcattgcgtcttagggagattgggaagagtgtatttgtccagacacctgccagtcttgtgagtaaggattttaaagtgaagaggccctgagtgtacaactgatgactgctgagaacagtagaaagaaaattttaagtggaggtattgcctagtaattcactataaaaatagggtgttgagcgcagttcattattcagatgatgggtacgttgaaagcccagacttcaccactgcacatacatgcatgtgagaactctgcacctgtacccattacagatctaaacataagaactaaatgaaaaaaaaaagcaaagataataggatctttgataaatacccttcatctcctataaatatatgtcagtgtatggaatatgggttaaaagttaggcgataaacctgttaaattcagtaaattaacataatacaatagctatatccccgagatgtgacagcctggaacgggttggcaagctctggccctcaggctaaattggtcctgctactcatttctgtaaataaagttttactgaaatacagtagtgctcattcatttctggattgtctgtggctgctttcatgccactgtggcagaatcagttagttgccacagagactgtgtaccccacaaagcctaaaatatttactgtctgatcctttagagaaaaggtttcctgactccttgtcgagaactagggtgccagtatggtagctactagccacacatggttatttaaattatagtttaaatgaattaaaatgaaataaaaatccacttcctcagtcatatctgcaacatttcaagtgctcagtagccacatgtggctaatggctaccaaatttggcagcacaaatatggaacacgtgtatttttgcagagagttctgttagacagcactggtctagaacttggagatactggtctatgagaaagtgttatgaagtaactcatgatatcaagcaaatattgagctgtgctgcagatggagacaagcctgtggcatcattaggtaacctgaaaggagagaagcagaagtgatgtgataataggaatacattgcagatcccacacgcacatgaagtaaaatgatgttgtgtttacatgagtagttctagaagggatttttgtgctattgcaattatattacagccagagcctcaggattgtctgttttctgccttactgctcaccctaccacttccccaactctgtgaagaactaagggtttcctttgtaagaatatcttacaaaattaaaatccaactttatgaatagctttgccaggggtctttttttttgagacggagtcttgctctgtcacccaggctggagtgcagtggcgcaatcttggctcactgcaagctctgcctccctggttcacgccattatcctgcctcagcctcccgagtagctgggactagaggcaaccgccaccaagcccagctaattttttctgttttttaagagacagggtttcaccgtgttagccaggatggtctcaatctcctgacctcatgatccacccacatcggcctcccaaagtgctgggattacaggcgtgagctaccatgcctggctgccaggggtcttgtattgctgtgcataccatcctggtaaagcttagctggagaatataaatttagggccaagccctaagtagggcttcctgctttctcaaataaatctaattcttggaatctgttgactcagatgagtctgcaggagaatatgaggatagaccccaggacaggagtctacttaacacatagagtgaaagagaagagaataggtcaatgatactgttaacctttaaggcggctgattagagtccattcaaatcaacacctacttctcccttgtgaaggagaatctcagtgtttttcaaaccgtggggtgtgatccatttatagatttttaaactgacttaggtagacgcaaccagctaatttaaaaaatgaattagagaagatacaaattatcagagtgcatctcatagtgagggtgacatttgtgtgagtttatacacacactcccacacaggtacttctttactgggttgttttgtgaaatatatttcttactttgatcatagaaaaatatttgaaagtcaccgacctaactcaaccaaacattatgtggcctttgaataccttttataaatctgtagcaagtggtcattcaaccttatggttgatattttcaatatggtttatctaaggaagagttaaagaaaatggaaatacttagcctgagagagcgaaaaacaaaatcaaaagaaatttatcatgtccaccaaaacgattttcccatatttaaagactattatgtgaatgtatatgcctactatgtatccacaaaaattaaaaattaaaaaaaaagtgttgcgtgaaagaaagaatcgaatagtagaagttttagaaaggcaggcttcactttccttgccaggagaacttttgaaattcttctgcctgctaggcctgaccgcatggatataacaccttttctagactcaacatgtctaaaaggacatcagtgttactttcattgtgtgtttgctacttcttcaccatgtaacagtgtcattttaaactgtcaccattgagctgggtgtgatggctcacacttctaatcccagcactttgggaggctgaagcagggggatcccttgagtttgaaaccagcctgggccacaaagcaagaccctatctctgcaaaaagtaaaaaaatttagccaggcatggtggcatatacctgtggtcccagctactcaggaggctgaggtgggaggatagcttgagcccaggaggtctaggctgcaatgagctatgatcacatcaccgcactccagcctgggtgacagagaccctgtctcattaaataaattaaaaaaaaactgatcaccatccacacattagcctagtctatacatttcaggggtctctaatctgccctgcttcctcttccacttcccacatgtcatcatttacaagtctctgctgtgggtcttctctgttgcttcgtacgtcctcacccaacctctgccactgctcactcgccttgctccgtctcctctgcttcatctttcccgctgccatcattggtctctttctcacaatgggaagaggcattcaggtgctttagaacagtggttccctattttctctagaaaacattccagactcttgaggttaatattccagtcccttctttccaaaccacatctcttacactttcctcttccaggtctttaagtgtcagcgggcagttgtcatgcttctcatttcctggacatgccggccaggtttctgcctctgtcctgtgttcataccattccctttgcagggatgtcttctctcccgagccttccttgccaggtgaaatcttcattagtagcatgctatctcttcactgaaaccttctctgatcagccctaggtaattccccccagcagaatgaagtggtttcatgtctggttcacagcatttgccaatgcctctgttgtggcacttgctcattcagggggctgtgtgcagcctagcatgtgtggggactctgcacaagacccctgagactcaggagatcagtgacctgagtcctgtcaccacagagtcgttcttaagaattttcgctctgaggtcagatggacctgaatgcatttgcaggtctcaccacttaacaatttaggtaaccagaggcaagttgccctatctccctgggcctctgttctgtcatgagcaaaattagtctgaacctgtctcataggcttggtgtgagggtaaattgggagtccctgggaagcccttacacttgaccctgacacctgataagcacttggtagccattaaccagtgaaagttcactttttccccagggttatatcccacagtactcatgttatgtcactgaaattggatcatttaaggaagacatcttacagggtcattttgaggatcagctttttaacaacatgagctatataggcgatatatatagctatataagctaaattctgttaatgaacattttatttgattttaagttcttggggatggtgatcttgaaactcttctcctaacggagcaccagtgcacagtgtaccacttgatgaaaattgattggagtttttgcccaaattatacccaaactagtaaatggttagactgtcttgatgtcacttttgttttgttttgttttttgctcttaatacaaaaactgcttgttcctaccaaaccctggcagtgaaaaatatcatattattatgaatggaaactggaaagcagcctgttatattaaggttgcagagttgtatacagccactgctactgtatgcttaatgtaatacagtatataaaaataatatagtataacataataaaatgtaatataatataaatatttgtatttctctaataaatttgttttagttcatatattggggtgagaatattagtatttcattgtttctcagagtattgtatcccactaaaagaatgccacctgagtaagtttgagaagccctgagatattttgttgtaagacaaaaataatgtgttgtactacaaaatttataagctgaagtgtgatcttaaaacttttgaaaacatgtacctggtttgcttcatattctcaaataattgtgtaaattttttcccctatggcctttgatgtttgtatatagcttgaagagaaatcactgtctttctaaaggtctcatgttttgctttaaggttgattaatcatacaaagaaactaatggagaaagaagaaaaactgtgcattaaaattcttcagacattacgagaaatgttagagaagaaagacagctttgtggaagaggtatttttttaaaaaactttattatttaaaaataaagtaggatttccccaatactgtaacctatgaattacaataggctattacgtgattacttgcattatatcttaatgatgcatgtacttagatgaattatataatttgagtttttatgatattcatctctcatgccttgttttaaactgggaaataactaaaattagagtttcctagatatttgttttattatattcttatattatattcttggatctgtgttttttcctcttatggctttagtggaccaaatgacctttttaaacaatgagtaactgagatgcattatttagattttgtgtaaagttctgccacatactgagaatgtctatgcattttggcatatgttgatttttttattataaatatatattcatgttattttttataatattctgccaagttttataaaataatactattttagtaagtggaatagtcagtttctattcttaactatattaacttgagattcacaagtgattttcagggaaatatcaacctatagataataattgtcagtctgttattaaaaatgacagctcaggtgctcattaagagatagctagcagcatgtttgatacccaaggtgatacacttaaatataaagtataaatctagagaattttttttagctagctgtctgtacttttatgttagatattaaacaaaatttgtaccatgttcctcaataactttttggtctgtttcggtaaatactaatcatctgatattttaaaactggaaggattttatatattactttatgtatatgctaaattccagaaagattgtagtggttgggttttttaaagtgcattcccatcttagaaaaaaatgcaatggaaacttagatattaatagaaagagcattgcttcaaaatattccatgtgaatcaatgtttgtttcagtaatcaaaatgccttctactttgcattagttctctgcatcacttaaattatatttggaaaacaaatgatcaaaataaaggtggtcaatgcaattttagcaaatatttctctaagataggactcaaaaacgtgctttcatatttaaaaaatgataaagagaattccttgggacttttggttgtctttctcttaaaatattgctgtagattgtgggatattgactgaagtaccagattctgaagtagaaaaatgaggtcaatatccttttctggcaaaggacgaggttcacaataaaagtgacttgcacttaacaggaggtacatggcaagtcttccatttttatgtaacagatttttattgaattactccaaaggaaaatcggaaagaaatcaggttaaatttttactttggctagtcaagagtatttttatgtgtctcccaaaccactctaaaataaatcacttgttttctcctttccattcccactgctatcactagttcaggcttttattacctcctgttgagaaaattccaggagtgcagtttcctgagacagaactgctcccttgggtggaggcagggctgctgttttcctaactccaagggtccccatttatgcaagatgtgatgtaaaggacacccccagcacatagccctcacagaagagttgagatgggaaaggctaattgcaagttcttcattcagtcacccaacacatatgttgtcagcaaactattaaatggtgattattgtgcctgggaactggggatactgatatgaatgacacagcttgccaagggccatgaatggatacaattcctgtgctagtggactcccttaatagtgtagggaagagatcactagagcccttcagaaaccatcaggggctctgcacagcgtcagtgttccaggccctccatttgtcctctccacttcacacccccatctgtcttcatccattagcctccggaaatctgtgttactcaatgtacctataatgtacctcaggcttttcctgccctgacctttgcttcatctggaatcatagattgcaaaaatccagtcaagcctcaatgccaccggctatctttgtggaggagctactgggtagtacttatcaattgttccagcaagtggtgattactttctcaatagaattaccaaaatacttcatgcttctcttttaggacactttaggctgtatctggaaatttagtccaagctccttattttatagatgatgccacagagtcccagagaggtgatgtgatttgactgaggttacacagcaagagctagaaccaaagtttaaattggaactccttcctctttgtttaatcttcttactcctttgatcatagccaagttttacaaattttttgcattgctattaagaaaggttagtatactttgtctagcaggtttatggcgccaaattttaagacataggcagacagaatataagacaggaataacatccaaaataggtaaagattcagataaacttctaagaaaatagtaaatatgggggaaatgaagtcatttaactaagaaagaaaaacctgatttcatttttttatggctgaataaaattccattgcacatatattcatcacattttctttacccattcatccgtcaagggacatttgggttgattccatgtctttgctgtggtgaataatgttgcagtaaacatgtgagtgcaggtatccctttgatatgttcatttcttttccttggataaatactcagtagtgggattgctgaatccaatgataattctgtttttcattttttgagaaatctctgtactgtttttcacagtggctctactagtttacattcccaccagtaaggtttgagtttccttttctccacatcctcatcaacgtctgttatttttttgtctttttaataatagccattctggctggggaaagataataccctgttgtcattttgagttgcattgctctgatgataagtgatgttgaggagtttttcatatgcttctcggccatttctctgtcttcctttgagaaatatctagtcatgtcttttgcccactttctaatgaggttatttgcttttgtcctgttgagttgtttgagtttcttgtatattttggttactagtctccagtcagataaataatttgcaaatattttctcccattcaacaggttgtctcttcactctgttgagtgtttcctctgctgtgcagaagctttttagtttaagatagtcccatttgtctatttttgtttctgttgcctgtgcttttcagatcttagccataaattatttgcctagaccaatttccaagagagttttccctaggttttcttccagtatttttatcgtttcaagttttatatttaagtctttaatccattttgagttgatttttgtatatggtgagagatagggatccagtttcttctgcatgtgactgtccaattttcccagtgtcatttattggagagggtgttctttccccagtgtaagttcttatctgctttgttgaagatcagttggctgtaaatatatggctttgttcctgaattcttcattctgttccattggtctgtgtgtctatttttataccaataccgtgctgctttggttagtgtagtgtagccctgcaatatattataagttagataatttgatgcctccagctttgttcttttcactcaggattgctttggctattccaactcttttttggttccatatgaattttaagattcttccaaaagaatatgatatcatgtcatttgcagcaacgtggatgctgcatggaactgaaggtcattatcttaagggaaataagccaggtacaaaaagacaaatactacatgttctcacttatatgtgggagctaacacatttgatcatatgaaggtaagagagtggaaagataggtaacagagactgggaagggtgggagtgggaaaatgaagggaactgggttaaaggccacaaacatacagtatgacagaaggaataaattcaatgtttgatagcagagtagggtgactatacttaacaaaatatgttgtatttgagtgatggacacatcaaatacactgacttgatcactacacatttatatacatgtaacaaaatgtctcatttatcctgtaaatttataagaacaaaaaagaaaaaggaaaagccttataaaaagcatacatatcttatttcttaattttcttgtttcttaattttcatgtttactaaggacagaataaaaaattatagctaaagcaattctagctcttagacaactttttaattctaagtgttttgaaatgagaagtatttctatcagtggaagcagaagacatctcattcccctctcaggaaatcttaaagataagcatattggatctagaaggattcaaacaaccagtttgggaatgagttgggactccatgatctctgtattttgtccattggtccttctgaaacagctggtgctcagtgatccatgccagtggaggggagctaaatggctcacccatttgggtgaaatggccttggatgatagattcaaaaagtagcaaaagatactattgtacaaccaatggtgggctctaataacaagccctaattatcaatagtgggataaggggtggctgtgtttccatgactgtattttttcctactgaccagaaactttgtggtgtgtaaaaccacacaaatttattatcttacagttttgaaagtcaagagcttaaaatcaaggtgtgagcagtagtgtgttccttctgcagactctaggggagagttcatttccttgccttttctggattctggaggccacctgcattccttggctcgtggccccatcccctatctttaaagccggtagtgtagtacctttcaatctccactccctatttcccgccccccttcccacaattgtcacatctcgtcctactctgatgctcctgtctccttcctataagaacacctgtgattacattggaaccacctggataatctggtataattttcccatctcaagagccttaactcaaatcacacctgccgaatcccttttggcatgtgaggtaacatgtttacaggttctggtgactaggaaagggatcatgagggcatgtgcatctttggggagggccattattctgcctatcacaatgacccttttattgacagtgagaaataacatctagaatgtagatgtagtatttacttgtggctgattaatattactgtgtagggcaatttaaatgcaaatgaatagaacaaaaatgcttggaatctatagcactttgctgttttcaaaatattttagaatattttgctacctttcaacaattctaacacatacacagaacaggcagtgttacctccacattgcaaatgtgaaaagagagactcagaaaagtgaattgcgttaagtcacataggttacccaatacctgccctgtaatgcctaaccagctggatttcgactgtgtattgaagcattcccaggagatttatcagaattaaatcaaaacagaaaactcaaaccagggtttttcacacgagctattctaatattacatttgagactccacttatttgaatttaaaatgtcaacttaaaagaaaattactatttttatttccttggttcctgacaccagaagtggtgtatgtgtgtgtgtgtgtgtgtctgtgtgtctctgtgtgtttgtctgtgtgtgtgtgtgtctatgtgtgaaactggtaaaaatttaaaaatagggcaatgaagcataaatttgcttcatggttgaaccaaatgtcctttaaagcaattcccaaccctgggattctaaatttcccgagtttgttagccttctctgtatgatgtattaaggaattacattaaggatatttaatgtaactaaatgtaattagattttacctactggtcaattatttattaaaagcttataatttagaatacccttgagtacaatttctaaattaattatacttagggatattcttccttgacccatgtttcttagtttgtgcctaagacactgagaaataagatacgggtgggcaacatcttaaagattcttgaaagaataaaataaataaaggaaaatttaattttctgtgaagtgtgcctatatgtgaaatcatctagggatcatatagttagttaagctatagtatttatttttaatggaaggataaaatgtgaaaattttttatagaaagtctttaaggggaaaattacctgagttttaaaaaattcccccttaaaatactgtttgtttaggtgactgtgatagaaaagcaagagtttacaaaggatgtaactaacaaccctaacaagtctgagagcttagttttcctttggggttggcatatttagaaggctttttaaacgtaacaacagcaggcatatttatttgtactttaaaaaaatatgtatgttggaacattggggtagggaaagagaagagaaggaatgcttcaaaatggctggagggcagtgtgatttctctttttctttgagacagagtcttgctctgtcacccaggctggagtgcagtgatgctatcttggctcactgcgatctccacctcctgggttcaagtgattctcctgcctcagccttccgagtagctgggattacaggcacctgccacccagctaatttttgtatttttagtagaaacagggtttcaccatcttggtcaggctggtcttgaactcctgacctcaagcaatccacctgcttcagcctcccaaagtgctgtgagctaccgtgcccagcctgagggcaatgtgatttctaaaattctctatccttaaagccattttgttctactcttatttccatgacactctctttctctctccctctctctcctctctctctctctcttcccctgtctctgtcacacacacacacaaacacacacaatatctgatagtatgtgtgtgctgatgaagagaatagctttattaaagtactgtgccttcgttctgtgtatttaaagatactttagaggtccaaatctgtgtagtggtgagttgctaatggagacagaaagagcttacgtggattggatagaggtgggctgatgaggttggagcaggaaataaggactgcactcagaggaatggtttggtttggtttggttttaaggattttgggggtcaatttcccgcatcttgtactctttagtatacattttcatcaagatttatagagcattacaagttatttctctcataaaaagggaaaaacatatataaatcatgaaagtagagatgtctgtcaactccaatcctaagtatataaaattcatagcttctgtactttagaattggagaagagaacgagcattgaaaatattcatggatcgcctgtggaaatggtaatttacagttattctctttacattctagtcaaagaagttgacctatttagaatgacagttacaatttccccatgactatattcctatctgttaatgttacactgacatacatataatctatagggcaacagagatgtttttatagtaaagttcaatattcttaaaatgatcagatttaaaataccatctatccttggaatattgttgcaaaaatattgagagctgcctctgcaatagctatggtacagttttaagcaacggttttaaaaattaatagctagcatttattaagagcttaccgtgtgacattgttattatcagacagtactgtcagacactgttcctaatcacttatatatgttaccttatttattcttcaaccctatgtcatagttttattatctcccttttactggttaggaaactgaggtatagaaagtttttaaggtcacacatcttaggagaaagagacctgggattccaacctaaacagttgcgcttctgagctcacacacttcattggcatgttagatccaaacaggttataggacttataatcacaactcatttattttctcagttacaaaactaaataacatgaaaagttcttcaattttattcttgataaaatttgcctaagtgtgtactggaaagcataatccatttattcagtgagctgcccaggaaaggcttgacacccaccttgtgatcacggtctgagtcgttattaactagaatattagttataaaagttctaaacaatattttgtaagatgactactggagatagccccttgttgaagtgtggctttcaacaaatagcatagcatctaattgagagctgtgatctttacaaatgcccaggttgggtaggtgatatttagacattgaatagtggtagcagacaatggattcttgatttgaaagttgatatccggagtgatatggaataaagatctttaagaaatgatgcctgaattatttttaagatgtcctcttttttttttttaactctaaaatatactgactcctgagttaacaagaaatttattcttatcctcagcaggaaaaaatattgtaactaatcttttatttctaattttgagaagtcacaaaaagaatgtcataattataccaagcaacttaactcctacatcaaatatgcatgtgtcagtcccagcaataattgcattgttgcaaatttgtaaattgtatcaagctcctcttattgtatcaatctgtatagaatcattcacatctatgcatatactcatttcagtttctagcaggcaaatgaatgaatttaaatagaaatgctacatagactgcattgtagcttaaaaattggataataacttttgctgagagaaacacattttagttttattatcagctgtattttataatatttcttattaaatacattttagaggtgagtacatttgttttgtaatataagtgctctaatgttgttttaaatcaaatattagtgatgctgcaactgtgtaccatcttagtcattcccatgtatattgtggttgtgtgcacctgcatgtgttattttattttatttttttgagatggagtttcactcttgtcacccatgctggagtgcaatggcgtgatctcagctcactgcaacctctgcctcccgggttcaagtgattctcctgtctcagcctcccgagtagctgggattacaggcggctgccaccatgtccagctaatttttttttttttttttttttttaagcagagatggggtttcaccatgttgaccaggctggtcttgaactcctgacctaaggtgatccacctgccttggcctcccaaagtgctgggattataggtttgagccaccacgcccagctgtgttatgttttaacacaagtgctatgtcgctaagtggttggaaatatgaaaatgagttgatgtgttcttataataagacatctgctttagtatacattattagcatgctcttccactttggaatttttattttatattttcacttaggcaaaaatactttcaaccattaaagtgggtataaaagcaacagttgcttttagaaatttactcttttcagttgctgggctggtttggtcacttgttagactataaaagtgataaatttactggatgaattatattcattttaacctcattattacaaaaaaattacaaagttcttaactgtgcctcacatttactttactctttcaaaatctcacataatagcactcattgcttcaagggtttttgagatatgctaccactctttagagatctatgactaaaaagtcatattgaaaatattgcctgtactcagaaggtaaccaccattcattgcctctagtaagtataggacatttggtagctaatgattgtaggtgaaaaatggcattgtgattaaaaaacaaacttggatagcattaaaagaaaaaaaaggagaagagaataaggaactaaaaggagaatcactaaaatcaatgtattattaagttatcatgttcatcatttccacctaaatctaaacctaaaaccttttccaggaagtatttcccatttagtttaattccatatcattctaatttgtaatcatttcagcacttatcaaattatatttatcttattagtgtagaccttttcatatcatgccttatgaaggttttctttggtgtatgtactgccattttaaataagttagaaactccttggggatagggctgatgcataatgtaaggggaaagaatgcctaaaaggcctttcagtgctgagaatctaggagggtagagtactggatttctctccagttccagcccaccctccacaaaatggtatactatttgaaagcagagactgttgatcttattcactgaagtatttctatgtctagaattgtgccctgcacttagttgctactcaataaatgtttgcagagggacagattgacacatagtacatgtaaatgttaccagctctctgcaatgcagcacattgaccttccctagtcctatccaagaagtagattctagacatatcatgtcatgttatactttgcatatctctgttacccaggtaacagcaggtttctttgtatttgacatccctgcaaacttgggtgggcagcagagaaccatagcatagagggctgaggaagaagacgtctcgcagaaggcactgggaccaggggactgctgttgtcttttgctcactgtgtggcttagaaagcaaaagaggatcccagacactgtgcacagttatggtgtgagctcagccaagggggattggagcagatgatgaccaaatctgaaggccagccagtggggagggggttccagccatggggcttctgtcccaggaagggcgctcgtcctggatccagtaggaacaagcaagagagccaggctacaaaaagaaaccatgtaggttttcaaaaagaaaaaccatgtagactttgaaccaggaaaaaaaaaaacttactataaaaccaggagaacatggcagcatttgggacttatggggagaggccaaggtccagtcacatgaactgggacactgagttagattaatgagagcaactagctgcagagtccaagtactgttgatctcaagcagcatcaggctctcctgccacaggatgaaattggtgttctgaactgctcaatggtgttacggttgagaggagaaggaatagaaaggctctggataagactgggcctgatacatttcaccttttctatcaaatacactaatttcgggatactgtttgaacaggtcctcacagagaatatttgcaacctggtatatgaggcaccaaaaccacactattattgttgttattatttaactgctattgactaggcatatctagagaagctgtttgcaaggtaacaacgtgtctgtgtctgcttggatcttcacactaactctctgaggaaagaaagtattttaatctccattttatagataaaaagaaaggcacagtaggtaaaatgacctggtaagaatcacaggctgtccgggcgcagtggctcacgcctgtaatcctagcactttgggaggtggaggcaggcagatcacgaggtcaggagttcgagaccagcctggccagcacggtgaaaccccgtatctactaaaaacacaaaaattagcctggcatggtggtgcgcacctgtagtcccagctactctggagggtgaggcagaagaattgcttgtacccagaaggcggaggttgcagtgagctgagatcatgccactgcattccagcctcagcgacagagtgagattctgtctcaaaaaaaaagaaaaaaagaaaaaaagaataaaaaatcacaggctttgtaaatggcagagcaggaatatgaatcaaggttttctgattctgctttctttgatgcttctccacatagtagggaattaaataatgctggtgaaagtaaatgataatttgaatttgatttcagtttttcaagccacttctttcagacttatttcctttgctagttctagcaacctgaaggttaagcaaatctttttttttttcaaaaaggtgtgtttgtgggggatatattcttatctaactttcaggtacatgccccaaataatagtaacagcttaaacttctatggggtttactctgttgttagtttaacaatcataacacattgaagacctgtagcacagaaaggttaagaaacttgcccaagatcacacaacaaaagatgacacaaccaggaggaaaatccagccaatctggccctagagcccatgtttccaatcactacatgatactgtctctcattctatgatgatatcaatttgcaaagctgtaggaatttcacacatggctgccagaggcaactgtttttttacgttaaataacagaagccaacttaagatattttttatgtataatgattttgagtatctaccatttactgatttcttcagagtaggcctggttcctgcatattccatctggtgcttgaacatcttaaacatttttggataaatcttagttgcttaaaacaaaacaacacagaacattatgaatatttgcagattgctcggtgaagttgttaggtctatcttatctcagttatcgctggcttttggctgggtttttaattaaaactcaatatagactatattacttatacagtcatgggatacagaaaacaaatgtgatatgtaaatgagcacagcatggcagcttgataaaatgagtctgtggcacaaaataatttaaatgaggactcatggacaattaaaatctaatcaaatgcttataattaatatcacatagctggaatgatgttgaagatactgactcagagacatgtacttatataactccatcccaggtattgagttgattttattttctctgacagtgccagagtatagtaatcagggaaacattcaccagaaggtaagcaataaccgggcagtaatctcatacttgggtgcacctttgaggatgcttctttaggcttcttgccatctaccaccctggtgtatgcagccatttattcattcaacaaatagactgcagcatatatacaattggcaaagagtcccccatcctcttggctgagttaggcaagacctctggttactaggcccactgcccactctcttgaaataaactgttggtatcaactccaccatgcttggattagttaatgcacaaaatgtacagaccaaacccttcctatcaccaccatgacattgccttgccatttctcaacacttcctctcccgctccagaactgccactcagcaagctctcctctatccttgtcctcttctctaagcggtccctccagcttcttgctttatttgaagactccctggcccccaaggtcagcccactttctgagcagctgtgtgaagtgctgtctcttttctccttcatcctccaggggaagaagctttttgtccctgtggtttcccattgttatttcaagacagattcctctgccttcttttaaaattcttagctcctttgaagttaagaccctccaactatatcacgaccacatcagcccacatcccagtcaattgctctcatccatctaagactttggaaccttgatcttggccctcagcactgccatcatcaggggtgaccccagtcaatctcggctgtgtagccaacactggcctggtggatcctgccaacactggcctggtgtatccgcactgaccatctctcttccagagtccaccacccagttcttgctgctactccatgattgctaactcaggcagtaattgctgctactccatgattgctaattcaggcatcccaatgctctgacatttactcctttccattcagtttccttgttcacttacatccatttcaactgtccttcaacctgatgaaaaccactgacccctcaaatttcccggttcttcagcttgcccccttcctcttcttattcacctcagatttcatagtctcgagttctactgttgagcagctgtttaagacaggggactaacaaactgtcctaataaaatagcatagaagagggaaggggctgttcctcctgagaaaattgcagtattgttgccaacagatgggaacagggatggcaggcaggccagaataaccagtgaccaccctgagttcttcgggaaaatcttgacagattgagttatttggattatttaagttatttggctgcttttcttttaatattccacctaaatgtatatgccacctctttccaaatgaagccagaaatcttggctcaaagttcttgtacaaaaaaagcttctactttgctatatacacaggcactctgtgttctccaaaattcaaatgactgaggatattctttcttaaggctgagaaaacatatggacgaaagtatgctgcttctcatcgtctgtagcctcttgacaagacatctgctgcaacagtttttgttcttcgatcatggacggttgtttgccaattgttttcataaatattaatctttgaaatcttgactgacatataagttgttctttttggattcctttcttcttttcttatttatgtgcaccatctttaaatgattgtgccacagtacaacaaaaaaagattttcttatgaaaaattcttattttaaaagtggaagccatataatgtctaatttgaaagcttgtgatttttttctttacatttgaaatctcctttttcttttgctcaactaaatttattccattggaataatgtttttacttcagctctttgaagtacccaaggaagacatctaagctcaacttccccaagtacttgactgatttagtcccaaggtagataactgtttcttctttctgtgaagctataaactttagaaccaaataattattttgaattggacagtgatagccaaggtgttctccagtgatatttgatgcatcttaatttctaatcatactttttcatgggaagataattggaaaatctttaatggaacataacaacactgtctaccaatgggtgttatttaatgacattgataaagttttattggtcttctgtgacctcgaccgtacactaaatagaacatatgaagcattttaaatgccatatatagcttttttggaatcatttttattgtgtatagtagttcctgatttattttaatgttacctctagggataagtaattcagcatattttaaattgttccaattattgctcaattagtagaacaacttttatggacacaattgtacatatttatggggtactgtgtgatattttgatacatgtttacgttacataaaaatcaaattaaggtattcagcatatccaccacctcatacacatatcatttatttatggtgagaactcaaaaaatcctgtcttgtagttattttgaaatatacagtagagttaaccatagtcaccttgctgtgcagtagaacaccagaacttatttctcttaataaaacaatttttaaccttaagaatgaaaaatgcttcacacagatattgatcctaaccctgttagcaaagaatcctcagttcatgtgaagctaatgatgcaaaatacagcaagtgactaattttgaaagactgtttgattacagtgccatagtatcttttctttcttagtaaaccacctgttcagcatctaaactagggacaattccttaagtgttcaacatttaaactgaaatgttcgatattccttaaatctagctgttcaacatcttttttaaaaatttacatcataaaatcttgagagagaagctccattctctggttttcataaagctttgggttttcttttgctttttctttatttttttgaagtgagaatactccgttgttaaatgagagttaataaattggaaaatatactaactcattgataagtgatgaaatttctatttcttcagttttatctagatcatgtgaaatttatatttagaatagaagagatttctttacatcttttgctctcttcaagggccgtatcagggattaggaatttatcttagttgagatcaaaccatttcctctgagatctattggcaagtgtcatctctcttccacatctgccattttctgaaagcaaaatgaaattcacatgtttgcatacaattttgctgattcttgccaggaatacttcctgggaaaagcatgctgaatatttctgcaatgcttcaattttagggagaaaagggaatattacaaaaatttggaactatcccatgacagagccaggagctgaggagcagatgaaggacctacttctggaaggccactgacgtgatggctggtgtctccacggggttaggagaatggacatgtcaagcagtggccctctggatcagggattagatgccagggagagaattacttggagaaaaggctgggctgacttgtatagttctagtcagataactgacacctagggggaatctgccatgtattgtatcatcttctgtgggaagacacagaggaagaaatgatgccacctgtattagtttgtagggctgccatcacaaagtcccacagatcgagtggcttaaacaacagaaatttgttttcttatagctctggaggctggaagtcagagattcaggggtcaacaggtggtttccttccaagggccaggagagaaggaactgtcccaggtgtttctccttggcttgtagatggccaccctctccttgtgtcttcatattattttccttctgtttgtgtgtctgtgtccaaatttcctcttcttatagggccactagtaatattgaattagggtccaccctaatgacctcattttaatgtaattacctcttcaaagatcttatttctgaatacggttatattctaaggtgttgcaggttaaggcataattcagcccataacatatctaagtctttaatcttttcatagatgagatgtgcaaaggttttctgtgtatgcttctcttgtgcgcattttgctgacagcagccaaaatgcaccgagcagcttgcgggcatctacaaacagatttaagaagtgatttctaaacattattgtttaagttggtttaaacccatggaagaaacagaaaagaggtttttctcttgtttcctatcttaggttaaggttgaaaaaaaccagttgattggaataaaaactcaagtgacaatgactaccagatacataggttttttagcagaaagtcaaaacatcatatagactggttccaagataagtgggaaaatttgaaaatttgatagcactgtgtttgtggcagtttttagctttgggctgactcaaatatagagtccagtttcttaccaagcacttttcgactgtgtttcagcatgatcatgaagaatgcacattttagataggatctttggggttttctatttgctacaaattaaattaaagaattattctgggccgggcacggtggctcacgcctgtaatcccagctgtttgggatgccgaggtgggtggatcacctgagatcaggagttcgagaccagcctggtcaacatggcgagaccctgtctctactaaaaatacaaaaattagctgggcgtggtggtgcatgcctgtaatcctggctactcagggggctgagatagagaatcgcttgaacccaggaggtgaaggttgcagtgagccaagattgcgccactgtactccagcctgggcaacatcgaaaactctgtctccaaaaaaacaaaaagaattattttggaatatcatttcatcaattcatcattacagtccattgtgtgcaaaatacatgcttaaaatcttttaccgggggctgggcacagtggctcatgcctgtgatcccaacactttacaaaaagttactttaaaaaaattagctgggcatagtggcacacacctgtagccccagctacttagcaggctgaggtgggaagactgcttgagcctgggagattgaggatgcagtgagtcatgattgtgccattgcactccagcctgtgcaacaaagtgagaccctgtctcaaaaaaagaaaaaatatttcattgaaaaatgtcccttttctggaggagtgttttatactgttcacaagtttgtgtaaaccacacatacacaattttgctatttgttttggcaagtggtcagtttttaaaatgttggtggttgcttttaatatctacctaaagatagagtgaattttacggaacataacacaaacaagaacactgcttttagctcgtgatatagccaagcctcaatgacttattccttgcacctgtatgtgggagataacaatgaaataataaattgtcatgattttaaggaagaaaatgactcatgtcatagtattacttttgtaaatatcctttcacaaatatcctataattttaagctttgtttttaaatcttaaaaatatttataaaatacttttctgatattttaagacagcattaccgtattttcttgtgtgtaaagttttcctgcttctagtatattttaaccagttctcttatgccaatcaaaggagaatatgcaatttcagaaaaataaacttcaagatagactcacagtaattccttctgtcctcaagcaagtatctattccatatctaaatcaagatgattgatcattttttgttttggtgttggtataatctttcctatgaggttctaagtggtggggtacttcactgactgtacaggaaaagagaattgtcttgaatcattcagatacacacttgtgtgtgtgtgtgtgtgtgtgtgtgtgtaaatacagtaaacatgaagcttagaacatggtagaaaatcaaaggtgtatgtgagaaaatatcaccttttaaaaatctgagatacattattctggaagtgaagaggcaatctaatctgcacaagaataacaattgtcagagcattgctttagatgggtcacaaagctaagacgaatgaaaaaatcaaggagcattttaagaagccactatttatacttgtctgctgctgaatttctctacaattcgtttctgctccagtttattacacatgaccagtgtatgtgataaatgaatggttaaaaatgagttatagactttaatgtgaaaatcttttgtctgattttactgttcactgctgttaccctcagtacatttattgaaatgtcttacacactttaatgctgtagtgtgttatgcgtgtttgtacttctcactgcctccgatatttcagtgggcagaatacagtgaggtgcattaggaaagcccaatgaatatttatggtaatccaagggaaccagacacagaaatggacttgcttggttcccagacctctatcttttatcttattcttaagggtatttaagataaaaacaatgtactgtaattgatttattttaccaaatctacttagcattcagtggctatatccaaatctaaaaatattgatagttcagcactaaaagtgggtttaaatttaatcatagaagagtttaactctgaaaaaatttatgatttattttgggcttttatctattgtcacctcttctttgctgaatgtaatttttatgacttcagatttataaattagacagttgcattaagacaactcaaaatgagaaaagaaaatagttctggaaagaattatttcttttttttctgaatttattggtacagtcctatgtagatatactacagtgtttgagaaagctacataaacatggcctttctacccacaaccacatccatagtatttaagaacccagtaggggagaattgaaggctgaggctgacttcagagaatcctacacgaggcagagttcctggaatcagaagtccaaagcaggatagcttatgtatagaaatattagctgtcttgattctagtagttcatagccccaactggggagccagagaacaatggttttcttcctacatttacttctgaccatcaagaaagtaaaaatctccaggattcacgggaaatatgatcctcagtgaacagtatcatcagaagatgatgactgttggcaacacaaacaatgaactttccaaaatacagacacagacacaagagagtaatccagataatttcaagtattctgtggcttctgggcctgtctttgtggacttcaggtgtagaaaattccagaataagtgtttgagatgttagctggttttctgaccacattaagtgtgctggtctgggacattggggcccttgctacatcacttattggctgtgggatcctaggacccttggctctaacctgcatcatctgttaaattaaattaaaatcccagttgagccaggtgagcttttgaggtctgtatcctgattctctgatctccttctctcttatggatttagattcttaatgggactacaaagcatataaattccttttcagaaatattggaggtagacttaaactgcaaaaataaaaatttaattaaatgcctaccatgtgccaggagctgaaccagttactgaagatacagttgtgaaagaaaacaaaacaatgaaatggcatggtccattcttatattggagcttacattctggagggggagcagatgatacataaatagataaacaaatacacagtgtgctgtgatgaaaaatggactagccatcatgtattgaatcttcataggtaccaggaatcattttaaggatgttagaggtgctttatatggagatttaatcctcacattccagtgtccattttacagatggaaaaactgaagtttagagacgtttggttattttacttgttccaggttccacagacagaaccagcccatgacccagctggcattagaacccaggcagcgtgattataggatctttaataggaaattattctgctacctgtctcaggataaaaggagagcaagaacagtgaagagaaatgggtttgtgttttctatggggtgttaagagaatgcatctttgacagggtcctgtgtggcagagactgaggaaggccatgcagccatcctgggcagaggaaacagcacacacccaaagatctgcattagcagctggattcctggtttgagaaccatcaaggaagccagtgtggctagaaagggctcagtgacaggtagcactaggtcatgagatcagagcagtgggagaaggggctggatcatgtaggccctttgtaggagatggtaaggactttgatgttgtctgagtttctcagcattagacagaaagccattggaaggtttgagtataggagtaagtgaaatctgatctatgattgacagagactactgtgtcagcttaagtgtagagtacgcttaagagggcaagagtgaaagcagagataatttttaagaagtgattgcagttatctagctgagacatgatggaggcttagagtagggtgacagtggaggcaagaagttgtaggattctggatgtggagcgaagtttgagtggatagcttttgaatgtgaggctgaatgtgcaataaaagacaaagaggagttcaaaatgtctgtaaggattgcggcatgagtaactggaagaatggaagtgccatttgttgtaaaggggaagatgaaaggaggaacctcacccaccctgtgcctccagtgcacaacacagcacagcaaatgggttcagtacagaactgaattagttagccatggaattactcctattcctgccaggtgtcctcaaacaaataccaaaatccatgacagtgaagtttagtggagaaacatgtccccctttgcatgatattctgagcttcttgatgacagcaatatcaaaagggaaaatgtagttttaatttggagggagatggaatctcatttacgataaacctggacataagatgtaatcaacatttcattcttgtacaatgtaaagagttattttgagcaggttttcagtgacctgtgaagaaatggcatttcagtacaacttcttccttcaggttttcatacagatgagcattgttataagtggctaagaaagatatggaagaggacatgataggatagaaactatttttctgggatagatgcagtgttcctcaaacatacaagtgcattgaatcttatatttacttttgtagctctaaacaaaaatccaacatcctttgtggttctatttcgaacagtttgttagtgttagggcttgcagaggccccgaagtaacatccctctctcaggagctggaaccattgaaagtcataggaatctttcaggttgagatcagaatgtcaggttcataactggaatatgcaactggaaaacatggcttgagatctgtgggtgtgtttgctaatatttccccccaacctaacggcaaacccagactctccaaaggggcaagccgcttagaatatggcagagagcagtccaggagtctcctgctcttggggtcaggcagaacttggggaggactttgctaacatctgttattccttctttccaaaccaccagtcacataaggcgcttccctttttcaaaggaggcatgagtgagtgggcagagagaggccaaaggtatcactagcggaagttcctccacctggggcacatgaggtaaggagaagggcacttccctattgacctttctccattgggagctttatctcattacgtagtaaattgtcattacctttatccttgtcaggttcatgtttctgtgggagatattgtaggactccttgctttatagtatagaagaagtatgtctcaacttgttttcccacagaaacatatctgatgaataacaaaccattagtattggtatctcattagctgctaccactaaactatgcattactcccagtttcactggtgccaaatccattcttttctctgtgagtttgagaactattaatgtagatacgtttcagtcaagactaaggaatatttctataaaatgaatatttggaattgattatctcagtaagtctaccagtatacctgaactgaaagggattccccaaaatgccaaatattcagctataccagaactatactgattggtggtgtaatgtttgtagaattttcagaatttgatgacacttttaggcattctatcatcatcaacaacagcaaacatttctcaaaggcattcttcctacaaagtgcaatgccaagtctgaggacacaccaagaagtataagttgtctggacacaagaagtttgtactccagtatagaatgtgtgccacatgagtacatgtgaaaagtgaataatataaatgtaccctatactacctgctaagtggattacatgagcattacaggcagaatgttaagccatgcaccaaagacacttttgacaggtttgggatgattgtaaaccatttcctaggaattgttcataaagcttaagacactagaagtgagtgttaactttgcaggaatagatcattaggggctgtttggtactaggatatttcataaagaaggtagaaattgagccaggcttcaaatatcccaggactgagtgtttggttcccttgtccactccatctgcattcctcttattaataaataatatcaccatccaccaagctgctcaccaaaattttaggtgtcattcttgatttcttcttatctctcgccccttatggcaaatgcatcagctagtcttgttgattttacctataagtgtttcttgaatacacccagctgcctatctgccctgccacccccttgtctaaacccgttatcctggtccaagaaaccgtcatctcctgcctggactaccacatgacctcctaactcttctccctgctttcagtatttgtaacctccaatctttttttttcatagagtaacagttgtaaatgataaatcagataatgtcattctctttttaaaaaccctttgatgtttttctgtttctctttaaaagaaaatgtacatttcttaccaaaattagtaggaccctgcacaacacaacttgggccatcttttcaacctctttcccttattttattatagtgtagccacagtggtgtcctttctgttcctcaaacagaatcacctctttctgtttagaggttttgcatttgctattccttctgcctggaataccattcccttggctattcatgtgcctgactccttttatatttttcaggtctcagtcctaatgtcacattctcagcacaaatgcctttcttgacaactctatctaaaataacttcccccagttcttctctattacaacatttattcatttttttcatagcaaatttcagaaaatgtacattttttcttatttccatgagtctattattactctagctgcagtgcatatcacagtgtcttggactacccaataaacacatgaataaatagtgcagctgatataagcagaggagaaagaaaggggaccttctcgtctgggtgagagtgtgagcaaagagctggagataaagtgtgcatagtattgtagggagcaacacctgagtgctgctcaaaggactggaggagcctagcaggaatgctggcagtggtgacttggattggaggttggggcttagggttgaattatagtggctgaaagtgagacagtctaatgggtagatacaaattgtgttcaaagaaggaaacaggagaagtatcatattaagcagtaggtctgatagggtgagcccaaggttgtagagagaagagattaaataccaaacaacatcaggaaggaacagggcatagtagggagaacaagggtaagtgaaaaatattttgttcaggatgtggtttgtgaacaaatcatctagaatactgttcttattgagagcaatcctatttatatggtgtaaagttttgtttcagtagtactgatatatgaatttggagaataaaaacaaacatatagagagggtctcaaagtcaaagctgtatggatggaattcaccttacagtcagtcaacttgatgttactgaggaaatatttttgatcaaggagtgactctataagattaatcctgctgtgatattattggttacaaatgctgtaggtagagatgccagtaggaaaggattgtagctgtctaggtgagcgcttttgaaatgtgtttctaagtctgtttacttaacaaggatatactttatatgtctgtcataaatcccatactaaaaagtattcaaaggaagttgttatagaatgaaagacatgaagacctgaactttgggaagctttagcaacagaaagtttggcagggatattagagtagctctactttgccatcccctgccttccatgcccacactctcctcatggtagtgatatccatattttacagtaaaatctttggaaatttctttatcctgcctcttccctgagatggtgaatggacggcctgtagagctgggctgcaatatcacagctcatcactaggtgtcatcctctcaccaatgacttattccactcagtgtttctcaggtttagttttaaattatagaaatgttttatttttattccatctatattttgagttctcactccataattataaataattttttgagtcacatgaaatcaaagaaaacattttctaaatcttgttacagtaacagtcacattttgtttagaatactcttttagtgatatttttatacaattgataacctgcttaattttaactgctgtagtattatgctatttattttgataatattgtaatgttggtggagatataaacaagtcatggaatctgaaaatatctggtttgtgtactttgttttcagcccttgtatagattaaaccaatcttttttatttttttgaaaaaatctgcagacattgccatgtacttgagttcaagatcctgtacatagacctgttttttaaaaatttaaaaacaaaatatgtgtaggaatttgtttagcatgtattgtatttcattatcaattttagagatatttttacatttgggcaaaaaattagcagtgtaataataataaggcaagggtaaatatttatatacaaatataatggttcattatttataaatccaatggcattacttaaaaaccagatgtacataatatttcatagttgtgcatattttttgattaatccctgcaaataaaatgatgagtatatgaggtttagaatgtatagtaccccctgtggctcatgttcaggaatatctagctcatatttgtcagttggttatactctatgtagtatctgaaatgtatcattcccacaccttcccaatttgaaaactcctttgaaatggcagagatactattagccttattcgtttgaaaaatggagtatttgaaatttgctttctctgttgcttggttagaagcatgtgtgttacatatgccttctatcccgttataatcttgtgtactgtgtgactggttttaatgaactgtttctaccagtagggaaatggtccctgttttatttgctgctatgaaagtcccaaagcatgtgacagtacatgtgcacactccgtgcagattaaagctgcggggcatgattggaggagacacagactgccaagccactgaggcggctctgccaacaacagcatgtgattatgtaacgcctgcagtgtctggcactgtgctccactggagacacgtcacgtgttgtgcaatgctcttggccctgaaattcaattagattgctttgaacgatccgtgagtctgcatgagataagcttttactgctctacagtagaaagcaaatgggttgattagctgcacataaattgataaattgcctttgtaattccagcaaggatatttgcattatgtatacatcatcatgcccctgaagagctgagtttaagcattatataacctggataaataatgtaggggtgggggagtaccaaccttcacaagtagagaaaaatgttttcttacagacagttagcagtaggctttttaaaaaaaaaaaaaagattttgccattgtttttgagaatctgcttaaaaggctgccagtattttatttttcaatgcaattatctatgagtgagaataaagaaattgatacagtgataatttggtggggggaaggaagattagcgagaaaaagtgtcaaatcgtgagttcaattaaattaaaactaagttgtgagctcagatggccttttaatgttgaacaaattaattttttgtgagattatagctgatcaatttaaggaaccgtcagaaattaaccctatatttggttgaggcttctagttatctttttacgaaaagagatgtgggataaaagaaggaaggtaatagaagttgagaaattggggcttggtaaagaagttgaggattattatcatactagaggcttaagagcctctggggaacaaccaaaatcaatgatgtgagcttggctatcccagctccctctacttctattttactccaaataggatttatgtttttaaccaaaagaccttgtgagacaatgctcgttagaattgttcagacactgagctgaaacccaaggcatcgaaatgttatgcagaatgcttccattttgttatatcaacagggattaggtgtacagttcttttgcgattttaggtaaaacagtcttgaactgtagcaaaaccggtgttgttgtggggttccccccccgccgtggaagcatggctttttttcttctattctttgaaaatcttctcaagaatttgcttaaggtaaattcttatatcctgattttgatgtgagtagattattttctaatatgtactaaaacccagaatttaacaatttttcaatttaatagattatctaaatgacgtgtgagatttaacttgcacatgtactttcccattcattcaatttccataactatctgcagtaggtattattccatttaaccaaagggaaaatggatgcatcaagaagcataatgaactgcttggggtcgcactgctcagaggtgactggataggggttccaaagcagatcttagatgttttcttccactgtaataatggtccccaaacactgacccacaaactgggccaagttggaccatatttcaaggaaatcctgatttattatgtgtaaagcgtaaacctgggaatatatagttttaaaataacttcccaggtgattgtgatttaagatcaggattggtggctacttcatgtctaatagtctaagctacagagatagcattagaacatctctatgctgtacttctgatgtgtgtgtgtgtataaacaggatgaacactatataatatctaaaaaatcttcagggaattaaatcagcattatacaggttggttaactgaaagtttcgagtatttatactatatagtgttcatcctgtttattcaaatcaaattgtaaaaacatagtttattctttttggttcttagtaaaactttaatagaaaatatatcttgctagaatagacataaaatattctgtgtctgacgctgtagtattttatagtagtcaaaagaatatagtgggaaatgtaattcagtaaatggcatctgctataaaaaggctagcctccaggtcttaaattgatgctagctggagtaactttgttaatgagtgaattcagagttggtttaatgagttagtgatgtagggatagctcattatcatcagggaatataactcgctgctgcatctttgcaaaataataaaaagggactagctaatcccttaccctgacataattgagtctggctttgttgttgttgttgtttcctttcctatctgcgtctttaaaagatgagatatgatccattactgttggggatgggactccctgagcatctctcctttcttcattcctccctcccactctttttacgaagatcgtcttgttttgtaccacagatatttgttttaaaggaaagtgtttgaaaaggccaaattaagtctgtaaacctacatgcttgatgaccaaagcatcctggctgaagctttggaaagactcgaggggcccctgactgcatataatgaatctgaaaaatattgacagttaataacagggtacatgcaactttgcagaacatgtattttctagaaacgcattcttaattgttcagctgtcatagtgcattaccaagtatatgattgacagctattaaggtatttttatcttaaattttactctttatattacataattaatataaattatttttcatgcgctgcacttataaaaataaataataatacagtatcatggttttctgaacttcagttaagagtgtgtgaacttttctttgcaaatgaactaaatattaatgtcagttttgtataactattgaaaatgcaccacctcccaaaaaatatcttcaggtaataaaataaatcagcattatacaggttggttaactggagtttctatttgagtatttataccatagaaaggaagctacttaggggcaaaatctgagtctttaatgtactttctttcacagtgactcatattgctacttcaatgtgatgtttggttcaggaaataatttatccagatgctctaaaaaggagcatgttatattccttacataaactaattctacttgattcctgacttgttctgctataatttttcaaagttatatcagcctatagaagatccataccccataaatatctaatcaatcaaattcatatatagatatagtatgtgcttaaaaaataaagagaaagattttcttggttggtctatcaatcaggtttgaatcaggagacaaaaatccacaaattattttaacaaaaaatttaatatgaagaattgatagctaggaatgaagaaatgaaagatgaaaagaaagacactaaagtgtcacaaagatagccatttcatgaagcagatctcacccctacatcaggagcaaagagaagtaacttaaaacttagatgagaggtcccatgtggctggaactcagaccttggggaccactggcaaagaccaggagccgctatttctgagggaaaggcgtgttggaaaaactacagactgggttagttgtggctttgagcaggaaacacccttgccagaataaagtgtgtttggaatgacactcacaagaacaggaagcaaaaacaggaagtcaacaggaagcccataggaagcagagaagaggaacaagtctcttcttccttcctggagtctgttcttcctcccagattgcctgcaatctccctctcatacttcctgctggcaaagcctatcctagatgtagccagcaaagtagaaatgtgatccataaaatttcagtcccaaatcacaagggggagtttggagctgagaggcaacagctcaataactggtatgtttctctgaaaaccttaagaaaactatctcaattaaaagttattttacatttaatttttgaataggtaatatactgcatagtaccaaaatgtaacaagaatagtttctttcccaccttcattgcccttgcaccgtgttcccatcctcccacctacctcccagccaggtaatcactattattggtttcttatgtatgttttcagagtttctttatgtatatacaagcaaacacagtatgtatgtttgtttctgtcatatcacttatcataccactatttcacacctttctctttttacttaatatatctcgttgattttgccatataagttcatagagaacctctttatgttttaaacctcattaccttaataaattctcttactgttttcagtagtttttcattttattgtctttggcgttcacaggacaaaatgacatcatctgcaaatattgatggtttctaaatattttgtctctacatcatttatctctgccaattgttttggcttgtgcatccagcacatgttaaatattaatggtaatgaacatctttgtctctatccggccttattgagaatgcctttaatatttctcagtaagcatgatgctggcttttgggacaagataaatatattttattttgttaaagaagcatctatttattatacttacttttaaaatcagaaatgaaattaaattttgtcaaatggttcttcagcatctgtaaagcataatcataggacttttgctgttttatgtaagtactatatttctataagctttctattttgttaagcagtttcctaatgtttctaacattgagccatctttgcattcctggaacaaattccactgggtcatggaattcaccaacacacaaacacacccacacacgtgtgtgtttgtacacaatgatatttataaaaatattgtaggttttatttattgttgattactatttgttagttttttatttatttcataggaagaatttggaagtttttcttattttcttctgctctgaaacagttaaaaagtgctggattgatcttctctttgggagaagttccctgtgaaactatctgggcttggtgctttttgagctgtttgctctttgacaatttcctttatttattacatgaaaatggtccctttagattttctgtctcttttgggttcaattttgataaattttatttttctagaaatttattcgttttatgcagtctttcaaaaaagtttacgtgtagttgaaaaatcttgttgatcatagaaaatcttgtgatcatttaatttttttctgtttctttagttatttccttcttgcaatgttttacttagtatttcaggctttccttctttctttactagggtttctgctggttaattttctcagaaagcaagtttttaaaaaattgttaaattttaaaaatttaaaaattagtgctgtttgtatttcttttcaacctcgttacaccatgcttctatatttaatgagttggtttaaaattttgctattttttatttttgggtatgacatttatttttatttctatggatgttttgaggatacagatttttctcttagcactactttattttttatttgtatttattcccgcccccccttccccgacaacatttattttaggttcgggggtacatgtgtttgttatataggtaaattgcatgtcacaggggtttgatgtatagattattttgtcaccctggtaataagcatagttcctgatagctagtttttaggttgtcacccttcttccaccctccaccctcaagtaggacctggtgtctgttattcccttctttgtgttcatatgtactcaatgtttagctcctccttataagtgagaacatggggtacttggttttctgttcctgtgttagtttgcttaggataatggcctccagctccatccatgttgctgcaaaggacatgatctcattcttttttagggctgtgtagtatttccatggtatgtgtgtgccacattttctttatccattccactgttgatgggtttaagttgattccatgtctgtgcaattgtgaatggtgttgtgatgaacattgtgtatatgtgactttatattaaaataatttatattcctttgggcatatacccagtaacaggattgctgggtcaaatggtagttctgttttaagttctctgagaaatctccaaactgctttccacagtggctgaactagtttacattatccccagcagtatgtaagtgttctcttttctctgcaacttcttcatcatctgttagtttttgttttgttttgttttgttttgtttgatacagagtcttgccctgttgcccaggctggagtgcagtggcgtgacctcaactcactgcaatctctgcctcctgggttcaagtgattctcctgcctcaacctcccgagtagctgggattacaggcaggcaccaccatgtctggctaatttttgtatttttaggagagatgtggttttgccatgttggccaggctggtctcgagcttctgacctctggtgatccacctgccttggcctcccaaagtgctaggattacaggtgtgagccatcacgcccggtcagcatctgttagtttttcactttttaataatagcctttctgactggtgtaattgttatctcattgtggttttgatttacatttctctagtgattagtaatattgagcattttttcatatgcttgttggccacatgtatgtgttcttttgagaagtgtctgttcatgtcctttggccatttttcaatggggttgtttgctttttgcttgttaattttgtttaaaatccttatagattctggatattagactttcattggatgcagagtgtgcaaatattttctcccattctgtaggttgtctgttaagtcagttgatagtttcttttggctgttatcactactttagttgcatcccatagcatctccctatatatagtattttaattattgttgtttttcagaaattctctttagaatttttctcttctaaaagttgtttaaggagagtttattttctagatgcaagggatcttttgaagtttaaaaaactagttcctagttttcttacttgtcatcaatgttatactcttcaaatattcttacatttaagataattctattacattatatattttaaaactatttgttaacttccatttcttttgtttccttcttcagatctccaattatgtatatgctgagtcttccattcactgtcttttttttcttttacgttctcttttaacttttgaagagatttttgaaatacccattttatttttttctcatatctatcctctccatctctttgtttgctgtagtgtcgagcttatttgtgtcccttccaattatttattcatttccaaagaaatactttttaaatgttcatctcctattttttccacaatttcttcctgaatttcttatctttttgctatgcagcattcctttatagaggtgatttcatcatgttaaaaagtgcatataaaaatttttttataatgattttaatttgtttgtataatccatgagtgctatttattgataaactttgctcttgcatctctcacctttcctttcccctttatattccttatatatattctttcagttgatacaaccagtaatttatgggaagtctttgaagaccccaaagcccttttcttttctgctatcacaaagctggagcacatcctaaaaatatggccactctgatggtatctttcataacagtagttcctcagcttagctttcctttcctttcctttcctttcctttcctttcctttcctttcctttcctttcctttcctttcctttcctttcctttcccttcccttcccttcctttcctttcctttcctttcctttcctttcctttcctttcctttcctttcctttccttcctgtcctccccttccctcccccgcctcccctcccctcccctctcctctccccttctcttttcttcgtcttttcttttcttttttcttttgagacagggtctcactctgtcacccaggctagagttcagtggtgcaatcatggctcactgcaacctctgccttcagggctcaagcagtcctcctgcctcagcctcctaagtagatgggattacatgctcatgacaccacaccaccacacccagcttttttctttttcttttttttttgtagagatggaatttttccatgttgctcaggctggtcttgaactcctgggctcaagcagtctgcctgcctcagcctcccaaagtgctgggattacaggcatgagccaccatacccgggccctctacatttctgaccttgccttttctccccctaattctgacttctatggatacaaatatgaactgcggctttggtgtttcttggtgggctccttcacttcaggagatagatttttgccttaacttcttggggatgcggctcggccatgtggccactctcagtgcttctctgtactttctcctgcttggcttctgcctgatggctgctgatatgggcagctcttatgtgtcttctgtagtttgtggattatatctgtctctttcttttgctgaaaatggagttttcaggcttttattttcttctccttctttttgttgatttccacagcagtataatgatactaaattcattagccatgcacatgctggaagtcagtgtgggccttaaggaatagcagtttaatatcagggctttgatagtttacacaggcaatacaataattacagcaggtgctgttcaaatatggaagtaaaataatgttcacacttgccccagaaaatcactgtagaaaatgagagacatgctgcttttctctttcttgcctttcatttattttaaagaaaaactttagtattagaatttggtgctaatatttgagcattccaagaaaactactttctttgataaatgatgcaaagctcctattttctccctatatcttttaatttatagattgttctttcttgttattttgctgatactggagtaaactggttcaatctgagtaagatcttgtggaccctgtttttcactattctgttggtattttgctactgaggtagaaattactctgtatatttgttaaactacctggaatttaggaggataattttccatcatcttacttttaactgatgagaaaatacatagatactattctgatcaaaggctgatttcttggtcttttgttatagttccagacagtagaaataattatgttttgcctggataattagtcatagctacaatacaaattttaattgataaattaaaataggaactattttatagtcagctcttcattaaatcttatttattttttattattgtgcgtaaccaaattgaaaatggtgtgaatttagattaaaggtgaagctttatacttaattttccttttaacatacggttcttggcaacaggcagaaaataaatgcaatgaagtcagtgtttcagtagtgaaactgtacaaacagtagcaagttactggagctgacagttttcaaatgatagtagcgggttatgtaagtcacccaagatggctcaatgtactattatttccagacagagttggaaatagcacgtgccaaggcaacaggcagtcagacaaaaacataacaatttactttccaataattatcatcacttcttgccaggctggaactcaattgatctgatacagcagaatatctttttgtatggatttctttcaagcttagaaacatcatgactgcagtaaatactcctgtaaatcattttcgggacttcattaaaggaaacagcaatactgtaatcgctttgttttttgcatttaaaacataaattgatacaaatcccagccagtgctatccttcaattcatttaccctttcttcttttccctccctttttctaaactctttctttttttaaaaaaacatcgtagttagttggaagcttttaacaaaagagctgattacattaaggaatttagctcactcttcttccatagctgataaaatattaaaaaataagactaaaattatgcagtctatggtttataagtatcacattgttcttaagatacagatttaattgacagatttctaaggaggcttattaatccttcagccatcattgtgaaagggaaatattttcagaagttcaaacatgggacaaacgacaaatgacaagtttggtggaaacacaacaagtggatgttagagatcattttgaaatagttgatgacatacatgtggcctgaagtcagttgattttcctcctgggtagcttttatgtatgagacttttgttcagggactaccacggcgggggaaaaatgtagggttgcatgtgtgtgtgtgtgtgtgtgtgtgataattggcaataaaggaaatttggagacagtggaaaaattggatagaagacataaggcaaaggtgctggaaacagggagtgctgagacaagagaaacctggaaaacttgggtgtagatgaaattatattcccagatgacttttcatggcagcttcatggctggcttatgctcaaagtcagggtttctgcagagagagagagagaggtctgaacaaagtatccgaggaagagtaacagctggagctgcccaggacaggaagtaattgcccattcagagtgacccaaactggcctatattatttaaggtaaaactagctaatgagtctttgacactggatctttagaaaactttttacattttccagaataaaaagaatattaatattcttttttcactgggttaaaatgttagtatcatggcaaaagcataatgaatcttaattcgaatttaagcaagggcttttaaaatgcaggatggaaatggctttcataaatctgtgaaatcccctgggcatacaggcagcattctgtgtttcacaatggtaactgcagagtgtcttatagtaaggtatctgctcatatgctttagagttaaaaattgtttcccggccgggcgcggtggctcacaccggtaatcccagcactttgggaggcctaggcgggtggatcacgaggtcaggagttcaagatcagcctggccaagatggtgaaaccccgtctctactaaaaatacaaaatgttacccgggcacctgtaatcccagctactcgagttggtgggcacctgtaatcccagctacttggggaggctgaggcagagaattgcttgaacctgggaggcggaggttgtggtgagccgaaatcgccccactgcactctagcctgggtgacggagcaaaactctgtctcaaaaaaaaaaaaaaaaaaattgtttcccttccctgtccgttgagaggtgtgaacccaaaagtatctgagacaggtctcagtcaatgtaagaagtttattttgccaaggttaaggatgcacccatgacacagccttaggagatcctgacgacatgtgcccaaggtggtcagggcacagcttactcttctacatttttgggagacatgagacatcaatcaatatgtgtaagatgtactttggctaggtccagaaaggtgagacaactcaaagcaggggcttccaggttataggtagataagagacaaaaggttgcattcttttgagtctttgatcagcctttcactcgatacacgatttacatgtggggggtgggtagagaaataatcacttatgccttagtctggcccagtgaatctgcatttttacataagcaatagggcagaggaagcaatcaggtatgcatttatctcaggtgaacagagagatgactttgagttttgtcctttgtcccgcacctgtgaagataagctatcaatttacattgccagagtgaaattcaacagacttgttttagggtaaaggtctggaggcccacaaggaatcttcttgtgggcaaattgtgagggagatctgcagctttttttttttttttatctttgtagctatcttatttaggaataaaatgggaggcaggtttgcctgacacagttcccagcttgattttcccgttggcttagtcattttggggtcctgggatttattttcctttcacagaggtaaagcaagagcaaaatatgtttttgactgagggtggaaatgagatgaagagtagatgaggcagagaggtactgggaggttgtttaggatgacagatgtttcagagaaggagattttagtgtcaggaatagtaagatggtgtggaaagacgttgaggaggacagaactaaagaaactgatggggcctgagggcgaaaatggtggacagagatggcttagacttcaagacttgatttgtagctatgttctaccagcctccagctgtctatgcgttggcctcacgcatgtcccaaacgtggtcccacacatgtttacacattggtcccacatatgctgagagtaattactttctattcatcagaggtcaaaatagaataaagaatgtttatgtcatagtatgactttttaggtgattttgaaaagcaagaatatgaattctatgaaaaaaatctattaggaaattatggaaatgacagaatgcagaggtatttggaaatagaaaaaaaatgggtgagacagtaaatacttacaaaaaaagttattgaatgtctgctcagccctggaaaggcactgatgaacaatcactctaccttcttggcgtttagtgagaaaatcataccaaccaaatagttggacagggattaattaatttctgttttaaatttactctgaaggagaagtccagagtactgtatgagtgtgcaaccagagggcacaaactgggctaggggaggggtgtcagaaacagcttctccaagacagtgacattaaacagaccagaagagcaaggaggatttggtggaaaaggccctgggagcagtggaacacacacacaggtgtgaaggatgctcctgttccactgatgggatgatacttgtggagcactcttttacttttaaacaattagacacccagaagaagcaagaaggattgcagggaaacgattggttacagctcaggaaaaaagagactgagaaaacagaatttggggaagtcaagatgatagtgaatttgaaataggggagaagagttgataatagcatagaaaatgttattagagcagagatatacttaatgtattttttggtacagttctttttgtgattttttaccaacaacttctgcccccaacacgtctagtgaacattttataatttttcaaaaagctgtctttattttgctttaaattaaaacaaatgcacactcctcaaaaatatttcggaagagcaaataatgcagttgactcttgctgctaagctaggtgttagtttgctatgagcaccaaatgagatgacatttgtgaaactgccctgatacgtaatcaaatattagtttaattcaaattgaatttactgattcatttgtctccattattaaaacaatttgtgttcttcaccttactcctgcgggtcctcctgtaatgactagattaagtggtccaaagaaaatgactgcatttctgtgcatgctgattgtctttggcattctgcgacctgactgcttaacagtggaagtgatttggggacatggaaaaagctgacattgtgatcttctcactcctccttctctagcctgctaaagctgtaagtaaacaggtgtgtggtcaggtcttgtcaacaaagtctgtgggaagcatcttcttttcttatggaagctacatgtcttcttctcatcctttattatgtttaattctgaaatggttggcaaataccactatggcttttctgtcacatctggaagatgtgtagtcttattttatgagaaggagtaaaaggatggtgggcggagtagcctggttgtaattatagtgtacgtttatttggaaagactagcatattagtatgcagtggctagattaattaaactcagctggcataattcaatatggttagttcctgtaaaagcaaactgtctttaaactcttgaggtttgctataaagcttatgatgagagcaacattttgaatgtctcttcctcccatatgaattacaaaggcacttaaaagctgtccttttaaaaatttgtttcccttctctccccacccccaccaccccaccaccacacacacacacacacacacacacacacacacacacacacacaaaacccttatctacttgttaacaaaataaattctgggatctttttttaggaagatgagggcttttttaactaacatattttgtgaaccataatttccatgaagttgtttataattttgagtttctacacatcaagtagtgtgaggtatccatggaaactgtctagcctatattcagtgcactggaccgccttcccacacaggtcaagactcaaacagttccagatactagcttgatttattgtgccctaaacattagacagttttaaaaggaaattggctcctaattgacacatacaatttcatgtttaattagcaatttgagcctgtctacattttactaacagatgtaacattcaaaacgtgccattctaatatatctgttgcacagatgcacctaaatgcagaactttatgtaaatagcagctcagctgcttagcaaaaatttggacagaactgacattattttccttaagagatgtactttaatgttatttaaggagtgattttccttaaccaatctaatggatttattttatattttggtaacagctttattgagatattcacatactataaaattcaccctacaaaagtgtacaatttagtgttttttggtttatttacagatttacaaccaatactgctgtttaattttagaacattttcatcacccctaaaagaaaccccatgcctcttagcagtcactcttcattcttcccagccccagcccttggctatctattttctgtctctttttgtctctatgaatttgcctcttttggacatttcatataaatggaatcatacaatatgtggtcttttgtgactgcctcccttcacttggcataatgttttcaaggctcatacatgttctagcaggtgtcagcacttcagtcccattttattgccaaataatattctattatgtgcatataccacattgtgtttatccagtcatcatttggtggacatttggattgtctctactattatggatcatgccacaatgaacattctgtacaagttcttgtgtggacctctgttttaatttctttagggtaaatacttaggagtggaattgccggaatgtatggtaactctacgtttaattttttggaactgccaagtggctgcaccattttctattcccattagcagtgtatgagggtcccaatttctccacatcctcaccaacatgtgttattgttcagatcacaatgtcagctttttccgtgtccccagatcacttattttagccattctagtgggtgtgagatggtatcaaggggcaactttttttaaaaggagagaaatttaatattgtccatggttcataaattagttcaatgtgtgtctcttacttgtttgcttttccattactcttgatttgtaagataaatatacctctcatctctatcaatattgtcactttccttactaattttaatgtaggggcctatgatatcaaaatttacagtagtgaattgggctacatatagaaaatgtatcatgaaaaagggaaaacactgaaataactgttcgattgcaaaggttaaatctctaaatttctgtatgttttcatcttacttgactttaactagaaaacaggtataatagtgatgccacatactgggaagcaatgagtatttgatacaatgccagattaaaaggtgtacttattttttcgttcaatatagttcatcaatcataaaataccatcaatcataaataaggcataccataattttatgtatccctaaaaataaataaatgctgccaattaaactaaagcacaccatggattttaaagtgacctgtaatttagaaatgttaaaacatgcaggagagaaatgggtgtgttagaatcaatgaaataaagcagaaaagagatgtgcttgctcagtgttttttgaaggcaacccagtcatttatgcttaccaacacccaggggagatagcaagaatcttcatacttcaaagacctaattcattttacaaatatgcatcaatatccatgagtacaaaaatagatatacgtatatattacacacatacacactgacatacacacacacacacacacacacacacacacagagacagagagagaagagtagagagatattcattgactcattcttccacaccttaggagtattagatcagcatcagcaacctgtagttcactgaaatgattcttcctctcttcaattcactgattcagaaaagctggtttacctcaaataatgtttattaaatactttaagctttcttttcagcctgagaatgtttcatcttgttttttccagaagctaatttcaataggtgaatcacaaacctgtgaaaatccacatttataattcagaggctagcaccacagtactaccaagcggctatgcttccttaccagcaaatgtgctttgcatgttattaaaaataaacgtttactttcttagtgccccggattatagttacagttctaaatgcattaaagtagtgaaatatctatcacggtgtatgccacagggaatcaaactgatttccaaaataacattcataagaccataataagtctaataaagcctttcttaaaaagaccctttctaaggtaagcatttggtacttggcccctttaattagctcaggcatctctaggtttgtttgaactgagacctcattttcttttagtaataattgtgttactgctttgaaatgttgatgaaaatttaaaggatttctatttttcattagttctaaatcattgtctcatagttttctctctgcaaaattctttgaaaattgtggtttacatgtagaacacaattaggagctcatgggagcagataattgctcatattaaagtaggccaaatatgtggcctcctggacaaatagatgcaagaaatgattaagattagatttatataatttttaatgtagcaatgaacactaaagaaatgaaatgatttatttcatgaggaaaaatgaggtaaaagaattatctttatcttctattataaattatgacacattcaaacatattttaaaagagaatagtgaatttgtatctcttcaaattgacatattcacataatattaggaattatgttgctgagtcagatccttgtatgacgtgcagccttaaggtggtttctttgttttttagtaaaatacgaaaatcctattgcagtagacatattgtagcagggggataacctggactggacttttgggatattagtgtgttctcttgcattaggctacatttgtgatcattaattagtattttaccttctaatctttcaggctaaatattgaaattgtctgtcttttaagttttataacattttgcttgctggatttcaacacaatttccttctttcagccgaccataggtaatgagttttgtgtgctaattttttttttttttttttttttttgagacaggattcctactcccaggctggacagggtctcccaggctggagtgcagtgtgcaatcatgcctcactgcagccttgatttcccaggctcaagcgatcctcccacctcagcctcctagtagttgggaccacaggcgtatgtcaccacacccagattattttcctatttttattagagatgaagtcttgctaagtttcccaggccattcataaactcctgagctcaagtgatcctcctgcctgggcctcctgagtaactgggaccataggtgtatgttatcacaccaggctaattttttttttttaattttgtagagaagaggtctccctatattgcctaggctggtcttgaactcctgggctcaagaaatccttctgccttggcctcctaaagtgctgggattacaggcatgagccagtaatacaatgtaatatttacatattaagtatttttagtacaaggctgggcatcttgtatttttagtactatgctaaatatttgaatatttttagtacaaggctgagtgccttgtagttttagtattaatacaaggcacccagccttgtactaaaaatatgtaatatgcaagtaacattgaataaatctcaaatgttttccaaagttatcagacatgatatacaacaaatatcagccatccttgaataggttggcactcagcatcaaattttgttgataaattgagtgatctctcattcaaaatcattgattcatacattcagtcaaaaatatttattgagtacttagtttgctagctttggggctaggtgttggaatcaatggtcagccaaaaaggaaaaaaagaaaggtatagttcctgtcctcatggtacttataatctaatagagggtgatagaaatcattgaaagattggtataaataaatatacagctaaagcacatggtgatatacatgctattataagaggacttaatgagaattgacttggtgcggttagagaggatgactctgaggaagatatggttgagctgagatctaaaggttaagtaggaattaagtaaagccaggaggactcagggtcgggggacagaaagcatggctggtgaaagagaacatcatctgttaatgtcttgaagcagaagggagcatgataagacactaagaagctgtgtggcagaaggaagatgtggattgttcagaagacaatgagacagtggctcaaatctgtaggtgttgcattgtgtatcatcccctaaagtaatgctatggattttagccaggattcaaagagagctggaaagtaacagaacatcctatgtaggaagctgtcatcatgatgtctaatagttcttgagcattttcttttcctataatattgaatttttatgaagaaatatatacaacataaattttagctataaagcattaaatataataaagactcatgacctcagccaaatgaagaatgagaacattacctgtaacttgtgtctacatatgtgttctggcctccccttccagaggtagctcacgttttgaataccatactgcatatcttctaggacttccctttttttccctgtcatcattctatttctaacattcatgaaagtagttgtgtgttacggtgaggctctgtttaatccatgtttactactctataatattccagtttgggaatattctataatttatttgtcaattttcctgtcacttgttatttgggttgattccaggtgatgttttgcttgttgtttgttttgctattgctatcatgcagatataaatgtctaggatgggatactatttgtttccttgagcatgtttcccctgggagtgaaattggtggctgagagcatacattgatgtgatttccaaagtagttgtaccaatttgcatcccacattctcttgatccatgtcctcttcaacacttgattttgtaagacttcttaatttttgtcaatttattgggtataaaatggtgtctccaccattttattagcatttctttgattaccaatgaaggtgagcattttttttcatgtttattggctgtatgtgtttcttatatgaaatgccagttcagttcttctgtcagcttttctacaagattcttaatgatttataaacactctttgtatagtcatgtattctgaataccagtcatctgttgttttgcaagcctctgaatgttaagtgagcaatgacttagaggggcatcctgtggatatggagagacatatggatatgtgttaggaagcacagcctttccactaatgaacaattgttgctgataataactttataaatatacttaatacatttcttgtgttaaaactaaataggagggaaaatagctcttttcccacagaacatggaatattggttttccatttaacactacttcaaggaaaggctgtctaaattatcttctgaagaattctgctttgtacatgtaataggggtgattgaaacctatccacaagtaagtgttatttttaagaaattgtagcatactgatcaaattggcttcaaagtagtctttcacaaaatgaatgctgtttttcatttgccttctcttgaaaaattatagaaggttggagctggatattgatgtcagctgtgaaaaccatggctgtcttgtggcactgggcattgtaatgtcctctttatgtcatcaattgtacaagtcttccccagattgaaacttattaatgctttcctttaaacataaaataaaatattacagtagctgtttattcagtacttgctatgggccaagaacataaagcttctcctatttaatttcctaatccttaaatagccttgcagtgtaaatattattatccacagatggggaaactgagccttggggcagttaattaaaattctttagatcacaaagccaataagtggaagaacccagactcaaaccaatcacattactctctgagacatcatttccactaaggtccactaacgtgcattgtcattgccaatgccgggagcattcataaactgaacttcttatgtattaaagtgtgtatagatattatctcatttaattctcaaggtttccctttggagttgtgccatgtagaactcctctattccatggattccatagactgtcctatctgaggaacttctaaatgtattctgaatttattaaaatttagcttcatacatattttgtcaaatattgcattgattgataagtaataccagtgccagttttcttcctctcttttaagaataatctatttctagtattttggggaaaaataatgaggtctttgtctctcacttaatccgtgtgtgtgtgtgtgtgtgtgtgtgtgtgtgtgtgttggtggggggcagtgggtcttctaccccattgtttccttgccagctcttcggagccatgcactcgtctcactgccctgtgaaccagccacactctcttgtttgtgggtcaggaggtcacagcttgaagatcaaggactgcactactgttgagaatgcaagaaactccatagaaacaggaaggccaatatagagcaggatagtgctggtgatatgtccccgtatgtattgttcctcatctcctgtgacaccaccttccaaagttgtgcctgtcttcactaaatgattatggaaatataacagacatcacagaatctggggatagaactttaaaacagcaaactagttacaactttccccattgtctaggaggaagacctttctcccactgaagttcatattgctattcagatcagtgtcagtcttctcatttatttaaatctcattccatctcctgctctttcctcttgtactctctgggatgcactgtaagctgagtccattactgagttacatactttgccttaccccccactcagcaacatagtctttgcagaagctttgaaattacctcttgaagttccattttccccagtctttggtgagcatgcacacgcctgcactgacagcactgatttcattcttttcagtaacaaacagtactctagtaggtttttatactgtgtaccagggactatgggcttcactttaatgattgtgtgccactgtctttgagtgtgattttatgaggcactgatttatgttatgtgaatacagtcattttccttcattaaggagatggtatctaaagcttgtctgctcacttcttgcttacttaccctcctctcagcttaaagtcagaagactgcttattctgaaaactaaacaattacaagcagtaaaatccattcttaagtcctattggtgagggattgcataagttctcaaactctgaatttcagcaaaccctgtatttaaaatggttgaggtagaagggtctgttgggtttcatgttagttagtatgcttcctggaattcaaatactgggaggttttaattaatgccccaaggaaaacaaatacagtttgctttattccttgctatctatggagtatagaatcatctcctaacaaaaccttctcagcaaccctgtttgtcttgaggctaggatatttgataaactcagagtggttattgaagtcactctttcattcagcagcagcatcaaatatttaaacctcatcatttactgtttaaacatttaattttcaccaatggaatcaaatggtctggtgaggattatttatattggaaaacagtgccatatgtttcaactccacatatctgaaaattctttcagcatatgctgcagaattgctttttgcatccacttttctacttcctgacacatggtagaaatgtaataaatgtctttacaatcaataaaaacaaggaaagaagaaatttggaagtaggttgccattatggtgaatgaatatttggatctaacattttccacagtcttgttttttcacaaggctctttactagaatcattgagacatcatatatttttcaagattgtaatgagtatgtcattgtgttgatgagaagagcatcttctgagtgcacataactagtcctgttgaaatttgtgtttcctgtcttaagaaagctaggcaaaggcaacagggagagaaattgacttacaacttcttggacagggagactaagatgttcaaatgattaaacagctagattataggagattgaccatattctcccgaaggagttatctgaaaatatagttgattataacgatggacagaatatcactccacaaagatacagttgttacattaatgtattgaaatgagaaatgtacctttttacccctggcaattcaaatgaggaaaaatacctaatcagacgtattgttactaagccaaaaggttacagaaacacaaattatgctaataccaagtttaatgttaaaatgggactatggggagactaacaggtacctatcatcacctccttgtagatcttgtctcagctgattggcagcttatcatgaatctttgaggataagtcttaaattgggcatccttagtttgcagtttttattacattttgaatttctagttgaggacttagttttctaggatgctggttgtgttttttcatgatatcttgattatattttacataatgaaaaaatattactttagtaaattgtttttctaaggggatgggaatgaatgtgggtagctatacctcaaatatcacacatccttgaactcttcattcctaaggctattaactccccattaaggcaaacagagttgtgctttctcaaaaatgaaacaaaattttagtcctttctaggatgcataaatttgattatcctttctatccatgaaaggcaatgatttctgaactttttaatttttgatgcattggactcggtgtaacagggagtgggtgggaaaaacccaatcctcccagatattcacaaaccatcagcaggacttctctggccacaaaagatgtctttttatggagatattttgttgtaatttcagaaggtggttgttagttttcttggctacattacatttagcacatctgggatgtgttcacatgaagacattggctaaaagtagtgtcttgtggcctggaattgactctgatattgaaaaggctgtaaaggacattccttgcttgtcctcactcagcaaagagaccttccatgggaggtgcatcaggaatgcattttggatttggagaaccagcacagaagtcaaacttcttcaactgtggtgaaattcttttcataatggcctaatgtgcttttagttcttccctcatttctgccatggcaattatagctctgagacaattatttgcaaccctggcaccagaatttctgacaatgattctacagttacttttgaattaaagtaatttggggaaatgactcacatttaagctaccaccactgcacagatagtgcgaactatcaagaatgccccaaaagcaaattgggacacagtacatgtctctcaccgcttaagtcagaactggatagttgacaagagaagtcagtttctgctgaacttgtgatgtagcaatatctgaatttttttattcttaaatgaagattactaagacataacagaatcttgttctgtttatacctattcattaatcatttttagcaccagagtttgtcttagcacaaaactctgaagtttgaaccaagacagaatttgttccaactttagttgaagttgtaagggtacattttatatagtgaagtatattcatgctttagggtgactttgccatgttagctaataagtatataattttaaggactgattaatagttaaaaagctaggatttaggggcagtttatcatttattatttttcacattttcttaatatactggaaatttatttcacttttgtgggaaggtttggtataacataagaaagtgtctgcaaaagcactttgcaagttgtagactgttcccatgatctggataatattaatactagcagggataacatcaacaatgtacaacttttatagcacttactatgtgtttggaactgttccaagtactttcagtaaattttaactatttaattatcacagaaatcctctgagagtagatattaacaatttcatttgacaattgagggactgaggcccagagtgatgaagtaacttgtttaagatccccagttagtatatggcatagaggggatttaaacccaggcagagtggcttcagagtcgacaacagaaaaataggaagcccctgccttttctatggcagtctgaatattacatggtgaggaaatagatgcttctaatggggctataattgaataagaagagtgttactcgtttgattttgatgtctatgaatctgataggcactgtgattatatctgccgaagagaatttaaaaataatcacaaatatgatgcttatttttatttggtgtgacataattctactctttggttggttttcaatagtttcattattctagcagtataaacgacattttaaaaagtaaatggtaaaaaagttttctatttcatctttaaaaaaatttatttgtttatctgttggttgggttcttgtagcagtgtgataaatggtgtgattaaaagattcttccagggccaggttcatgtctgtaatcccagaactttgggaggccaaggtgagagggttgcttgaggccaggagtgtgaggttgcaatgagctatgattgtgccactgtactccagcctgggcaacacaacaagaccctatctctaaataataatagaaataataatacataaaaggttcttgcagagactaaaaggggagctagttctcaagggttcagtcctcttcacaataggttccctttcagacagtgatgctgacttgtgcaatttcaagaaaaagtcctggattttcacactgtcagctttagttattacaggtgggccaactgtcttctacagggttagagtgagtggtctgtagaggtgagatccatgaatagtacaacaaactgagctactctttaaaaaaatgagtgcttcagttaatgtgacctcatatttttctccccaacttataacttcaaccctgtagtttatgggtctaaaagatttttcatagcatctccttctactataatgagagtcgcagtaattacccaaaggcgttgactccaaagaaaagctttgttttgtttttcctttccttttggaagaaattttctttggccaggtgaatttaattcaactcaaaggactttctcttaaaaaaagaaacagtaaggacgattttcatgtcttatgtttcttctaggtgctgcacttaagtgttatcaggaatagtaaatagtagagttgtattccttggtagaataagctgttatacttcactgtttcttttgagactagtcaccacctttacttactacaccccattatgaagaggtcttaaagaaagaaaacatgaaataggaagcaataataactgtctatgttctaagaatttaagtaccaataaataaaagttgttacaaggataaacaaactccagacactctgagtgtctattagaattcttggcactgaccgggcacggtggctcatgcctgtaatcccagcactttgggaggctgaggccggcagattgcctgaggtcaggagttcgagaccagctctggccaacatggtgaaatccagtctgtactaaaaatacaaaaaacaaaacaaaacaaacaaaaaaaattagccaggcgtggtggtgtgtgcctgtaatcccagctactcgggaggctgaggcaggggaattgcttgaaccagggaggtggaggttgcagtgagctgagattgtaccactgcactccagcctgggcaacagagtgagactccgtctcaaaaaaaaaaaaaaaaaaaattcttggcactatgacatttaggacatgttagttgagtgttaactgtgcacaaggcaggtctgtctgatgatcacataagttagtagacaggctatgccatgtagagcctcctcagagtcgacagctcctcttatgcttccagaatattgcattcatctcattgtaaactctttgagggtgggttatatcttattgacttaaaatggtgcctaaaacaattgaatatcataggagtaaaggtaagacatagaaggctttgtgggcactggtggctcatgcctgtaatcccagcactttgggaggccgaggcaggcggatcaggaggtcaggagatcgagaccatcctggccaacacggtgaaaccacgtctctactaaaaatacaaaaaaattagctgggtgtggtggcgggcacctgttgtcccagctactctggaggctgaggcaggagaatggcatgaacccaggaggcggagcttgcagtgagccgagattgtgccactgcactccagcctgggccacagagcgagactccgtctcaaaaaaaaaaaaaaaagagagagaaatgatcacatggttcaatttggttaaaatataatgtaggaagactctattggaagctacagctgaaaggtagaatgggcaggatttcatgtcatttgacatttcaaatcattatcaagttggggtgggggcgggtagtaggtgatcccttaaatttggagcttaaatgatgaaaatgggtgtgatcttcttttttttttttttgagatggagtctcgctctgtcgcccaggctggagtgcagtgtcacaatctcggctcactgcaagctccgcttcctgggttcacgccattctcctgcctcagcctcccaagtagctgggactacaggcgcccaccaccacgcctggctaattttttcgtatttttagtacagacggggtttcactgtgttagccaggatagtctctatctcctgacctcgtgatctgcccgcctcggcctcccaaagtgctgggattatgagaatgggtgtgatcttcttaaaagaaattaaaattaaggggaaaacatttgaaagagaaggaatattctgttctgaaaaattgagtttgagatgccagtggaacctcaagacacaggtaaggaaatctaagtggaaacagaataagaagcttaggaaagcaaggttcaggctggaggaaacagatttggcaggcagaccagcagaagtgattgtgcaactaaggagaagatgaaattgccagccaggagaggagcacaacaaaagaactgaggataatacctaaagaacttgagaaagaatagccaaaatatgagaaagtgaatgagcaatgagagctacatgtcacagcatgaaggttgggtgcagcgggacatgaagaaatggctggattttgtagccaagagttgaatcaggtgttgctcaatcacctgttaactgcatgatctgcagccaattacttaagctcttgggccacagtttccttacctgcaagatggaaataacacctctgtagttatgttaatttaaatagtttaaacaagtattccttaaataatgcttttaaatcactctttttattaaaataataatcaccaataaaagatttggagttatctgtgtttcttatgtacatgcaagcaattatattacaaaatgtattattttaaaaatgtcctgtagtcagtacaaaattgaagacttaggaagttttggattatgtaatttgtaaaggaatacactgtcttttgcccacagtcttctgaataaagcattttggagtttaaatataattcagtctgttttatcaaggttaattttttgagtacctgctctgttccccactctttttctggctattttgactaaattcctctacctaagccctttgctttccaattcttagggtgtttattattctgagtcttctttaggcaactgatactccccaactctggaaacttcagcttttgaagcaatcttaaatttttagcatttgtgatttttctagtacattctattgaacacactcttttatttttgacagaataaagttatatttaaaactctttattgagttatgattaattgacattcaaaaagctgtacatatttaatgtcttcaacttgatgagtttggagataagtatacactgtgaaaccaccaccacaatatctgccataaacctgttcgtcacctccaaaaagcttctcccaccctctttatttattatgagaagcaaaatgattattttattgggatgcatttgtaaatttttgcctcagaaaatattatctgatagaaagttaatttttccatgcctcaacatcattcacaaaatgcatttaaagcatttaacatactgacatttttcacttttattagaaaagggaacagtaactctttgttatccttcttattagggtaacacattaagaaagatacttctgaatcgatactttaaaggtgattatagtattggtgtgaatggacacctatcaggagcctactccaaaactgcacaggtgggaggtaagtcctgtcatttgttttctcattttaggattctcatgatacatcttcatgtcagtgttactctagtattttactgaaatggcagatatataaaagagtcatttaaaaatcactgttaaaaactttcatacaatttggggctcataaaacaacagatttgaacatcagaattgattttgctttttgaccttggaaaaatagttaaactaagttataatctcttaatgtataaattaaggacaaaataaagctagttttctctttctgtttttaagaaaaacatttaatcacatgtgtcaaacatttaataaagagttctatttttacaaactttgatatttttaaactcaagcttttttttttttttttttttttttctgaggcagagtctcactctgtcacccagcccagagtgcagtggcgcaatcttggctcactgcaacctctgcctctgaggttcaagcaattctcctgcctcagcctcccaagtagctgtgattacagtcatgtgccaccacgcctggctaatttttgtatttttagtagaattggggtttcactctgttggccaggctggtctcagactcctgacctcaagtgatctgcctgccttagcttcccaaagtgctgggattacaggcgtgagccaccatgcccagcctcaagcttctattatatttaactttgtagggaaaaaatctcaatgattaatatttttattaaaataataaaatttaagaatttgaaaaccttacatattaataatgtctacaattaaggtttatttatttatttttcccaatcacaggaagcttttctggacaagattcagataagatggggatatcaatgtcagacattcagtgtctgctggataaagaaggtgcatcagaacttgtcatcgatgttatagtgaacaccaaaaatgacagaattttttcagaaggcattttcctcggcattgccttgcttgaaggaggaaatacacaaacacaggtacttgttcatcaatcatggggattacatttattattggtatttcttgtttacttgtcacagaaaccaaggaaaagtaatgtgtttcttttagctcttattactatctaaaaaaaaaaaaatccatgtatcacacttttcttaaatttgtttgctgtagaaactacagagcttcacaatttattcagtcaagcagaacattcctctgaaacttccttctgacattattccaggaattccacaacagtgagcaatatgctcacctgcacacaggagattaggccactatttccagaaggcacatgttttcttttgaaacttctgccaagtggcccgtagggttgacgacacccaaaagcaaaacatgctgcatgagcccgagtgctggggagtgttcccagatgacagacattgtcctccagtctttttttttcatttatcattatggttaaataataataattgtacatatttatagggtacagtgtgatattttgatacatgtgtacaatatgtaatgatcaaatcaaggtaattagcacatctttcacctcaaatgtttatcatttctttgtgttgggaacactcaaaattcacttttctagctgtttgaaaatatacaataaatggttaattatggccaccctactgaggattagaacacaggaatttattcctcctatgtagctgtctgttttgctgctcggtagcctgctctttctaggtttgccttggtcagtaaagaaaactgtctacttactactaagtatataattagaaattccaaaagccattttctcgactcaaggccagcagaagccatgtctaatttgaaactgggatattgtgcttcatttaaccatcaaatacattgaacaataggaacattaccatctaacacatccaatcacagtggctttaggagtaaaggcctcacgagcagcaagtggcatggtgacaaaaacaacgctaaatcaatagtacttagttgagaaaagaaagtgtttaaaattctcatgatgctgtagctgcagcatagatttcctctgagggaatttgaggaaggaggtgatggaggaaattgagtgagtttttttggaaattatcttatctgaaccaggtattcagttgggactttttaaaatttaatttaatttttaattgacaaataatcattgtgtatatttatggggtacaatctgatgcttttatatatatatatatatatatatacacacacacacatacacacacacatatcgtgcaatgatcaaatcaggataattagcatatccatcacctcaaatatttatcatttacttgtagtgagagcatttaaaattctttcagctatttggaaatatatagcatattattgttattaagtatcattgccttgctttacagtagaacaccaaaacttactcctcctgtttaactgaaactggactctttgaccaatgttccactgtctacgtctatgacttcaacatttttagattccactatttcacttatcaatggatgaatgatttttaaaaatgtgatatataaacatgacagaatactattcagacttaaaccaggaagttctgtcaattgggactttctagagaaagtgtccagtcaaccacataacattagataaaggcttgttcagtggatagaagtgaaggattttttttttttttttggtggggggcatctctagaagatatcctcaggattacagtcttttgtagatttctgtttctaggccactaagggtcaccagatgggatcatccttcatccttcgcacttatttatgcttacttatatcctcatattgctggggaataagccagctcccattggaaactgcaccttctacttataaattcctggcaagttgttcccctagatctcttcacaaccgaaatatttttcagtccttctttacatgattttctgtggcatttgccactagtgactttttctttcttcttgaaaccttttctgcctgggtcttgggataccaccctctccagcttgtcttctacctcctaccatttcttcttagccttctgcaaaggtttttctccctctacttaactcccaagtttctttggactctctgttctcactctgtgtgttccccaccctgacctccttcatttccacacctttaacgtttactgtgtttggatgcttctgaacttactgacgttctagactatgtatccagctgtcttccagaatatttagtgggatgtgcacaaatgccttaaactcaacatgtctcacatggagtctgctgttgctctccatacacgcactgctccttttgccattgcctctctcagtgactggcactccatctacccagttgtctgaccagaaaatgatagtcatccttgaccttaacttgtccacccttacttactctcttcctgaacatcccactgatgaccaacttctgtgattctgcccccttaatatccctcatatccatactctattattttcaattcctgcttttccagctctcactacagattctccttatcttttcctagacagtgacaagtagtcttctaagaggtgtccctgcttccagttttgcccttctccaaatcattctccgtgttgccttcaaagatgcctttttttttttttttttttttttttgagatggagtcttgctctgtggcccaggctggagtgcagtggtgtaatctcggctcactgcaaactccgcctcctgggttcacgccattctccttcctcagcctcccgagtagctgggactacaggtgcccaccaccacgcccggctaattttttgtatttttagtagagacggggtttcactgtgttagccaggatggtcttgatctcctgacctcgtgatccacctgcctcagcctcccaaagtgctgggattacaggtgtgagccaccgcacccagccaaagatgcctttccaaaaacatgctattcttctgcttaaaatatgtcacctgccctataaagacaaactccctgctacagtccataagatacttcatgatctcttcaaattttccaactttcccttgttcttccaccctcttgcctcctccatccttcctcttatgcatcagctacacttagctctttgccattcctcaaatgcgttgtgttatttctcatgctgctttctcctctttgaggattcaactcaatacatttctcctagaagcctaggctccatatctcactgggtagaattgattactgcttactatgtgcccctgttataacctgtggatgtctttaatgacatttctaccactttgtttgcttgtttgtttgttcttgagatggagtttcactcttgtcacccaggctggagtgcaatggcgcgatagcggctcacttcaacttctgcctcctgggttcaagtgattctcctgcttcagcctcctgagtagctgggattacaggcacccactaccatgcctgactaattttttgtacttttagtagagacagggtttcatcctgtggccaggctggtctccaactcctgacctcaggtgatccacctgcctcggcctcccaaagtgctgggattacaggcatgagccactgcgcccggccatttctgccgctttattttgcctcttcatgtgtgcatcaggcttcgtctagtaaattataagtccttaaaggttgaaactacgttttattcatctttgtaccccttgtgtctggaccaatcttggggttcagtcaatgtgcagaagtgaatggttctgtgaatgaatggtcctaattaaattctttcttcttcacaaagtctttcctagctgtctgggacatttggtgtccattcccttatctcagcttccatgcacttgtttctttaataccacttggcattttgcatgtgctactttgtttggttgtaatttgtattataccctgcctctccaattgaatttcaacttcttcagtataggggatcatatcctattctttatgtctacagtgctttatagccattcaacaaatattttttgatgaaacagcattaaattactcttatatatgaaaaccttcttttaagatggattatgacaataaggaccagccttcctctactcggatgtctcacattgtataacccagatggcaactatgttttcctggctctaagaggtctagttgagattagctcaaatcttattccttgccctatagcagtctaaagcgcactcctccccaagacacttgccagttccatgggggttttacattctcactgtctccttagccaaaaaagtcttgctttctcagcacataaattcttaacacccctgcttctgtcatactgagaactgcagccccttcctttatttcttcctttctaactacattaagtcaatgtgtgtatgttctatactttgttaaagatcaactgaaggagaaggtataggaggtacttatattacaatttcaaatggaacctaatgatagcaataagaaaaattatacctactaaatataaggcgctgttctttgtgatttgtatgtattaacttggctaatattcaaacaacctgtgaggtaagtggtatgttatcctaccttactgaagaagaaactgagatagacccaagcttacatcgctagttagagatagagataggtttcaaaccgatgcagtctggctccagattctgtgctcttagatgcaataagcatctcttttctagaaatagccatctccatcctcaccactaggatatttcacttgaggattctccctgcatcatgctcttgtctttctccattctcacttcccttcccttctctgcctcttccagtctcctgtcacacatatctgttgatccatcccccttagctccaaaacacttggagtttctttccccttacactctatgcagctaatggaggtagtttcctaagcaaaaatcatgtctttagtgaaaggaatacttatgctacttgttgagattatataaatatatatgaaacctacttttcctttttaaaatcgtgttgttcagcattgtagatacctcgttcttaaaaggtgttatctatgtaaataatctagcattttcatcgtaagaggttgttttatacatttagtgatttagagtcagaaaatctagatttaaatcctagctctaccccttactagttatataatgttgggcaagtcactcatctttactaaacctcattttatgaatctataaaatggaactaagagcactctattcatcacactgttgaattgaaagtatctatgaagtaatatatatagaagaactacataaattatgaagctttgttttaatagagccacaaagttctcataactcctcattaatatactggaaactccttccaccttctaaccccattatattgaaaagatttgggctttatcatctgcttaattcatgggattgtagaggtctgtggatgctgcatttgttgtttgaattaacaaaaccagcttgactgttttactgtggttgctatggttaccgtgactttttggccttctttcttgagggttgcttgccctctgtgtaggagcttacccttgtaggtgtgcagctgacatctaaggcttcataagacactctgtgtatatacattgcccacagagaaaattgcagggtaggcaaccatttcaagacctgatgtcattagagtctcagttacagatcccaagacctgtgggtcatgtttccaggaattcctaaaggaaagcatatcctggggcaaactcccccaaactggctgtttaaatgttcttatattggagtagggccagttctgcttgatctggaaattattttttcttatgttttcttcatactatctctcctcaagcttatataactcttttattcactacagttagggagttattatctttattaatttacaaatgatatttatcttgtttgtcttgtatctatctcataatcttggtagtaataagttataattcccccacccacttcaaattctgtcttctctggaatgtgttatctttcctacctcctactgcttctcctggacacttccataaggcattgagcaggcaagaattagggtaaatcttcccaaggttgaatatttccacatcttacaaagatacattttatcatacttttgtttctgaaccatttctacatcattattgactatatttattttaaggtggatttgtctgagaccccatgcaaagcaatgtagctaatgaggaaccaaaagaagttggtacctgtttatcagtgagatcccatgagtgaggctaccatggtaacactttccaaattaaatgtgctgtaatttagataaagagaaaaatagtcctttgtaactttccataaactcatgtttatacaggatgatctttggattgatggctattttccactttagattacaaactcatgagaacaaggattgttgttggtttccatttttgttctatccctattaacagagggcttgacgcatagtaggcactcaatacatacatgttgaatcaatgcatgactttataataatataaaaatcaaagaattctttccatacaacttcttacaatgtccctgtaagtttttaaaaatatataaccagtaaggataaattaaacagcatctgaaaatatgttggagtttagtggaaaatgctaagtaaataccaactattattagtacacattaaatagtacaagaaactggcaaaggctgtcaatttatgaaatagtaatgggtggtgcattaagtgtgtgcttttgcctataatgcttatgtttagttcaagcataaaaacaccatttgtctccccttgggtattgatgtcttaaaatatgttttcttgcagtattctttctaccagcagttgcatgaacaaaaaaagtcagaaaaattctttaaagttctctatgatcgaatgaaggctgctcagaaagaaataagatcaacagtgacagttaataccatagatttaggtaacaaaaaaagggacgatgacaatgaattgatgacatctggtccacgaatgagaggtaaagaagtatttgagtatttgggagaacagagtgagagaaaagaggggaatagcgtttaaatctcattaacatttttcgtctctcttctcttggtttaattatccccactgtggctctgatcatccataaagaattttggtcatggggtgaccctaaaacggctctgcaggactaaacttaaatgagacataatcagtgcaaagcaaccaacggcatgaaagatgtttgatttcattgtggcatgcatggtaaatagtaactgccccaaatcttttaagtgaccatgaaaatgaaactttaaaaacagaaattaccacaccaaactccaatgaaagattcttggtattcagaatgacaaaatcatccatgtattaaatacaaatcataaagacattaacattttgaagtttgtcacattttcttacctccttgaataagaaactcatatacatgaatatatatatgtatatatcagaaagacatgagtccttttaaaatttgctaagcattgagatcttttttatgacccactgcaaatttaatttttaagtgctctctcaaatcctttttggaaattgttgcaccttttgtcagattatttttaattcaattgttagagaatttgggtacctggtttgtttttttttttttaattagtaaaagcaaattggttcagaaatataaaagtactgctttgttttcagtaagagattcaacactacatttaaaagagggaatgaaagggcaattaacagaagcttcttcagcaacatccaaagcatattgtgtatacagaagagaaatggatccagaaatagacattatgtgcacaggaccagaagcgggaaacactgaggaaaaatccgcagaggaagtaacaatgagtcccgcaattgccatcatgcagccaatactgagatttcttcagttactgtgtgagaatcacaaccgggaattgcaggtatttgttctgttttgtgtgaaagctgagaatacaacctatgtttatcagtaattaaattcaaataaaaccaacaagtagtttcggagagcattttagaaagataatcaataaaagcaatagtgctcctctgaaatgggaagaaactttggtatcagtgaagaaaaggaagaagaaaatccttttatgcaagaaaaaaaaatcaggctcatacagtgtcatcctcctcaatatttttagcctcaaatatttttagcctcagtgggcatcctgtcttcctagtattctctggtaaggttatattgttgagagagatcacatttgtctcatctatatctttcatgattttatattcttaaggggctttcattattttcaagccaattcatatttcttgagtgagagtactgagtatatttgtatgtcttcatttgaaacagaattaacatagaagaggatgtttttaaccagagtgaaggtggatacattcaaaaatgaatgtagtcagtgtcatatcttctttcctgcattttcctttgttagataaatgaacttaggattgcctatgaatttctgaattttggcctcttttttgcattgtttgtacacaggcaggccaaggccagaaacattgcttccagagggacaatactggatcagtgcccatgggcctatcctaacccatttcgtctggcagtgtaggaaatagatgtatagggtgtataatacattagatagtatctgattgaacagtttactggtaggagtgtgggatcagtatagaaaatactacttttaaagttgtcttaagaagaataaatggtagatataaattcaaataaacacgttaaataataaattaatagaaataaatactaaattaaaatataaaacatgtttccttccctgcttacccttttactaggtttactccccagagaaaaccactgttaacaggtgattaatctagagaacttgactgaatattgtcagggcccaggttttttcttctagaaatttttatgcatgcataagcatatcgaactgtgcaggtaaacattttttaaaaatcatattctgtggtattccggccgggcacagtggctcacgcctgtaatcccagcactttgggaggccaagatgggcggatcacaaggccaggagatcgagaccatcctggccaacccagtgaaaccccgtctctactaaaaaaaaatacaaaaaattagctgggcgtggtggctggcacctgtagtcccagctactccggaggctgaggcaggagaatggcgtgaacccgggaggcggagcttgcagtgagcggagatgatgccactgcactccagcctgggtgatagagtgagactctgtctcaagaaaaaaaaaatcgtattttatggtattcctcaacttacatttttcatttagtaatttcggttattagtcaattacttattgccaggttatgtttattggtacatgttgaagtacctaatttttatagttttacagtattctaatgtttggatgtactattattcattaagccagtcacattaccatacatatgatatggtttctggtgttcgtataacaagcagtatgcagagaacctgttggtgtacttatgtacatatatctagaaaaacttttttagaagtggagctgtatgttaacttaaaatattgatagatacttccagttgcccttcataatgattatatcatttataattaatgaacaatgaagttgcactgttcatatgagattatttataattgaaaatttgcttctctccctaatgaacttctttctacctagtttttttttctctttttccgacttcccattactctttccctctctgtgtagtttgatgataatgacactgagaaatgtttattatgaactatcttgatatatatatacacatatatgtatatatacatatatacatatatacacacatatacacacatatatatgtacatgtatacatatatatgtgtgtgtgtgtatatatatatagatgcttggggaaaaacctaagggcgtttctccctccttaagtggaggacagttttaataaatgcgaatacttttcttacaaagaaaagttagaaaagcacacatatgggaagaacagcaaacaatcagcacagtgaatttttgtaacccttcaattttattttcttttgccttcagaacttcttgaggaatcaaaacaacaaaacaaattacaacctagtctgtgagacccttcagtttctggactgcatttgtggaagtacaaccggtggcctgggcctgttgggtctctacatcaatgagaagaatgtagcgctggtcaaccagaacctggagagcttgactgagtattgccagggcccttgccatgaaaatcaggtaaccagaagtatccatgactaattagtaaagggattaatttggggaaggagccaatctttgtgtgcacttgaaagatctttcttcttgctttgccagacatttttactttcctaataaaacatacaaagactgaattatagacaaggaaatactatgctgtatttgtagataatttcattgtaaaaacaagtcccatgaaaatgttcaagataaaaatcaacttactgaaaaaagtgaaatacgtgtcatgaccaccacccagttttcatctttagtgaacttttccaggatttgtggaataaactttctttggctcctttggcatccctacaaggagtagtatatgttatttattttatatgcacaataaacttatgaataggtatcattatttctagtttgctgatgaataggttctaacccaaagattaagtgactttccagagtttcagagtgacagaatcaataagttgtagagccattcttacaactaaggacttttgattctgagtctaaatcgagtgctcttttgactatattacattttggagggcacagtttcaagtctcttttccagaatgtttgtctctgattttgttttctgggatatcaaggatatattgtgggagtagaaggcaggacacttgggtcaatcaaggtaagggatgccacctgaaagtttgccagttgactgtttcacctcctctcaggcatcatggagctaccatcgtaagcatggatcagtccagaagacagagttttcaagtcataaacatttctggatataaatattaaaaaagtcattgagagcaaacatcaacgattgacatagaaaattgtgaaaaagaaatttgcttttttaaacattgcagtttacatgagatacgcacacatacacacggtgtctatgcacacacacatacatttatgaatctatacacacatgtgtacatgcataggtgtgtacaatgaaaacaggacagttttggcataaacaatttgttatgggggtattttccctttctgtactgtacatatgaaataccgaaagagtttgtggatttttccctgcatttttctgggttatatttcagtctcccagagcaatgatacaagaaaacctaaatgttgatttaaagttaaggaaaaacatacaaattcagagatttggttttgttgttgataaaaacttgtacatctataatagaaaataattataccatttgtctcttctgctgtttccaggaaagcttgtaagaatgttccccagttttggtctcataagagaatggaatagagctttgaaagtaatttactaaaaccaaataagttctaaaagtaaaagctaattttcaaataacatgaaccccacatataattccccattgctctgaaaatgtgtgggaggaaagattgctggcaaattctggagatgatctgcaaaaagattctctttaagtttgggaaatattttaatgagcagaagaacctcaggacaggtaggagatgggtagaaaacacctttcctctgtgtcagaggaataaaaactccattgtatgaagggagaaataaggcccatgctgaaaaagcagtcattttgaagttgtcttgattttggtctttctcatttaactcaccaggatttcagtttttcatacctcttgacaaggtgctacattgttaacacatagtcctacaaatctggctcgcaagttcctgatttaagacctgtaaaattaaattcagaaccccagcatggtcgatcttaaccttcaaaatgtggatatttatctcacaggatgtttcataaattttccccaatcaagattccctcatgtaagtttaagaaatccagtaaatttttccttcagccatcattattgacagcatgtccccaaacatcaggagagtctcatattacttgtcttcacttccacctggcttggacagcagcatctcttgtcatcagtttagcattaagtagcaacgaaattaaaatgcttcattggtaccataaaatttgcctacaaatctcaggtatgagggacacatgtctttcataaatgggaaaattcttttattgaggataattcagatcttaaaattctgaccttaaagatctcctctgttgattggtatattaaagtttattgaatggaaggatatttaacttaaccagtattctctgaaattctataaacacagttcattttaaaagatacgtgcttcatgcagtgtctcgctcagtgttctgcatacaaaaccatttgatcaatactaatcaattaattgccagaccctatacaaaagaataagtcaaatgctcaaaggtaaatcttacctattttttaaaggtcaaaaattaaggtgattatgttgttttatatcctgttagttctagtgctattctgttgtgaataaaatgatattttacaaatattttgttttctagacctgtatcgctacacatgagtctaatgggattgatatcatcattgctttgattctgaatgacataaaccctcttggtaaataccgaatggacctggtgctccagctaaaggtagagcgattccactgttcaggccagaaaagctacagtctctatagtacaatcttcaagcagctcttgtcaaaagcatattatcatgttttcaactaatcaattgacagaaagggatagtgaaagtacaatgcttactaaactccagatgcaatgtgaagttagctttgaggtaatattccatggcaaggtcctttcctggaagttttccaagcagccactgtgtttcatgacttcccttttgtttttatttttattttattttttattttatttttaactttactttttgagatgaagtctagctctgccgcccaagctggagtgcagtggcgcgatctcggctcactgcaacctcctcctcccaggttcaagtgattctcctgcctcagcctcctgagtagctgggattacaggcgcccgccaccatgcccggctaatttttgtatttttagtagagacggggtttcactgtgttggccaggctggtctggaactcctgacctcgtgatctgcccacctcggcctcccaaagtgctgggattacaagtgtgagccatcgtgcccggctttgtttttaattttatatttttcattatagggagaagcaaaaggtgctgatgtatttttaaaacacattgactacagaattccacccagaaagacacaaggaattagacaaagtcaaaggagtgctgcattttatttttatggttctcttctttctaaaagttgttctcttttacattaaaatttagtttttccccaaaatactttcagtgatatccacactgtctttaagaggtttctttagtttaagccttgtgcacagctcccagcagtttcatttataagagctcaggagcagaaattaatatacacactaaattatataaagcccaaatactaaggcatgatattcaattgagatgagctagtaaagaccacattattgtgtttagggttaaacaggaaaaaataattcttgcttaaattacaatttatctgtgaagccctgtctatccaagactattaagaatgtataattaaatttaactttgtatgggtaaatttatagccaagaagaataggaatgatatttttctaatcctgtttctaaatttaggtttgggtagtacaatggaaagtacatatgtttacgtgaagattgtgctaaaggctcttagtaagcatgtgcttctttatctttattttatttttttgagtcagggtctcactatgttgcccaggctgatattgaactcctgggcccatgtgatcctccagcatctgcctcctgataagctgggattacaggtgcatgccaccacacccagcttaaatgcttttttaatagaagagattagtttgtattttttcatgttttcagttgtaatgtgtataagcttctgctctttctattcatagattagcaaagacgattcttacatagatgtacttgtgcccctcgattcattaccatcatgtttcagttaatgaaaccagcctaggcctgtaagatagtcagcttaaattcaagttattagaaaaatttttgttgttttatcttaaattcatatttaaccataattcattaagaaacaacatagagaggtcttgatctttggcttttaaaatccttcattagtctaaagactatacctttaaatttcatttgtaattaattaaacttaatggacagaaatactgaatggctcatccatttaaaataaagtataagcatatagattatttacaaatcaaagcctatgtaaaaaaattaagtgagagggcatcacttaacagcacaaagatattattaactattcaaatgaaaatgctttttaaaaaatatatattatttaaatttttattgattttagtatgtacaattgctaccttttaaaaatatgacagttgaataagtcaaaataccaaatatagatttggcttgaaatatttaaagtatagtttttttttttttttcttagtgaatgaggtgtgtgtagttttctaaacaatctttgagggtttgtacacattggccaatataagaacaatgtttgtaagacagaataatatatattagtaaatttaagggacttccttgcatagggtactttaaataataaattatctttaacattaaaaagataccatattaaaaattattaaggttttattttatgtcattcattcctgaatttaattgcttaatcatccctaattttaagtatacttagctttatgtactcatttagtatgagattctattactttttcatatttgttgtcctttactttttattttcatttgcaaaactgagctgtaaatatgaagtgcttcatttgtaaataggtaaagatttgttttgttttgttttttcaaagaatctggcttctttaagaagaaactcctgcactaacactgatatttcatttgattttgtggtatatatagactcttatactatcaattcaattcatatttcattaggccgtttataagatttctattcttctgacataatatagaaaagaagattggctagaaaaaataccatattgccaatagcgttctgaaattggatgtatttttaagctatcatgtattgggcctgctgagggtaggttcattagatagcactgtcagtgttgccaaggttttagctttgaattccatggaggtctgttcagattactcctaggatttaagctctccactaatcctagaaccttactcttttaggtatgttatttatgtgggatactagattgtcgaagtggattttaggattggttcaagtccgcaaaaaaatgaaaatggagcagaaaaagataatactccctttcctccaaaatactgacgtcttttcataatgagtcagtgacattagtgtcaatcatcatcttcatcatcgtcactattattggtcacttaagatgatctttaggctgtacttctggggggaaaatagttggatagaatttgatgttaaaactacccaggagaattaatttgcacaaccttaacaaaatttgcatggtcattatttgtttagaccaaacacaattcagtttaattttcattctatgatatgttaactttgagtcacttagaagcatcttaaagccatgttaactccaattcttttgtacttctatcaaagattgtgtgtggaggttaagatttttatctaaatgaatattatgagcacactgtagaaataaatcctggatatttaatttcatattgcaatttgccaaaattctatgccagcactgttaaaaacacagcatgaagtaacatctttcaaaatgtttaggatattgtgctttcttggctaagattttctgtaactctgagtatctattttggattataaattgtatcagaaatatttttgatatctgtatgtagaaatggttgagataatatacttataaaacaaattagaacacttcaaagacaacataagctattttcattctttgttaagcaaaaatagaagatattctttcacaacccaaaggtaaacaaagttgcatatcgcctgccatatagtgagactaggaagccgttatcaataagtttatattatatttctaacacatggaatttgtaattttatagattaattctaattattgcttaaatttattttaggtttcgatttgctaatatatattaatatttcattttaacaattgtgctaaattctttaaattgtataccatttctgtaaaatatgttactgatacctgttcacctttttttttattaaaacatcattatgaaatgcctatttaggaaacagtgagggaaaatatgattatattttagtgtggtatatagtaagtcacttttgcatttgaagtaccttttcaccaatatttaaaatatctcttgtaacatagctctcatgattcattagttatattttgtgttgacaatggagtaagatgttctattttagaatgttaacaagacaaatgaaattagcagttttaaattccgtttgattaaaaaaggtcctagtaatctcaattaaaacaaatgcagagaaatcgttaatccatgaaatagactttgcatgcacattaactcaatctgtgtctctagaacaatgcatctaaacttttgctggccattatggaaagcagacatgacagtgagaatgcagaaagaattctttttaacatgagacccagagaactggtaagaaaacttttaaaagcttggtcaatattgggtagcctaaaaggaaaaaatttagagaatgcatgtcagaaaaaaaagttgattgattttcattgctctaccaagacaaatggaacatcatgacctaccattaccaatacctcagaaggccctgtggtgacaaaggcctgtgtgatttgggccttatgacttcagtagttttatccactctaagcacttttcttagccaacttatcacactatactaaactatatgcaaatgtgtattgccagaaaaaagttggctttggtttaatggtgtattggagcatatgaggaagggatgtaaaaaaaatgtttgtactcttcaaaaattttatttatacttatttctgaaaaataaaaataaaattaatattttttgtagctgttcttctcagtgatatgttgtacaatgcttggcctcaaggaaactgtgcatactctagtagagattccacagagatcattagtgtgtcttcctattgtagaagttatcttttctttctcactcgtggcatgcacattatgaaataatgcaggtgtattttaaaagcattgggttccaaaagcattgagaatgtactcacataatatagctcagtgccctgatgattaagccccactcacatcagggccattgttggtgctatgggcaactcctacgaaagtctggcacaacattcttttgctctcactttattagtaaagaatggagttgaggagggcagacaaaaagagagacaaagtgaagtttgatttaatatatatttaatgagagcataatgtctatctgcaaacagtgagttacaaggaccaacacatttcctatcctatggttaaatgtggcagtgaatcatatatttattcaacaatggcactgtgcaatagccctttgaaaatactagttcctctgtgaacaacacctttattctgtcatccccttcctccttgtggcccaccctccacctcttgcttgagtatatgcccctgctctgcgcttcctcagaaacatacatagccctggattaggaccgatggcaccgcactgtgtttgcctccttgcttgctgactctcccactggagagtaagttccatgagggtactctctcccatccactgttggggtcctcacttcccagggcaatttctagcaccatgtctgcctgttacttagtgggcacttagtaaataatggatgtttattggggttctcgattctcctaattcatgggaacttcggcactatcaacattcaaatatcaaacaaaaatttccaaggaaaaggggaatattgtaggaagatacttccatgttcattgaaataaggatggtttccaaggccattttcatttagagtccttttatacttttgaggcttatgaagctgcccaatttttaattaaatctcataaaaatataaagcagatgttgtttctggcatttcaatattctttttttttttggataggtggatgtgatgaagaatgcctataaccaaggattggaatgtgaccatggggatgatgagggtggagatgatggtgtttctccaaaagatgttggacacaatatctatattctggcccatcaggtgtcacattttatatctttacattattttgctcatcctatcaatcgtgttttgtatccatggcttgtcatattttcaagttctggtcccttcatttattcagcacttaccatcctaggtttgggctaaagagaggaacagcctcccagaatgcctgactatgcaccccaaggtatgctaagggacagtcttcaggaaaagagtgcttggtacccaaaactactggaccagaagggaggagacattcccatgtcagcctgagccatggataaaccatggcaaaaaatgagggtcctgaaggagaggggaagagaggctactggggagacagagtgtgaagtgagggggtgcattcagtcctaatcaggacaaattcggcaggtagtttctggcctccttgaattgtaggttgacatgctttctgtagaagccataaactggcagcctctgattggaagtgtgaggctaaactttaaattctttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgctttagccgggatggtctcgatctcctgacctcgtgatccgcccgcctcggcctcccaaagtgctgggattacaggcgtgagccaccgcgcccggcctttaaattcttttgaaggaactgtttccattttataacttaaacaggtgcctgatgagtactattcataaatttaatacaattaacatgaagatcaactttaaattggcatctttgaatgcaaatttgtttagaagttaaacattttaaatgtgcatttgccaatttgattttgtctatgatagctcctttgtttttacaaaatgaagttcaaactttagagacttgctctatctttctttctcatcattttctcccattggcaatcattcccttctgtttccctgtacgttttatcagttgattgaataaacattgatagatataaagtcagattctcggaagatttatttttaaggttgctctttagacatttcttatgcccttttctaccctttgtataactgtctaatatatgtgaacttgactataatttttccaaaaccttccaggaaggagtcagattctaaaagatactaacaaaagacaccactattgttttataatatatctggctcattgaaaatattttaaggtctctcataatgtatcaaaatacctatgtagaacagaaagaggtaagggcagatgacttatagctagacagatgagcattttagctgctgagcaactgaaagccaggatgatggacaagtggaaggaagcagaaagtggagatttaggatgtggaaaaggtgtcgttttagagagaaagagaagccatgtgacacaaagtgagtcaagctagcaaaggaatggctagagattgaatgtgagtagaaaggaaaaaatcccaggctgagaattaaaatcatattggctactagaatgaacacagaaacatgctgacccatatgtgtacagggtcaaggagttactttagaggctgtagcactgtggagggaagaaggcaaggaagacaagcaaggtcaaaaaggcaaggtcaaaatgagcagtaataagtttcagaagaagaaagtagggaagtagaaccacttctgttttcttgactgcaagatagtcttgctttgtatgggggaggttgtcttcttgcacgagtgagcagctgcatgagtaaaacctgactgtgtagctgttgagtggggaatgaacaaccagatgagctaagcttgccctggagccagcagagtgacagattggccagcagacaatgaatgaaccacctgacatccattaagaaatttaataaagcagtctcagatgaccagtgtcttaggggtaacagtgaaaatatcaaggtaaagaaaagacttatgttaggtaacttcagtttgaagcagactaagcataaaagtagaggatacaggccaggtgcaatggctcacgcctgtaatcccaagactttgggaggctgaggtgggtggatcacttgaagtcaggagttcaagagcagcctggctaacatggtgaaacctcatctgtactaaaaatacaaaaattagttgggtgtggtggtgcatgactgtaatccaagctgcttaggaggctgaggcacgagaatcacttgaacctggaaggtggaggttgcagtgagcctagatcactccactgcactccatcctgggcgatagagcaagactctgtctcaaaacgaacaaacaaacaaacaaaaaacaaaaaaaaacagagtacagaatacaaatttttaaaaagacgatgatacatgttgagaagaatggacaaagagggtaaagaatgcaagcagtgctcagagatggaaagatgatagaaaacataaagcaacctatatatgaaataaattcaaaatgaagatggcataaaggccaattattttaatgaatttgagtttattacagcgcttgaagaggagaatagacatatgcaaagatgatggtggaattgcccaaaaagtggaaatttagaagtagtaaaaaaaatgttacaaggcgttaaaacaacttgttgaaaggaagataaatcaatgatatcaatgatgtgaaaatgattggggtggatatatcgaagttgtttttttttttaaacttcccagaagcaaaatgttggaaaagcaatgatttgtagagcaacgaaggtccaatatagaagtagagaaacaaaggcagactcgagaagagagagaacaaacatcaaaacaaaagaaagtaaagagaaaaggagattctgaattgctgaatactttaagcctcatgattacactgtaagagattaaatattaaataagagtcctcatgagtccctcttagaacccaaagagggcataggtatggaagaaaagtaggccagttgtatgtaactgacagtgtagagttaagcaattgtccgcttattctattatagtgacacaaggagtcatttccttgccaccatataaatgtattctttatggggtaaccccgtcaccagtttttcatgaaaaattatgagctttcactcacagaagagagaccattgtgctctgctgatctttctgcaggtgactccttggctttctctaggctaggatgtcatatttggtttcttagcaggccaatccctaagattgtttccaagttcctcatgaatctattgtcctccacaaactcacaaggagtggttgcttgtaagcactgcttcagaagtggccatgtggctgtgctataggaatttggtagagtccagtttccactgttttcattgtggatatgcagtcactgggctcctgcaggcaaatgactgtgcaaattggtttctggctttgtacagtttagtaattccaaaaccaagatgcaacttcctctttgttttactataatcatcttttgtgcagacagtttattctggtgctctcagactttcaatttttgttgttgttcttttcatggtagtaaggtagttctgctttttctgccatgacatctcttttggcctttcctgtggttggtgttacaagaaacaaataatgcttcttgtaagtgtcttgtctgatctacataaaactataagtacctcaaaaagggaatttcttaacttctaatactatagtgttgtgcagagaatttccttaaaatccaactatgtgcactttttgactttctatcttctgcgtgtttaccttatgtctctctgccccatctctctgctttgctcttggtcttttatattcttttcttgctttctgtagagacagtcactatacacagtccagagcactgttcagtactttgtgtatgtccaatatatattaaaccatgtccaatatatattaaaccatgttgtttcattctctcctgaagcaatttctgttcctctgtctgagaccctgcatttaatgcctacctgaagtaagaagcatatggagaaatgttatatgcttttcaggttggggagaagtattagatagcaagctgtaggaagcaaaaataactcctggatcataaggcaagagagaatgggtcactctgattggttatatttaattcttttcaaaatgcaggcttgaaaatttttcatgagcttttcccatatcactaaatggtctttgaaaacataattttaatgtctacataattgttcttcatttgaatgtaccatgattcatgtaatcactccttattgttagacatttaggtttctaatgtacttgatattataaattacgctatgattaacatcctcatacattaatctttgtctgccacactgattatttctctaggataaattccaagaagtttaattactgggtcacagggtagtaactattttatggttcctgatgcatattgtaaaattgttttccacagtttatgatggtgcttgtcttactgaatcctaaaattatgaccatttaaaaaaatattggccaaactgatagtatttggaacaacaatgtttgctgagtgaattaacatatgatagatgaaaggagaatcacattttgatttatatcttttggattactggtaaaatggactatcttttaatatgttctttggtcatttgtatttcttctgtgaattactagaaagtatttatctcttattttataaggttcattttaatgaagtttaattagggataataactctttgtcagtcatattagttatatttatttcttactgatttactggcttttatgttttcagaataattttctttcagcacctcgagatcatttaaacactcacctagattttcttctggtgtgtaatgaattcagtttttgtatctaattatataatctttccatgtcataatgcaaaaataataagaagaaaagttctgatgcttcatctgtaaagacatattccaaaatttagtgtaacagcaatccatgagggcaggatttgcaggaattataggagggtgctgtagagcatgggtcacagagaaagttttagtagaagagattagggccaaaatctagccatcttcaaggccagatggggtatgtgaatgagtgatctaggggctggtgaggttgggacagtctgacgttcctcttccaaagcagggagccattactcacttccgctgacttgccagttgggcttgcaggccctggatttccacttcttccaatatttcaaaagaagcctatattttgaaattttgtgaaaatgtggaatctcctaacttttaaaagttggcagatcattcaagatttttacaaacactgaacaggccaaagaaaactcagcagcaagctgaatgcagccctcgatccatcagtttaccactgtggaggaaaggatttacatttcttgttctttctttcattgagtttcacagatgcattgagtgcttactagatgccaagcgctgtgccagatactaggaatgcagtggtaaagaagatccgcaacagatcagctctcagggaatttgcattctggctgggagcaatgaagagtagacaatgaaccagaaagataccagatggtgatataagctacgcagtgaataagaatagatcctggtgaaagacagttactagaggctattagagattggttgatctggagggttttctggggagcaatttagactagatctaagtcaaaaatcaaaagccagcaggataccatgggggtggggggtttgcaggggaacatcccagtggcttgaaagtggcaatgaacttggcatatttaaaggaacaaaagaaggcctgggtagcttgaacctacccccagccagctattagtacttgactattacactaatcacctacagttcacctcaggcttatttattataagatagtctttcaacaacatttattgaacacctcttatgtcaggcattgtgctagtttctaagatggaaagatgactaaaaatgcaatcaagaagctcacaatgaagtgtatataaaaggaagagcgagagagataaatcattataattgaatgtgtttgtcttaacatggaggttatgtacaagatctacttcccctaggagtcaagagagcttcttggaagaggtgacatttgaactaaatcttgaaagagagggatagaggaagacagtccaggcaagcagaacaacttctgcaaagagccaaaaatattttagggagaggagccaaaaatattttaaggagagaaacttcttttggtcatattggtagggatcttgtatggtatctacatatgtttttatatgaaataaactacaataatttgaattgtgtaaacatctttgataactgtaatgactctgtaggcacttaacaaatgttgcacaaatgagtgaataattgagggatgaatgaatgactgactaggacatgatatattctaaagctttgataatttatagtttaagtattataatttaaaaaactgaataaagatatttttctgttactatcattaccatgataaaagttaatgataatttctgccactggagcttacgtttcttgtgtacagatgcaattatcttttttttttttttctgtttctatatttgttcagtgcctagaatatagcaggcactctagaagagtttgaaggaataacttctggcaaaaatgcatgcatgctgataatatttctagataatacatccactatgtaagattaatagactcctacaatgcttataatagcattctggcagtccataatcttattcaactgctcttaactttctttttaattttatacattactctttgccaatattgttagtaaactctgtatcaacaggccctataatatcttctttcttgctaggcacttttcttatttttgttcatgataccatctctctcttttactaatagaatatctccttctgttgttacaattcatcttagtgttaccttcatacccttaagatccaaactgagagctacctaacacatttcctagataaaatacagccagcaactattctttgttttgaattcttacatttgttatgtccaactagaaccacatacttacttttacactaggttgtgctatatatcatcctggaattgttctttgtgtcatgtatgtcggacctggctactaaattagtagtggatctacaaaatctgggcacccaggaggccttatttttacaaaagaaactttccacaaagaaaaagtataatgggaaaaaaatgcctgggtattatagaatagatttaaatcctctaataggcacttacgtgtctttcactgagcaactaagaatctttgggttatggccatttaaatgacctctcaaattgatggttaatgggtacaataaaaaatgcaatctaggaaatggattgaaatgggactcactaattattagtttgatataaagatcatgaagtggaagcaattatttgtttgcttaacatcccttgtttgttagttacgtatttatttctgagtgacataattattagagcatcagtctgaattctagcaatgtaaaatgccattgctgtgtctttgactcctccttctgcctgcttttactatccactgaattcaaagtctaataggatagctggagatatcaggcaaggcttttatgattagtttttccaggaaaaggaaaatgcatagcacttcctagtatatttcagacccttgaatttttagcttatccctaatcaaagtcaataactctttcttaactttcaggagagagagagaaagagaaagagagagagagagagatagagaaagagaatggcaggaacagccatggcattttaaggacagggattttttatgtcatgctaaagaaattttttggatttcctgatagtcttcattaatccacttttttctttaaaaattctgtttctaataactaactacaattgcttgagctatattcattttaagggatatgcatgtaaattactccaaatagctaaagtttaatttatactgaaaccatatgaaatgtatctatcactcagactacttacagtgttttccttagagatttatgctcttcacctctttgcagcttccattttcttatgctaatatgtagtaatcagcattgcttcatttactttatttgtagatgcagaaggatggtttgtaattggatacataacttccatctctaatatctttgaagggttttaagtaacgtacaattacctcatctttattattgcttgtagtgcagaacgtagaaaacacagctgggtttttcaactcacagaggcacttgtagctcagtaatatgttggctagaatgttgtaccaagaatattatgcaaacagtttagctattattccacccctgcaccctgtgttttctctgtgagctatttacatcacttaacttctctggcttcaaccttctcatctataaaaatatgatggctgtcagtgagctgcatttgcaaagtaaactttcagagacttatgaactccagaaagtagttggactgtgatagctcttttactggattcaattatgttttaaataatgtaacaataactaatcagctactagatatttatgtatttatttatatatcatcattataaacagaatttgaggttgaatgagaaatgcatgtgtataattagcttgttagaatacaagatcaaaagccatgagaaggaaagaggatctaagtatacccgaggccttggctaacattcttacagtttatcagtggtagctctgagcttcttggtaaccaagagtataattgatacctatagtattcattaatgaccaactttttactggcatttaattcaggaaggagtttatgcaaggatatagtacaacacagtggacagaaccattctgcagaacgcaacagatgaaataatgcacatagctgttttttggtcctcagggacaatgatcaacacttctgatttgttagcaggagtgaatgtaattaatgttgaagtgtgtttaattcaacagccattatgaaaatagatattatattcaccttatagacagactttgataatgtaggacctttctaatatgtgaacttagttgaaaaaaaacttttgtaaacatgaagagattatcatattaaatcacagaaaatagacttatcctacttgcccaggtatgtgaaaatcctgctgctctcagtgctggggataaagtagtgagcagacacacccaaatccctttcctctgtgagcttacatgctagcaggaatgtctccctccttgagaccacatgattccttttggggcatgtgctttatagatgcagttgtggggtgggtagggaatgcacgggatacggaaaggaggcatcatctctacccccatggagtatacctttattacaggagggagacacaaaaacaaccacattgcatcaagtcctaggaaaaatgcgtatctgaggtgctctgggatcttaggttaggagtgtgcttaggaaagtgagtatggcagagcaagagagagagagagggcgccagagggagcaagaggaacagagagataccactttccctctgttctccctcgtttgatcatttgctcagcattcgtgcatgcaaatctgcttctttaaaaaaacctctagcccactggctcataacttgctgtcttttatagcaaaagtgctcaaaagattgtatataattgctatctccaattcctctctttctattctctctctaacccatttctgccaggctttcattttcaccgttccacctaaaccactcttggtgaggccaccagtcactgcctctttgaccaatctaaaggttgcccccattccgcatcttttgtcctgtcactaacatttgacacaattggccactctcctttctgtgaaatatttcttcacttagtttttgcccagcgcaatctcctgatctttcgttctgcttcactggctcctatttctttctctggcttctgttagaggtcttctagtcagaaccattccatggatctctggtcttcttaatcgacgctcactccctgaatgtcacttagtcacatgactttaaacaccagctgtaccatgataaattccaaatgcacatcttcagcgtgggcctgtcttctgcacaccaggcttgttcctccaactgcttgctcaggatctgcatttgaatgtctttttaggcatctcacacttaacattatccataatagaactcttggtcctcccaccctgtgtacaactcagataccccagacactcagactccatagcctcagctccttagcattcctgtagaccaagcctgggtggatgtccctcctgtgtgtgcccatggcacaccacgcctgctgtgatcatagaacatatatcaccaaattcacatggcctgtgttgacttgtctcctccaccagactccaaacttcataaaggcaggagttaggttttactcatgaatgtcacccagtgcatagtgctgtgtttgatatagtaaattgttttgattcattgagtgagagagtaagtaaatgagtggctgtgatagtcaacaagtgctgtagatcaggggtccccaacccccgggctccagacaggtaccagtctgtggcctgttaggaacggggccacacagcaggaggtgagtggcaggcaagcaagcatgaccacctgagctctgcctcctcttagatcagtggcgctattagattctcataagagtgtgaaccttgtcgtgaactgtatttgtgagggatctaggtaacgtcctccttatgagaatctaatgcatgatgatctgttactgtctcctgttcacccccagatgggaccgcctagttgcagtaaaacaagctcagggctcccactgattctatattatggtgagtacgtaataatagtagaaataatgtgcgcaataaatataatgtggttgattcatcccaaaaccattcccccccacgccccagtccatggaaaaattgctttccacaaaactgatccctggtgccaaaaaggttggggactgctgctacagatggctagaaaggaaataggtgaaataggttaatattagctggagttactgtataaggctttgtggtggggcttgcattttagatgaatcttatggattgataagatttagataaaccgagaaaagcattttcatcatagggaaaatatgcacagagatgggggcaatatttagcgtgctgtgcgtgtgtgagagcagcttctctgggaccttacatcaagaagagagaaagccctgtgttgcaactgtgggaggtagttagggagggacacaacctattgaattctgaaggactttaagtaccaaagactaattacgtataaatatttattgaaatgtgatatagtatacatttctgctaaactgttccttagagtacttaatttgtttttgtttgtttgtttgtttgttttttgtgttttgttttttgagatggagtttcgcccttgttgcccaggctggagtgcagtggtgcgatctcagctcagtgcaatctctgcctccctggttcaagcaattctcctgcctcagcctcccgagtagctgggattgcaggtgcatgccaccacgaccggctaattttgtgtttttagtagagacgggtttctccatgtttgtcaggctggtctcaaactcttgacctcagataatccgcccacctcagcctcccaaagtgctgggattacaggcgtgagccaccgagcccggccagagtactcagttcttacctctgttgccataaaatgaatgagactgtaatgattctgtaaaatgctgaacagaataatgcagagacaaatagcacagaagtctgctttagaaaatatccactaaccccaaagcaatgttataagtcttaaaatgattatttaatgattgtactgttactcatttataacctgacattattaggcaagtatttacagataaatcaattataagtgaacccatgagaaaatgtaattagtaaacacataagccaatataaaaatacttaggtcagatcactaagtaatattctgtatatatgggtttatgtgtgtacttgcatgtatctgcatataatatttattgattaacttatttttcctgctcagacataaacgaagaaagcttaactatagctcaggcaccgtggcttacacctgtaatcccagcactttgagaggctgaggcaggtagatcatttgaggtcaggagtttgagaccagcctggccaacatggtgaaaccccatctctactaaatatacaaaaattagccaggcatggtggcaggcacctgtaatcccagctactcaggaggctaaggcaggagaattgcttgaacccgggaggcggaggttgccgtgagctgggatggcgccattgcactccagcctgggcgacagagcaaaactctgtctcaaaaaaaaaaaaaaaagaaagaaagcttaactatatagctgacattttatcctgaaggcatgttgaggaagtatgagctaggacagaatgtcaggacagagagagccaactaattctcatttagtcaatagatccagtactataatatcaaagtgatgtatgaaaatagtttttcccgccaggcacagtggctcacgcctataatcccaacactttgggaggctgaggtgggcagatcacttgaggtcaggagttccagaccagcctggccaacatgatgaaacaacatctctactatttttaccagtggcaaaaaccgcaatcacttttgcaccaacctaataaaaatacaaaaattagtttggtgtggtggcacttgcctgtagtcccagctactcaggaagctgaggcacgagaatcacttgaacctgagaggcggaggttgcagtgagccgagatggcaccactgcactccagtctgggcagcagaggaatactttgtctcaaaaacaaaacaaaacaaaacaaaacaaaacaaaacaaaacaaaagttttccttgtgtagtagcccatggaatcatgtaggtatgtgagtctcattattatgtgatgagattgctcagcttttctgttttatggctgttggtgcattttgagtttcagaattacttacagaggcacagaaaagtggcagaccattgtgacaaactaatgctgaaagacaaaatagttgatctaaaaaaaaaaaaaaaagtcaggcttcggaaagggaaatagttacccttagccagaccaaaaaaaaagtccccttctgtcacaaccaagtgattatttgaaattatatggtaggggaaaattctgaaaagtcccttgtcaggatttatattattgactaaatgtgatcaattttagagatgtgaaatcagctggtctcagaaaacttctagaaatgtatccctatacacatatatgtaactttatatgtatgtgtgtgtgtgtgtgtgtgtgtgtgtatatatatatgtatgtgtgcatatatatatatatatatatatatatatatatatatatatatttatatgcttttctttttcttattgtcagctttgtgagacctgaaaatgatttgcaggtttctgttactataccagagatttgcaaagtactacatagtaaatattttaggcttttcaggttatactgtctctgttgcagatactcaactctgccattctagagaaaaaacagccatagacaatatgtaaacaaataagtctggctgtgttcaaataaatctttattttaaaaaacaggtggcatgctgaatttgacctaggagctgtatgtagttggccaaacccttctgtagattatttttataatcttcacagttgagaagttgcctgtgtcccatatctgaaatatccttgtgaaaactgagtcatttatttttaaatatttttcatgcttatatttatagtgtttaattcactttgtatgtgagtgtaactaacacacacatacacacatacccatagacagagtgacatacatgtagaggttctgactgcataaaaaagaacactccagaggttctttctccgattgctgtggttctgtgatttaagcattctatggacagtggaagcctgctcataaattagaattgactaaccaattgacagagcaggcacatgttcattcagtggattcaggataggaatgaatcaagtatgaaccaggtgtgtggatgaatcgagtagaatagagggagaagtgggggaaatggaggcagaagtcattgaaatgagacagatctaggcatccaggtcggagggcaaacaaagaaccctagctgggggcaaaggtagtcttctgcttccttctgatacacaacttgggaaacactgtgtattagagttgagctctaaagcagtggttctcaagttgtagtgcatcaaattccgggaccccgaccccagagactctgagaatatctggagtagggcctgcaattgctttttaccgtatatcctggatatttttattcaagttgtctgcagaccacagtttcaaaaaaagctgctccagacttttcaccttctcagcttccttccctatttgtctgataggctgatcatctgatccagagacagcctcttctcatttccttcccttcctttttttgtgctttccactttcctggtaccaacctaagctgattgttactaatttcgtttctgttaactccgcttctcagaaattaaagacattaacctctgccacttatacacatgaaaatatatgttgaaaaatagcttgcaccaaaacaaacgaataaaaaccacaacactctcctccatgggcgtgcacttcttgtccccgtaaggccatgtgagaatctggagtctcttactgctttatatgcaaagtccctaatgaccaaacaataagaaatggccagaatagctagggtgccataagacagaggaccagaggtgagacacaggatggaggcagggtcggatcaggaggacatgcagatcttgctaagggttttggcctgtatcccaggggcagggagaatccatcaccactgccctttcctaagtccaagaaccacttcatctgtagctgattgaatgtctgggaatgccataagttgagagaaaatgaagtgagagtcttggatggttctaggtatagagttggctagttggcagatgatggtgcatttcaaaagactggagatagaggaggcttgtggtgaaatggaaagaggagcagcttagttctagactgttggtagttaaggaactgatgggacactgggttggaggtgtacaacaggcagttgatactatgtccttgattctcagaagggagagctaggcttggagcatagatgtacggagacattggtatatagatgctgtttgaaattgcagatgtagatgagatttcctgggaaaatcaattggaatgagaggagtaaaagttcaagagttgaatcctgagaaatggcaaactttaacagaaagaaggaggaattgaaacccacagaaaattgagggaatgtgatataaaagcaagagaggagagagattcacaaaagagggtggggccaaaggccctcaagaactcaataaacgaggtgcagctgtaaaccagacccatggctttggcccccagcaggtcaccagcagccttccaagaacaatctattgatggaggggaagtaagagacacaaactggactgcagtgaacagagaacgctgtgggatttactacctgcaaagcagacacacgccagaatgcacagtagagtcagaatagcaatgactcaaagcagctcagccatctctatcttaagcagaatgagggcaaaatatcagttctaaaacctggagaagaggggagaatgagagaaacactggtggcattacagcacagattgtcttgctgtcactgagcaagtgtgttatttgttccctaaatatatgcaattgctcttcagcagaagtgtgtgtacatttaaaatgtccaccctcctagatttcctgaggctcctcatatttgtatgtgtttccccttagcacagcagcattacctaaaagcagtaccaggaaaggactgataggaaatattcacagggtccagtttgcaaaagcagctctttatctaccagactaggaatttagcttgtgttgtgcccactctgtgcggtgctttgtagttctcatcggggaaggcccgctatgggatcacagcaactgtgctaattaaatgtcagtggggtcgggagctgtggcgaggccttcacgctcagctcaccaagacccaagcaagaaggagaggcacatcagccttcctgaagctcattaggtaggaagtactcggattcagacagcttcagtgttcagatcctaaatggatgctgcaagtgggctcacaaatgagctccaaaaggaataaacaaactcatgtctttgtagttttaacagaaaacaatttttatttgggcaagttttccttgaaaatgttcccctccgtcacccctcattttattaactgtatcattgattctagaagtgtctcgtgtttatcttgtttttatcgttgatgacgccctcgtgtttaacattgacacaaagtaagggagaacaaagtaataaacacacatatcaagaaaatatcagtgctttgggtgcaggtggtgacaggcagccaggccctttctggcttcccctggaaggccctggtattttcctttcttgattgttccgatctgagtgtgctatgttgcagggaaactgagtcttgatgtcgtcagcagcctctccttaaaataactcagagccccttttctccatgagtggcacagttctctaagcggctaccaactagaagtggcattcacctgggcccccgtaccgccctcacctggacagcctggcagagctgctcactcctctccactcatactgccagtttcttcctgctgccatcttcattttgtgcctggacagctgcagtagcctcctgtctccatctctggttaagtcccttttcaattcactttccacagggaagctaaaatgattaattatactgaaaggtcagctgatcctgtctgtctcctcaccaaacatttccatagcttctgataaagcagtatgtacgtgctcaccaacatgctcaggtgacccttagtgagcatgctcctggttactcttatttttttctgttattttagttcatatttattgagcacaatacgtacttactttgtatcggtgctgtgtctcatctaaatatcacagtaactctctgaggtaaatattcataaagtacccttaggagcctcacttgcagaaggagaaagtgaagcttagagaagctaagtgatttgcctgtggctgttcagttaacaaggaggatataatgcagttgaacccaggtctgtccagagtccgtgatgctaaccactgtacagtcccaccctctagccacgtctgtgactgccctcttcattgcaccgtatgttacagaatctgcccacatccttcaataccacctggtccaaaccagcaccatctttcacctggattatttgcagtaggcttctgactcttcgtgcttctgttcatccacgcgttctgtagagtgttctctaacacagtagcaacaatgaacccttaaaaatataacacagattatgtcacctctctgctcaacaccttctaatacttccagtttcacagcaaaagtcaactctcctgttggcttcacaagtctcccaatatgacctggccttcttccccatctcccctctctctggccactttcgtctttacttattctgctcaagccacactggcctcctggctgtgccttggagtcaagaacctactttgtgtctataagtttctgtttcataatcctgctttgtatctaaaagtttctgttaaaatggtctctaaccatttgatttaaaatggcaacctccatcccccagtgctcattgcttccgtcctccgctttattttctccttagcacttgcacattttgatagatgatatatttgtttatgtctcctccaccaacagaaagtcagctctaggagggcaggagctttggtctgttttgttcactattataaccccaaagcctagagcattatttggtatacatcagaggttcattaacaattatagaattgttactagaggctgggatggtggctcgcacctgtaatcccagcactttgggaggccgaggcaggcagatcatgatgtcaggagtttgagaccagcctggccaacaaggtgaaaccctgtctctagtaaaaaatacaaaaattagccgggcgtgatggcaagtgcctgtaatcccagctactcgagaggctgaggcaagagaatcgcttgaacccgggtggtggaggttgcagtgagcggagatcatgccattgcactccagcctgggtgacagagtgagactctgtcttaaaagaaaaaaaattgttactagaaaggggtcctgatccagaccccattagagggttcttggacctcatgcaagaaagaatttggggcaagtccatagagtaaagtggaagcaagtttattaagaaagtaatggaataaagaatggctactccataaacagagcagcaccgagggcagctggttggctgtttttatggttatttcttgattatatgctaaacaaagggtggattatttgtgagttttctagaaaagggctgggcaattcctggaagtgaaggttcctcccctttttagaccacatagggtaagttcctgacattgccctggcatgtgtaaactgtcatggcgctgctaggagtgtctttaagcatgccaatgcaatataattagtgtataatgagcagtaaggacaaccagaggtcactttcattgccatcttggttttggtgggttttggccagcttctttactgcagcctgttttatcagcaaggtctttgtgacctgtaccttgtgccaacctcctatctcatcctgtgactaagaatgcctaatctcctgggaatgtagcccagtagatctcagtctcattttatccagcccccatttaagatggagttactctggttcaaatgcctctgaaagaatgaacatacaaggcatatattaattattgtatttagctcatgatggcttaggtcataggagaattctgtcttagtattgaataagagaagtgggtctttatgttatgttaatattgcatataaagcacttcatgtatctgaaactattaataacattgttttacttatagataattcatgacctcattatataatccccaagacacttacattgcaggcagtaactttgttcatatacctatatgtttatgttcaataccttgatctttaaatggcttctttaccagtaggttatatatttcttaagaaaggacaataagtttttccaaatgagtttttctttaaattttctctttcttcccttcctctccttacttttcatgccctctctttgtcttttcatttgcaacctgggttatttaacttctgaatgactagataacatttaaaagggtgttggatgtcacagaatgaacaagtaacaaaatatatctgctcaaagttctttgtctcttttcagtttaattcaacagatctgaatccctacttagacttgaaattcaccttgccacctcatttccttctttattaggtttgcctttgaaacacagttcatttgagcagtaattctctcacttttaagaaccactctatctcacaaaagctgaccttttttttttttttttttttttttagcagctgttgattagacagttaaacagagagacagcaatggcatatttcttagtctgatgtaactcagaaatagaaagctgaagaaacctgaagttgaaatgctttcaagcaatcgagcttaaagttcctgaaaattatctcgtagtgcttcttctcaactcttcatattccacccccgattttacatctggctaatttgcgcacttcagattggattcctgagcacacactggcagtgtgagaactgttgcggaactcatcattataatttcaagcctctaattaacccactttaaagtggctttgtcaagactatgagaaacagaaaagcaattgactcattcttggaataggtatatcatagagaaaagtagaatagtaagattgtgctcttcactcagcctcattggttcaggaacttaaggagcattaggagcacagatcctgcagtaattctctttggtatattattgcagatgttgttatttcacagttaggtaaattagacataaaaaggtcaaatgacttgaacgtgctaccataaaaggtcagtgataaagccagaagtcatttctcagtgtccatcataagccacccccacccccgcagcaattactttgagaacaagagctctctaagttttcccagtcaaccacaggtactattttaacatggtccaacatctcaaaaagatgactttcttcaccttttgatgtttgccttaaaaaaaaaatcaccagaaacagtgaaagaatcagaatgcttttaaaagaaaagtgttgctatcattcccatttttcttgttgtatataaatgattaggaattaaaacatttctggcccggcatggtggcttacgcctgtaatcccagcactttgggaggccgaggtgggcagatcacaaggtcaagagatctcgagaccatcctggccaatatggtgaaaccccatctctactaaaaatacaaaaaattagctggtcatggtggtgcgtgcctgtagtctcagctactcaggaggctgaggcaggagactcgcttgaacccgggaggcagaggttgccatcagctgagattgcgccactgcactccaccttggtgacagagcaagactctgtctcaaaaaacaaacaaacaagcaaacaaacaaaaaacaccacatttctcatatttacatataatattgtaattcatcattttctaaaaactcaatttatttcagaaaattaaacacatatgccattaaaattgaactaataaataagcaaaaaatactgtatgccatccatccatccatccgtccatccatccatccatccatccattcacccatccatctatccatccaaaaaatatttattaagcaactcttgtgtgccagacactgttctagatgatgaatacaacagtaaacaaaacaaaatccctgtccttctggaaactacattctagatggaggacatattaaaatcaagtgaagaatatttcatactcacatattatctgaattatcatggagaaagattcttctgttctgctagtttttcccaaaccacacttgaaatatgtgggaggggacgtggatgggaaatatccagcaaattcatttctggatgctggaagaagcaactcaagtaatattacctggtcatctctggatctgaggaaaacatattatttcttgtgtgggaatagtgagacccagaaatttcaaagacttgcgtttagttacatcaaaaagaaataaggtcaaagagatgtctgttttccatcagttctatataacgaaagcaaaaactcctagtgtacatcatttcagggtttcccagaaatcagtttctatgtttttcttattaatgtctatctgtgttttagataaccccaccacacatgtagaattagtttcttttcttgcttcctcaccctgaaatgttttaactcttttgactaggacactacaataatgattactttagaatatttttggtgaaatactgatttcagataagatgatctacatagatagtatttagtttcatttcattttagtcgctcagaaaatattgatgtatattcttacatggatagcaaaaccaattaagattatacctcagtaaatttcacatgaaaaatacaaaatagcaagcattttccgttaaagtaatgaattctttataaaatcttaaataagtatcttctgaagtattgaagtagaagtaggagaaggtataacctgttttagttgaaaatggaactaaagaatcaatttgtcttaaataattgtagggaaaaagcttgttttagaagataattttttatctcttttcatgaaaataaacatataaattaattcataaactaatatatttgttatatattacatataattatacaaacctcctgggattaaagtagtttttactcttttagtacatgacttagtctattttctgttgctgtaagagagtacccgagactgggtaattaataaagacaagagatttatctagtgtctgggaagtccaagattaggcatctgcatttggtcgccttctggtgagggcatcgtgctgcatcatcacatggtggagaaaggaaaaggaagcaggcgtgtgctaccatggcaaagcccgaagcagccttcctgcataacaacctgctctcaagataccaaatccggttccttgagagtgagaatgcactcacttcctctgaaaattaacccagtcccctcaggagcagcattaatccctcttaatgacctaatcacttcccaaaggccctacctcccaacaccaccacactggggacaaaatttccaacacatgcattatgggtgacacactccatgcaaagcagtatagaaattcatgagcctagaaattagaagctatgagtgacaaataaccaattgtttaaaattaagtggagcatattttatatttctgatcctaatctcatttttttgaaaatgtgttcagtaaatgtactgttattaagagtatctacatgttaacatttctcttgtatgcttttaaaggaaaaaaaaattctttaaaaacacttcattcttttatgtttaattttggtttaaaaaaaaaaactggtggattttcagaagggaatccaaattgcttatggtgataacatctactatctattagaacagtggtttacaaatgttggcaggattgaaatcacttggagggcttgttaaaacagatggtggggtgcagggggagaggggtgtactccttcatagtttctgatttgggaggcttgaggtcgggccagagaacttgcatttctaacatgcttccaggcgatgctatatagctgtcccagaaaccccattttgagaagcattctattaggatgagtgttagcaatctgtaggaaagttagcttcatcaatcgtcacaacactttgcaatgcttgatgataaaatcgtagtacaaagatagcatgcttactaaaaactgccctaagtcattttaaagtgcattttttgtgggctgttttcttcctttttttctctcctgctttgccctgcttcaagggttgagctgtcatgaatcatttgtttattataatcagtagggtcttttatcaattttactatagtttaagacagaccctaatgagtaggagtctagatcatttgaaattaggagaagtttgtttcattttttaattctggcaaatttcttgttattttgtacctatctttgtcttagtttggctaccattataaaggaaataataaactgatctctaagaaccatagtggatttttaaaaagataatagataaatataacttacaatatttttagaactccttgggtgaagtttgtatagtgcagagtgatgctggtggcattctagggtcgctccttcagtactgctggggagggaaggcatcagttccttactttccgtgtgtgtgtgtgtgtgtgtgtgtgtgtgtgtgtgtgtgtgtgatatgagagaaagctgtcttgagatctcatgatttcccttaggtctgtggtcctttggtctggttgtccatgaatcctccagagctgtcttgcagggtactcaagagtctgtgttgtctcttccccaggtttgtctgtattctttggaatgatcacccctgttctcctttctgtccactgccacattttcctcttggctgtgctttctttaaggctttctctttagattctcaaaaacctattttgaaagttcagaaacatgaacattgcttctttctttttccattccagttatataccaaaatctgctcaagataatatggacaactctgtttgactagggaacaagggtgtcttggaaagaaagaaggacaagaattaactttccaagaaacacagatttgttagcttttctaactaatccattccactgtactatttggtggggtataagggctttcatctgcttcccatggcccatctcatactctttcccattttccctcctgactttcccctccccctccactctaaggttctcaacccctctggaaacaactatctcctctttgagaaaagagtgcgtacagcccttcacgtgtcttctggattgtttagcttgagacttatgctggatattcctggtggttctggctgcctcagttctgctgactaaagtggggaaaatgtgcttctccctactaggaattcctgaagctgatcttcttctaaagtggtctaagtaccaaatattcacctgccgtagtgagtattttctggctgagaccacacagttgagtctcatgtgggaaagccttttcttctttctcacaggactctgaccctactaacagggtagtaattctggcatcagtatttgggaagaccagttatttcttctttggtctgtgttctttatgaaggacctcacagtactgcaaggaaccctggacagatggcaccatgcccaaatggatcctgtcttatccccaaattccttttttaagagaagggaagaaagagatgaatagaatctgagtttatcttgccacagtcaagagaaaagttccttggtggatttgtgttaacttcctagggctgccataacaaatgtccacaacttggaagttcacaatgacagacatttcttgtcccacggttctggaagccgaaagtcctaagccaaggtgttagcagggccatgctctctctgaaggccctggaggaggatccttccttgcctcttttcagtgtctggtgtttgtcagcagttcttggcatatgttggcttatatcacccagtctctcctgtgtcattacatggcattctccttgtctgtctgattgtgcctgtatttccctgttcttgtacggactctagtcataggattaaggcccaccctaatccagtgtgacctcatttaacttcatcacatctgcaaattcctgtttctgaataagatcacattcataggtaccaggagataagatttgaacatgtatatctttttggcttgatttggacacaattcagcccaccacagtattctgtatttgaactcctcacactggcatttagtgtggctcccaattaccttctagtcctcttctcattgcacatcctccatggcttggctcatgggatccctctctctatgcagaatcacttcctcatgccatcctttcttcctcctttctacctggacatttcatccattctttaaaacctttatcagatgcacttcttacatggttcctttcctagtgccaccaaatctaatgtgattccttgtaattctgccctcatttttccttgtattaattacatgtctatcattgttttaattcctccaactagaaagtaggttgcttgaaagaagaaaataagtcttgctcatctctatcatcccacagtagctaaaaccgtgctttgcactttgcagggtcacagaatcagagaaaaaagtagatgttttgaaaataggaggcttccatattttgcacattagaatacgtaaagccttagtttttgcccccttctgctgatttctctctgcttcaaataggagtagtgtttgacatgaaggcattgtattgtaatacaattgcctaaatatacaaggcagttattctgacttcaggctccagctcactttgcgatcttgggaaagccaattgctatgtcacagttttaccaattaataaaattggaactcacattaaaaaaatacagatgaaaagtactagggaataattattattgaatgtcattgaaatatagtttcttgatttttttttctccatccttacttggactcaaactgaaatgaagattaaaatcctagtgataagaagataaatgtgaaatggataataaagggtgccactaaaaatgaaaagcccaactctgtcatctttattccctaatcttggtttcaaaaaatgcatggtgttgctcaaagaccctgctgcaggttatatatgtttatgtataaggtttgcacttatgtgctgtctatattttatgaatatatacatatacatgttcttattcctatttagtgatgcatctgtatttaaattacaagtgtgtcatgattgataatgatatgcatgattttccttttgtcttcaacatataatgaatctcttggtagtctttcctgtggggatgtctttattctttcttaagactgactatccaccaatgctttggatcccctcctcactaatctgtatgcttgcactgtatctacccatgtattcattgcattgttatgagactttaatattatgatatgtaataaattatctcaggcctagtttttctatttgcaataatgacctaataagtgttccttgttgctaaaattcttttgaaactgcatactaactgggtaggcatcatttgcacaccatatataaaacaattgctgctattttggctcatattgttgtggaatacaagtatttctaagacccagagatttcccccccatggcatttcccccttttaacattcaatgcagttgcccaaattcagactctcattatcattaatattgattgttggttagttttctggaacacgtttgtatagtgacatcagctgatttcaagtcctgttgggagcatctttgtcaatagtaaagttggatatcgtaagacggctgtccttgaatatcttcattagcagtttttcagtttttaattagtatctaaattagatttcttattgttacaactcaccacagatgtgccatacttgtgcagaaacttaccaggtatttttacctttggtttccaaagcacataatactaaatggtgtgattgctgctttggatgctgggtttttttttttttaaaaaaaagtcatgtaaaagggtacatggcatataaaactgtggagtagataaatgtggctagagtccatcactaagacaatcgaatatctttggttggcagtgcattcattctatagaatattttaaatcagattgcatttataggggactaaaccctttaaaaactattaagtatatgttaattggtctctaagacattgtattgtgcttttagtaaactgttaatttggaccaggaaagcactgtattgatatcagtcatttttatgcatttcacaatcattgagatattccttaatccttttgcattttgtctatataataggaatgctatccttgctttatcatccagtgttcctttcaacattgactgggtacccaataaaagtgaaactcacattaaaaaaacacagatgaaaaatacgaagaaataattattattgaatgtcatcaaagcatatttcttgatttttttttttactctgtccttacttggacccatactgaagtgaacattaaaatctcagctgtaaaaagataaatgtgaaatggataataaaggatgccactaaaaatggttatttccttcctcctaatagcttacaatctatcagaatacatatgagtacataaataactatcaaacaagaaaaaatattaaaatattttctttctacaaatactggaatttgtaccatcatctgatttctaatcagatttatttgcccttcttctttacagaggatgaaacagagagataattcattgaggcttaagagttgttgtccacttaaacgcataaatatatgttattaactagcccatttcttcattgatttcaacaaatatttattgagtctattttatgtatcaaattctgtttttggtgctgagaacaaagagatgagtaagaccaggccctttatttgaggatgtcacagaccactggagagaaataatagttactcagatacaatatgagaaatttcgtaatatagatatgtgcagggcactatcagaacacagaacagggaggagaaaataagcctcatgagtcaagaccctctattacaaagaatatgaaagatttccaggtagaaaaaaacagtgaagttatctctgttttgtttttattgttctttttcaattatatatttcaaattttcaaagatatgtatagatggcttatctaatcatgaatgaaaatattgttctaatactttgaacatgtgaagggaggcctaggtgggtgtttttttttttttttttgagtcccttttagaatgcctcttctctgcagtaaaactagacaaatgcagaatcatgtcattaagtcaatgggagggagaaaggcctgcaaatgtttctgtgtttctgttaagctgtatatattaactgaaaatgatttgtataggtttgttcactattaattatgtcacattaaataacattattggtttcttaaaataactgtagcaatttttgaccctataaagtgatcataaagaagtaaaagctttttaataaataaacttaggagaaattattcaaattactgtctcaccttgggagactatcagttatgtaagatttaaagagttccagtatttaagtatctcttttgtgtgtgttgttgaccttacccaacaaaactacgtatctcattatttacaactctctactccatgcgtatacccatacagctgaatactgctggagaaaaacacacaaatatggttcctggcctccctttgaccataacataagggagacccttaaggcttcctggcagtactactatatttcccaagtccgtgtactttccctagctattttatagctgcttttcatcagttatccaacacctcctctctcgtcctcattatcagcttcctacttcactgagaaaaaaagtaaccagaaaagaacttgtcagtgttcccatcatcacaaccacccaacctcctgaatctgtgcccatattccctgctgtctctaagggtgaattttttcctatctaaggcaaacccctctacaaatgttctagatcattccactctcacctagtcaagatgttgctctagtgaatagtccctttcaaaaccaaacaaacactatgttctattttccgtatttaaaaaatccacctttatccctgcccttttgtctagctgccatctatttcttgggtctcccttacacctgcagtcctcaagagctgcctctactcacactccttgtttatacttcctcgcctcccattcttttttaaactcactacaattaagctttggtatccaccacttcctaaaacggctgctgtgaagctttttggtaatttctgagttgctaaaccaaatgacatttctctgtcctcatttgattggacttacctgctacatttgatgcagataatcaatccctccttcttgaaattatttcttcacttggctgcaagacacctggctgcgtggggttttgttcctacctttcttaaccaactttctcagtctaatttgctgatgtcttttctcttcctaacctatattggagttccatggagctcttttctctgtttaagctcacttttaggtgatctcactaaggctcatgattttaaatatcagtcatatactgacgtcccctccatgcacagctccagcactgacctctgcccagaattcctgacagacaaatccaacagcccgctcctcgtctaaagcttcatatgtccaaaaccaaagtcctgattttatcctgctaaatgtactcctcctacattttttcttagtaaatgacgtttctaaactattagtcgctcaggtcaataactttggaatcatccttaattctctttctttcatgccccagatccagtcagcaaacaaatcatgccagttttgccttcaagaactggccacttcttaaaacatgctaaggtacctaaagattacagtaattttatgctttcaaactgattgagatttttagaaacccctgtaagtcacaacaagtttcatgactgtggtttgtaataaaaatgtgtataattcaaatttagttaaaaaaatgtaaatagaaaataggaaatagttttcttgagtgattgattagtgacccaggaaaccaattctgaaataacagttttcaaaatgatttgctctagagcagcatcaatgtaatgaacatttaacttaccaaattatcacttataaggataatgttcatttggtcttctagtttctgaattattatttaaaattcatctccatgattataataataattggtattaagatctcatgaataataggaaaacttattgctccgtaatgtcgataaaatactggctctaccattttctagctatgttatcacaaacaagttccttacactctctgtgcttcagtttcctcatctgtcaatggcaataataagagtgcttaccactggatttcttagtagattcaaataagatcatgtacttgaagtgcttagaattagtgcctggcatggagttggaggcaggcattgtgctgggagtgaaagagttctgtggtagagtctctgttagtagaagccctcagggaatttaagcattaataagatatttgataagtgaaagacattgcaaggtttcaggaattgctcgagacaaccataaaagagacatctgaaggcaacatgtattactaatctacaaagtgagagaactagccaacacatgctgtagacattcaaatgggagagaaagatcacttccactacaagcagtttaaaataatttatggtgaaatttttgcttttttaaatgcctgatttcaatgacaataaaatcaagatctatacccagaaagcactcattttggcttacaaacatgaagcaacataggactttataccaactactaatgtagagcttagattacatgctataagagaaactcttctgaaatacagatacctatttatgtgtgtataggaaaaacacacatttatattgttcccaccactcactgatttattgcactgttgatcactttgtttttatttgcatgtagtttaaatttactatagacagtgtcaattatgtatcactgggaacatttcttcttcctggtacaatcgtacatttattgaagacataaatttaatcaacaaatattaatggctgatcattgtgatttcattatctctgcctttcaaatacagacatgctttcctgaagtgtaactaattgtccttaaccctaggactctgaagctatgtgtacaagtagacaaagatattgcaaagtttgaccctaggaaaggggaaaaaaagacctaaaacctttattttttccctactctagttggcccgccacaataaactgttgcagcagatgctcaaaccaggatcggatccagatgaaggagatgaagccttaaagtattatgccaaccacactgcacagattgaggtaaccatctattatttattgaaagagaccaactgtgaaaagttatgcttacttcctattttagaccattttcatatttttttctagagcaatgatgcagaagtgagtggtttaaactgaaaaatgtatagcaaaaggatgagtgaggagtgatttataggaaactgaggtgtacatctttcaaagttgtctttttttactaaaactatatgtaaaatttttttttgtaattaatagatgttttttaactgtagaagcaatcaatcattgcagagcaatagcgtttgagagatgggattattataatagaagccatcattcaggaaaaggtttcttttttaaaattgtggaaagcttattaaaatagagatctccagcaattcacaagtggagtaaacatgaaagaaactaatacagttttcatattgatagcatagccttggaaaggtttaacagtttccattttcagtatgcagcacttgacccccccaccaccctcataaatgagacattatttaatggttggtggcagtccaggaggtgtgggtcaaaatggacttaccattatgtgttctgagacccatctggctgtcatttactagctatggtatcattttgacactggctggcagagctaatcaggcagaagtgagcagagtagttgacgcttgtcactcctataatttacatttatacattcattcattttggcagatattttttacttttcagcagagtgcatgatgggcatcactgtattcactctcaagatatataacccctacactgtattgtttactattgtcaaacctttgtgtcacagaaacggataccttgctcacatttgtaaacattaatagtaccatagctttggtgttggacttgacttagtggaacccatgagctggactagcagcaaaaacatttctatacaaatagaaataggtcatcaaaccatgaaggtcttgaggaagatcccagaagtcaaagtacaaagctaggagatcagaagagaccagggaatagcaaatagagtgagcaggccatgggagaagtttggttaatgcgggtgagagatgggagctgttgtttgatgttgttttattgattccagtagtgaggagagatttagctataaatacacacattcagtacatgtttactgagcacttactctctaccaattcacacatatagaagataattctatgttataagtatataaacaaagggccaaggaaatgtagagaaaataataattagtggtgcctgagcgatttcaggatagatttcactgagaaggttgcctttaagaatgtattaaagattgagtacgagtttctccttcaggatggggatttcagaaaggagaaagtaagtgaagggaaggtattaaaaaacatgggaaggagatgactattttcaaaagatcaatctggttgccgtttggagacaggactggaaaagagagtgggatagaaaacacatagaacagataggaagatattataatggcaaaagtgagagatgatatcgaagatggctggactggaaaatacatagatacatagatgcagatacatacatacatatagatctctatatagttatatatatattataaatacacacatatacatatacatactgacagggctttgaagttgaagttgaattgcacatgttaggaaaatggtgtggaaaaggatgtcctctgggctactggtttgaataaatgagcagaagttggtgccatgtatgagaatgctaggagagagtgaagtttggcagctaaaaggtagaagaagattatttgttcattattggatagattgaatttgaggtgactttgagtcatccatggagttggatatacaagtccaggtttcaaaggagtggtccaggctgatgaactcgttgatcagctcttgcactcatctgaagccagctcacatgacctactcagagagtccttcctcccttctccaggctttcattaatttcatctcactgtgtatgcttccacagcagtttggttattctgttagtttaatatttatcacattggaatattgttagcttcatgtatgtcacttctcctttacttgaggcagggactggtcttggtcatctttgtatttccaaaactgaaccctgtgccttgaacataaccacaacaattcatgttattgagaataatagtttgtctgcaagttatagacttaaagaccctgggaaataggaagagccttgtgtctaatcacccatctaagaaggaattgccctctaatgatctgcttctgctttaaattcttcctgcgatagagttctcactacatcaggaagaaactgatccgattttgaatgactagtaattagaaactttttttaaaatgaagagttaacattagcccattttaatgtttacattcagaacatttttttctccctcaacatgatagcttgactctaacatctgaagagccatcatgattactaaactacaagctcttacctgttggggttcatgttgtttttttctccaacatgcctcacctaaagacggaataagcatttgttgaataaacgtattgaaaaattatccatctctggctttttgcggttaacacacctccatttccttcagtaatccctccagtttgtccatgctgcttgtaaaatgtgacaaccataatcaaacataacatttcataaaaggactgaagagcttggcttataataatctagacatgatttctttgatgcaccctgagattttttttaaatatttgacactattgaatcaagtaaaccttttttccctatatggttgcctgtcatatcaaatatgtccaattattttgtacaattgatttttgtaacctatatgcaagaatttttatttaccctactaaatttcatgtagtttgctttatgacagtattctagtatgtaattgaatatatcacatatcatttaggataccttcagttacaagattaatagaataccacagtgacaattgtttaaacagtaaaattttatcttatgggaagtctggagtaccagtagttctgtaattgattcagtgattcagtgatgtcttaaaatatgcagactcttcacatctttatactaggttccttatcatgctgacactatctcacctcatggttgcaaaatggctgctagcattctaagcatcatgcccttagacccttttgttctaagcaagaagaaagagggtacaggcaaaccaaaacaacaacaacaacaaaaaacttttgttttcgtgtatttggttgttgttgttgttgttgttgttttgtgtgtctcttatggctctctgcctttaccaagaagcaaaatctctcctggaagccctttcaggatatttctctttatgcctcactttccagaggtacagtccatgaccaccaccacaccagtcagtggcaaagggaagcagaattactcgtttgggttaagccaatccttattcattcctgagaactgggcactgtacataaatatgaaccttgaaatttaggctacataagcccttgttacatagtaaagctgtatgaaaatattcagcctttttttagtctaaagttaaacagtcacaaataacaaataagggaggctaaaaatgatgagtatttaaatgtgggtatatgtttacatggatgttgtagctacaaaaatatgttttaccatgaataagagaacattttaatgatataaagcgcttttctctgtagagttcagacacataatgctgaatatgtcatttgttacctggcagccccttttaggatgaagaggctaagaacaagatacaaataacataagcgctatgtttaaggctacccagccaatcactttctaattaagactgtcttagttttaggatgtacttcacaaaaataaaaatgggtggcagaagtgtaatgctaacccagaaagaataaaaggttttagtttttgttattttaagcaaagtatagtgttcatgatatattagtcaattaatttctcttttttaaagagaaaaatacaaagtagtatagtaaaaagggttctttcagatacttcaagttggcacattttttcacaactgaattcataaaacattctcagtaaactcatgttaaaaacaaaagcaagtctaagactgaggtgtccgaaaggctaaaaacaatgcaaattaatgttttcagattgtccggcatgataggaccatggaacaaatagtttttcctgtccccaatatatgtgaatacctcactcgagaatccaagtgccgtgtgttcaatacaactgaaagggatgaacaaggaagtaaagtgaatgactttttccagcaaacagaagatctctacaatgaaatgaagtggcagaagaaaatcaggagtaagtacagtaaactgaaatggttagttttgtgcatagtggtagataatttggtactttgggacacatgatgcagctcatttaaattgtttttttaatttcttgctggtctgatattactgaaatcacttgcagtcttaagagtgtccgcttagtctaccgctggagccgagacacccgcagcttaaggaaaacagaaagccctaactaattacatcgactcttcatgatgatcctatttttaaataaatgttatgaaatgcagggttgaagctgtacatttcaaatgttgaacagccacaggtttgaagtccgtgaatgggccctgactggcctatcagtgaataggattgagagacatcagctcctgcgcactcttcctctgttgtcctgtgattgaggggattgtttcatgttttgctgagagtaattctttctttgaacatatctttacctccccaaatcaaacaagttatacatatgataacacttgtatttaaacagagcaatgttataatattccagttaaaaatcagcttagtacagttcccatgacctatctcttaggtcccacgtctattaggaaacactgacttttaaaatttaaaattttagaatttttaaataaactttattttccaaaataagggatctcatgagtttttcacgaaagtcaatgggggaaactcttgagtaggtctttttcagtctcttggagttttctagacaaacaggatatgttctcaatacttctattcaacagtatttcattatggtagttttcagcaactttagtgggtatgatttatgaatttgagtggtgcttgagaaatatcatctttagatataggggtgtggtatgcattttcaggcttttaaaacagaatgcttttaaaaaaatcaaaattattctcccttagcattttaccatgtagagccttatggaattcagtgaaaattttgggtgtctaaaatacatatgaagacacaattttatttggagcatttaaaaaacatatattttctggccaggcgtggtggctcatgcctgtaatccctgcactttgggaggccgaggcaggcagatcatgaggtcaggagatcgagaccatcctggctaacgcagtgaaaccctgtctctaccaaaaatacaaaaaattagccgggcgtggtggcaggcacctgtagtcccagctactcgggaggctgaggcaggagaatcacttgaacccaggaggcagaggttgcagtgagccgaggttgcaacactgcactccagcctgggcgacagagtgagacaccatctcaataaaacaaacaaacaaaaaccaaaacaaaacaaaaaaacatatattttctccttgacaataaattgaatactgaactagtgctttggggaggtctgtgcttttaaaaaaataagtattttatcatttaccaaaaattaaatcttaaataattttcaatgtacattttactttaaaatttggaagcagcttattatgaggctataggcagagtctaattcatttggtggattcaatagtgagaatttgttattacaaatacatgcatcaacatcttctaattttgtcttaatagtctacctttaaaaatgaggactcctaattcaggaatgatggagatgcagatgtttatagtttatgatacattagtcaattgaatggcatagctgatcatagcatatttcggcattggaatgttcccttccaagagaaggaaaacaagatgtactaaagagaagtacagtttgtaagtaggcaataggcactaggttgaaattcacaggatatatctacaaagttaatcatttccatttgaaaatcgatgtgcctttcccccttgattaacttcaattttttaatcctggtgttaagtttttaaaagttagagaatggacaaggcctataggagccatgtgagtgcccagggcaggctagtagatttggctgtcattcaaacttacatgcattaccaatccgttcagttatttaacagaggtggaaagaactgatttttggttaatgtaaactgtattcgattgatgtatttactaattcatttgtgataacagacacagagtcctttgttgaatatatgcagcaaagcgtgttccacttattaacagtttttattatagtgctcattttcttctgctgtttcaaacccaacaagttcttaggaagatttaaggtttaaaatgtagataatattataaatcactagttccccatcaggaatactatgtcacatgattaggtttcatactttcaggtaactgtgactgtcataggaattttcattagaaatatatctgtgctatgggtttggagtttttttatttgactttaaggcatgggaatgggaccaatttatcaatattaccaaattatacaatgaagtatatcatttcattaaaagggaccccaggcaactgctaaactgctctgcagatagattacagagagttattacagaatcaccttttctgaccacctttagcaattgcaaaattcctcacccttctacagtagtttaggcctaaactggctgaaggatgaaagaagaaatcaaatttcactcctttatggttctgattgtttttaataaacttactcaagtcaaatatttatttaaataggtttttataatagtttacaaaaatgatgcatttagtaaaatattgttttggtaagcttcatgtgttgaaaccaaaatgtattttcctgttcagttcctttacatttctcacttcctagataaccctgcactgttctggttctcgaggcacatctctctctgggggagcatttccttcaacctggctgtgttcatcaatttagctgttgctctcttctacccatttggggatgatggagatgaaggcaagtgctcgtttttccttaaaatataaatattttaaagttcccacttaactatttaaagcttcaaaataagaataatttcattcctgttaaatggatttttctatacttgttggaagtagagtatgatagtaaatagaacaggcagaaaagtgtggtcaacagaactgttattttttaaaaagctcatatacacaattgttattagagctatattatatcttggcaaataaagcaatgaaaagatttgtcatttctacctaattattatgaccccatttttatactgtatcatctaaattatgcaaatgacagttctgtgcccaatattaattgttgttacctaaatactggcgtttatattttactctctttgttttctgtcttgtctaaggtttctatagtgagcatacatgtaatctagaaataatttttaattctatactaaagtcagggattcttaagataattaaatgtttatcatctgaggtttcaaaagtgaacagcataagacaatataataataggaaataaaggatactgaatatgaaactattattaaactaataatacaaaagcaaaaatgagaaattataccattttaggtggaaatgagaaatataggagaaatatactgaatcgtgagatttttgggaagtaagttttgtataagtttggtggagagcatgggaagtatgttacaggcttgggctacaatctggtaaataactttggaatgggcatggaaagaatggcttgaaagaaaagatggagaaatcagctaataataaccatgcagtgcttttgcatctcatcatttcatgggattactgtgagaatttaatgagatactataggtaaagcatttagaatagtacctgataaaccttcaataaagttcaatggtggtggttgctgtttaaaaggtacatatttgtactacataaggaagcgtagtggaaagagagtatgataagagcaacaggtatttcagcctatttcagatgaactgggggtgggcagaaaaggaaatgggagtccaagggtcatttgctattttacaggttcattacaggtaacatagatatcaaagttctaaactttagctgtaatctgagtagtcatgaataaccactgtttttggaaggcatacccgtaataaaagaagaatattaagcaatggagtggatgtatgagttaaatagcagtgaaaatgtagcaaatatttggccatccattatagagcaactgcaaatacaccaggaagtaaaaacggcattctcttcattgtgtttggtctcctttggtgataaactcttagcatagaggaatataactcttgggaggaaagaagtccagcatgaatgataaatcaatatcatcttcacacagaatgctgagaagattatagagtcccagttattagaagcataaagtcttagaaatggaagcaattctggaaatcatctaatatcaaacactcatttgacagatgaacagatggaagcccagaaagcctaaaaaatgacatatcttagagtagaaggctaacccttttgtttccaatctaggacccttctccgtggattggaagcatgtcaataacaagaagcatgtcccttcttcatacaagacctaatttcccttgagttccattccatgatatccctttcttgaccaccagagccaatgtatgtaggctctgctgccacctattgtacatgaaatgtagtgatgggaaatgccacccctctgggcagttgctctttactcattcaggagaagcagaatacatggtatttgtaatacttgcctggccaataatagttataatagtaatactgataataataacagcagcggatgttgttcaccacttagattgggtcaggcaaaatgctaagcacttcacatacatttcacttaatcttcctgacaaatctgtattcttatggaggaagaatatccttatggatgaagaaactgaggctgaagatttgccttgtaattagagtccaaaaatatgtattttttaataagctcaccaggtattgctggtgcaactggtcgttaaaaaaggacttgaaataacggatttttcaaagccattctttacccattaatggtgggaagggaggagcattttctctccttaatactttatatatgtatccattttctataataagcatgatattattttaataatacaaatgttttttaatttaccctatatatttttaaatcttagaaagtatgaagtttatcttttataaaagaaaattcagaaagcaaaattgcaaacttcaatccagttcacataatgaagctctgctatctacctcatgcagactctatagtttcctgtacagaacatgctgcttcttacttccctgtttctctccatccctctgcctcccaagtagcctcatgagatctttctgtttcctctacctcagtccagctaaatagatacccactcagaattccctgggtcgtctttactattgtgccttattcatttcttggtcccttaactggactgtgaactctctgaggacaaggacaagtttactaatctttgtattttttaaaatacaaagattgtaaaatctttatatttaacagtgcggcactccatcaacagttaagttgaaggaattgaaatcaccatgaagaactcattttctttaacacaaagcacttgatggaaaaaaacaattacactacaaattttaatataatttttaaaaatcacatactatcttggtataagacattcccatggcatcaattttctcctagttatgggaggtataagtttgttagtcccagaaataggactaacgaacacaaggctggaagacatggtgcactatcatcaggtgcagatgcagactttacttctgggaaaggactggatagcagttaacagtagtaaccaatgtagaggctcagcttaggatatccaagtggatggggtgcttagagggaagggaaggcatgagctgccattttggcaatatcaaaccccaaggttatgtctgggtcatctggttatagttctggatgagttatttaattatagccccatgaataaggttaacattttggtcaggattagcttagtcttaatctgttgcacactgcatagctaggaatgctgaggaaacagagctaagactgttacacatacttggccatcagaattgtctggagaaggaaagctctgtgctggtggtgaaggttctctgatgctggatttggtcaaacaggctgaacgactgtatgctagggccactgtgaagtgatttagaggtgggtaagattaaagatggatgaaaattccttcaagaagtgcttaaaaatgatggagacatgtcagaaaacccaggatccaacttgaaaggtctccagatggtcaaatatgagaaaatttagagaaaaagattattgacagtgacacatcatctcctatagaataaaataagaatccaggagttcatgttgatagtgggaagataaagctcttttttagtaattgtattccaattaataaaatgtagacagaatgatggaaataaatgtcaccatttggcaaacatcacagtagtaaaaattatccatggctgctaaaattaatgggtgactatatgatgaaaagtatataacctatatataatgtacaattctgtccccacagtatacttaattatgaaaggaaaaataataactttaaagtgatcactttagctaagtgatcagtattaatggcacctgtaatgagacccagcaacatcacatgcctcctgatacaatcaccgacaaggacataacatcattttccaaaaataaattaactgataaaatttcagacaaaccccaaatgagggatatactacaacataattggccagtactcttcaaggtgtcaagcttatgaaagacaaagaaagactgagcaactatccaaattaaaagatactaaagagacgtgacaaccgaatcccatgtgtgaccctggttcagaagaaggacataaattgggaaattgactaactttgactagatagatggtaaaagtggtctatcaatgttaatttcctgatattgatcattttcatgtagttatatgaggtgttgacatttggggaatctaggtaaaggataaagttaaaaagaaaaaaaaataataaatgtaaggagtctgtccaaccctgaagttccttgactcggtatagaagctgattatgaaatcacctggtaagtcttggaccacaaaaagagctctggttaaaatatgccaccttccaaccccagatcctaatacatgctggtaccaatgtggtggtgagaacagagggactggcagagggaatgagccgtgtatgcttcctccaattatatttcccagtctgaacacctggactactaggagtttcttgtgctcaaatatttggttcacacttgggttatgatattaactgagagagtagttgccctcttcaaccaggtagtggggtacaatgactaaatggagacatttaagggagagggaattctcagaggaccagcctgttgggcactcttcaccctctactgcagatagagaatctcctttaattgccaggctttgaagagtttggtttcaatttgttcaggagtacagggctgatgttttatggctaaacgttttggttgggtttctttgtttggctgattggtttttgtggctgtttgtttgtttaaggtatgcttctctaaaaaagaaacatgccaatgttgaggaatgaggctacactggttgtggctgaagcagcagctgctgatgctgggaatagcctggaagtccactcagaagctgacagctgccacgccagatatccctacccaggatttcatttggcaaaggcagactagttagtggagaaaattgatgccatgagaatgtcttataccaagatagtatgtgattttaaaaaattatattagaatttgtagtgtaattctttttttccatcaagtgctttgtgttaaagaaaatgagttcttcatggtgatttcaattccttcaatttaactgttggtggagcgccgctatgtgctaggcactgttaaatataaaagattttacaatctttgtattttaaaaaatacaaagattagtaaacttgtccttgtcctcagagagttcacagtccagttaagggaccaagaaatgaataaggcacaatagtaaagaccacccagggatttctgagtggatgtctactttagctggactgaggcagaggaaacagaaagatctcatgaggctacttgggaggcagagggatggagagaaacagggaagtaagaagcagcatgttctgtacaggaaactatagagtctgcatgaggtagatagcagagctccattatgtgaactggattgaagtttgcaattttgctttctgaattttcttttacaaaagataaacttcatactttctaagatttaaaaatgtatagggtaaattataaaactttttgtattattaaaataatatcatgtttattatagaaaatggatacatatataaagtattaaggagagaaaatgctcctcccttcccaccattaatgggtaaagaatggctttgaaaatctgtactgtcagctcagcgaggtggctcatgcccgtaatcccagcactttgggaggccaaggcaggtggatcacctgaggtcaggagttcgagaccagcctggccaacagggtgaaacctagactctactgacaatacaaaatttagccagacgtggtggcaggcacctgtactgacagctactcgggaggctgaggcaggagaatcacttgaacctgggaggcagaggttgcagtgagccgagatcacgccactgcactccagcctgggtgacagagcaagactcaaagaaaatctgtactgtcttctctagagtttgtcagagagacttcagttcttttttagcattgaatcttcagatagaaaccaatatgatcattcttagagaagttaattataaacattggcaatagctgttttaaataacttttgagtttattccacaaatatatatttagtatgaacctatgtgcaagctactatactagacactctttgagttcttttcacaaagggatcaaacacccaattttaagtgcctgactataatttctgtttgatcaaggggatatctcagcaaaccagatatggtcttggaaagaatagtgaagaggtgaatagtttatcagaaattagtgacaatgcacaatgtgactatctatgccaaattattctagaataagagtgtcaccaagacattgcttatgaattatgctgaaaagtcaaataactggctgacagctgtaaatgtgccttgaagatattgtcagttttagtgaacttaaaagctaagctgtatgacttggggagttgataactggagacttagttatttattcaaaacaaactcacagaatatatttttgtttatttactcaatcaacaaatttttatttgttgttgtgtaacaggcatggcgataggtctggagatggccctcatccttttagattgtacatcctggtggagtctcaagtcccagtaagaaagagagaaaattgaagacattatttactctatggctctttgagatctgtgaggtcagggcagttggtggtcagcctgtattttggtagatgtggagtgcttacaagccaacatcatcataaacacgagtagggtacctgtatgttagcattgccagaggacaagaattgaaggtaactttcagagcagtttaccctttttctttccccatctccaaattaatcttatcagattataaatttggtgagggagaatatcacatctgtcttcccaagctcctttcatcattgtttgctttcagagacagcatgataagaacaaaccttgcaaaagtaaacatgtctaaatgaatgctgttcattatctgattttttgtttgtcttttaacagttgacaggatcttcctgcctatttctgagatgttagcacacactatgaactaagagtttatacagaattcattaaaggagtcagataatcccagggttttgatgacagtacaaaagctatgcatatcaagcccttgaggtgttttgcatgcggtagcaaattttataaataaagataagaggtgtggccaaaagattaagactgttattgaatatttaccagtggaaagtctccattttgttgtttcctttctatgtcagcctatagacatgcatttgaggccccagagctgatccaatcagcccaagaatgttgcctcttaatttacttctgcaaatgcagcaccacatgaccttcagggaaagattccttgaatgcacatgtcagtgcaaatgtcaatgaattgtactacttattaaagaaaaaatatttttgaacctctcttttggggagttcctaagaaatcttatgtgtaacagagttcgttttttaagacatttggaatgtgaattttctgatgagtaaatagctaaaaattttatttagcagtagagttggccttcaaatacacacactcatgcacgtactcatacacatatctatgtatgtgtatttagcagttaaagcatgtgtctattttataaaggttattctactagattcttcagaggaatctagactatggaaacttgatactgataggacaagacaaggtatgaattcaattttttaatgatttagctatatatctaatggtcattaatcataaattttggattaaggttcccgagagagatgtctatcaaaagtatttagcaaatcaccctcatatgacagaaagatgaacaattgtcagacttaataaaaggaacattaactagtgagtatttaagtagcttgaaagtaatcacaaattttctggaaatgtaataatgagtaatgctttcaaagacatttccttgaaatataaagaacgtagatggggtcattttgaaatttactggattatggctttgacttaatgataccatataaagtagagcagcaaatattttagcattttttagttttattcttagtagcaataaatttcttccacattttacaggtacactttctccattgttctcggttcttctttggatagcagttgcgatctgcacatctatgctgtttttcttctccaagcctgtgggtattcggccgtttcttgtatcaataatgctcagatcaatatatacaataggtcttgggcctacattaatacttcttggtgcagctaatgtaagtactttacttagctttgtactgttacagaattagtttaaaagtgtatgaaatataaaaatataactataagcttttaattcatgtatgcatggtgaattctaatttattataaatctaaattaaccagagcataatttgtacttttttaatttaattttgagtgaaagaaaaaatgataggtaaaagattgctatatttaagaagtaacatttggggaatgacccagttctgccatcaatttaatccaatccaattttaatgcattctgcatcctatacccacagctattgacaaaaatgactgagccattgttaatattccaaagtgacatcgtaaatcatccaaaaaagattaaattatgttcaatagaattttgaaagtgggcacctttcatcaaatgacctaagaaaaaggatttctatatgagaaaatattaaattgggttctttttatgtgaacaaattttataaactgatgaaagtcatagataggattaattttttgaccgaattttgaaatattagaataaggaagcacagagtagtagtatttcaaaaagcaagtgatacatttatagaaataattttacccgagaaatacaattttaaagggactagccaacgttatgcatggcacagccatacagagatattaaaaggtaaaaccatcaggctaatgaaataacaaatggccaggtaagaaaataagtattgctgatctatgtgttgaatacctagacactttcgatcttttcctgggtttctaacataatgtcctacattctggtatctgtaattaggactagtctcccctactacattttactatgcttaaggattgatcattcagtatcaagaacattataggtactcagtaaatatttcctaaataaataaattaataagtgagtgaatgaatgagtgaacaattatctttgtattcttatatatttacaggggcttgcacataaaatatatagcaaatatttatttagtaataaatatttaatatttagcaaatatgtaataataactaatatttaacaaatatttacttaataaataaaatgtatttattttatttatttattaaaatgaattaataaaatagtcaaccaaactttcaagaattataaagctgagctaatatggccaattctgtatttctgtgtttctgacctctattttattacaattcttcgaaaattagacatgatgtatttgacagctcccaattagctagaacattcaggcaaccaaattaccaattatcctcaatcattgtcaataaagggaagtgtactatacctacaaagaagtctatcagtaaagaattttgtaaaataccaaatatattattctgtaagtttcttgagggcagaagttgtcacatttataaatttagccctacctgcctcactccttcccagctccatgtttctctactttaacagctggcattgaaacattcagaaaatgtttacatgaactgaatgtgtactttcaatgccttggaaataagctgattttacagtattaccaaccaagcaaattagaaaatcttcatgaatttgtctaaatttttctaagcctatgtgtttgactttttttctttaaaaacataaattgcatattgaactatattatttgaagaagcaaataatatttataaactggtaactggccctcaagaagacatgaatccaagtgaaaaaaaaatccaagtctgacaaagtgaaataatagctagagatgggccaaaaataataatcatttactgggcctctgttatataatagacactaaaaataccaagacgataaaggaaatggttcttgccatccagaagctgatgtgtcacactcaccgatttgcatttcctttgtttttggaccaagaatatataaagagataaggaataacattctaatgtctactgggggaaaccaaagacatttggagcattttttcccctcatgggagaggataagaagatagcttttgcctggtttggtgaaaataattccactatagcaaatgactcttcatagaagaggcaagttttatatttcactttctttatgagaaagaatatacatgtagatatgcaacatctctcctttattaactgtagaaatctgtggggactgtaattgctttcacagcatagaacatctgtttgtacagtcaaatgatacattgtggtctaccagctcagagcgttttttttttttttcttttttagacagggtctcactctgtcgcccactggagtgcagtggcgtgatctcggctcactgcaacctccacctcccaggttcaagcggttttcctgcctcaggtcctgagtagctggggctatgggcgcgtgccaccatgcctggctaattttttgtatttttagtggagatgaggtttcaccatgttggccaggatggtctcgatctcctggcctcatgatccgcccatcttggcctcccaaagtgctgggattacaggcgtcagcctgtgcccggccggaataccatagaatatgatttttaaaaaatgtttacctgcacagttcgatatgcttatgcatgcataaaaatttctagaagaaaaaacctgggccctgacaatattcagtcaagttctctagattaatcacctgttaacagtggttttctctggggagtaaacctagtaaaagggtaagcagggaaggaaacatgttttatattttaatttagtatttatttctattaatttattatttaacgtgtttatttgaatttatatctaccatttattcttcttaagacaactttaaaagtagtattttctatactgatcccacactcctaccagtaaactgttcaatcagatactatctaatgtattatacaccctatannnnnnnnnnnnnnnnnnnnctggggctatgggcgcgtgccaccatgcctggctaattttttgtatttttagtggagatgaggtttcaccatgttagccagggatggtcttgatctcctgacctcatgatccacccgccttggcctcccaaagtgctgggattacatgcgtgagccactgcgcctggccgctcagagcattttgaccaaaaaaaaatcaactttaatttgggacaaacacattcagtggaataattgtcattttgatattgtagatattgacaaaaaattttatctataattttaataatatgtggattaataaacatgttttaggttggatgctatgtcatgcctgtaatcccaatactttgggaggctgaggcaggatgattgcttgaggacaggagtttgaggccagtctggtcaacatagtgagacctcatctctacaaaaaataaaaaaaaatattttagcgaatatcatctaccttcatttttaacataacaagttcactgctgggtgcagtgactgatgcctgtaatcccagcactttgagaggctgaggtgggcggatcacactagatcaggagtttgtgaccagcctggtcaacatggtgaaaaccctgtctctactaaaaatataaaaattagtatggcatgatggtgcgtacctgtagtcccagctactccagaggctgaggccagagaatcgcttgaacccaggaggtagaggttgcactgagctgacatcaggccactgcactactgcctgggtgacaaaatgggattctgtttcaaaaacaaaacaaaacaaaaattagctggtcatggtggctcgtgcctgtaatcccagctactcaggaggctgaggcaggagaatcgcttcaacccaggaggtggaggttgcagtgagccgagatcgtgccactgcactccagcctgggtgacagagcgagactccatctcaaaaaaaaaaaaaaaaaaaaaacacaaaatgaaaacaaaaaccaaaaaacaagttcactacaaagctatctatggtttatcattacccaggaggtaggaaataaatacatgaaaatatcaattagtcatatcttgtaccttaagttttagtacatttattaacttaatttacacttaaaagtttgcattgtgtaagaggtgaaactataagtgctaaaactataggtatcagaaataagaaaaacaaaagaagacatctacctgacaattttgccttaatgaccatcagagttctacactttaggcaaatcaacaagactttgaatttcattcttctcattagtgaaaggaagatactaaagcctgatctgtcttcgctaggatagttgaaaagatttagaaaagattaataatggtgataatgataggatagtaacaatggcagctgtttaccaactatctgtaataatacatgaagcaccctttaattgtaaaacattctttttatggttgtaaaaatatttgtgttttggttcttggggagttgtttctggactctgtttttcacaatgttaagccactgcagaaagtcttatttttggaaaaggaatcaagtgggaggaacagcctcaacctgtgttataacaacttagtactggtttctgtttactatggtgcttcttttttattgtctttattcatttctaaaactaggagttggtctagatttcaactagtttgccttgtcacagaagtgatcgcaatatttgagatatttcaaaaaattcaagtgtttttttctcattataaagcacatcttataacccagtctagttttcttccctctgcaatgcactgttagtttgcattggtaatagaaattaatatattattctgacaaatataagcacatattttataaatttggggtcacttaatattctttcataccattaaaattatttgtaaacctcattttaataactgtattatttccagtcatatgggcgttataaccactccattaacttttgttgttcagatttttaaataaataacaatgtagtaaaatattacaaaaagatcttttaaacttcttacctacaatgatttttcctttctaatagtacctggaaatgtgtaattcatttaataagttggtctcaccatttgcagagagaaggagcaaatggagtttagcagatagctagtctactaacaatgagccactgtgttcaaatttaatagggtaatgtccctagttacttacttgtagatagctttctgggaggtcttatgttactgctaattcgtaaggtcgagttccaccatatgttcatttaacatacacaaattcagtgatatatttggagtaaacaactttcattttctctctctctctctccacacacacagacctaccctttttcatataatgtggtcactgaatgctcctaactacttctagttgcagaaacagaaaactgctccaacgctggggttaaagtatgatgagatgaatttagtaagagacactaccatttacatgacctgtgcttactgttctgttttgtcagcaatttaagagatttccagggtgattttgactgcatgcaaattttgccttacacattgatcttagaaccttgtcctgctgtagatgtaatgcccctgaaatggagatttttgaatcaaaccatctcatgtttagtaagaagtttaacttacatggttgatgaaaatatggtaatggagttgaaaatcacaaattccattttacttttcaataaataagtagacagtctttttttctttatacaatttattcctgtaaaataggtcatgttttcccataggaacaatgtaagatggggatagaattcttgatcaggaacagagtaccaaataagatgaaatgaataatgtaaagacaaagataaagcagctataaatgtctgtgatcaaataaaattgtaacatttaaaggtatcacacagaattctacagctatgagggagcttaaggattgttcacttctaggcatttcattttatatgtgagaaaacaaagtcctgtagacaccaggagggtttaccaaagcaagaaattagtagcatagccaagattgaaaccagatgacccgccttctaattcagtgtctttctgctacactgtactgttaaatgtcctgcaaagacagatcaataactataaagtatatatgaaaacactactttcttaaataacttatttaactaataaattatctaattaaatagttaaattattcaataaagtattattattattcaataataattattcaataattcaataataattattggttaaataattaagtagtattttcatatatacttcatagtttaactaattagttaaattatttactagttatttactaaattattaactaataaattaaatatattaattaatcatttagtaaataattagtaaataatttagttatttagtaattagtaataatttcataaataattagcaaatagataatttaattaaataaacttaagtaaatgtaatgaactttagtatacactaattaacaaacaaacattaattttgcttttttttttagaagacctattggtaaatcatttggatggtgtattatcattttttaaagactgtcccaaagcttgcactgatgctgtttcaattccatccctttccccactgtcacacagttcacctcatccccaacaaaaactgtatcagggatggctttgaataatagacagagtaagaaaaaaatatataggacagttatggtccttgaaattgaaatttgtgtgttgacttgaggaaccccttagcaccagctcagaagagccttgtgaccatcttgcccagtttcctgggcacaccatccactttttgtcacccacatggacccttgctataatggcactgacaaatgaaggactggttagacgatgtcaacttttttatgacatgaaaagggagactgttttagcaacttgctcattcttggcataaatattccaaactttcatggaaaatgctatatgaaaacaatttgtaagtttcatgaagaaaggagaattcacagctcaacttctttcccacccgaatcatttattcttgcacatatttccccttcatatgaacactttaaaacaaaagcacaccaagttccctgttttttatctcaacagaaataggtagacgccactgtcagttatcaactccactccacgtcaagacttagtgaagagaacaggaatctattcatcaagctctagatcaaggttcaaaaatgaaacaaaaaccaaaacctgaaaacaaagaaggcaaatctttatttttcaagtgaaaatggcggagtctcttttaggaagaaatgtggccttgtttttgcattatttgagaaattaaatgtattattctttttgagaatttaaattcagtgtattttttttcctcagtatatggagcttataaatagtttttctgcgtaatttttatgatttcatttggagaattagaaatcatataaacaatgtgtcttaaacatatcattcgtctttctgaaaactcacgactccaattatttattttatttttatacaacttatttctaattcatattgatgaactctggtggatgaatcaaggtaaatagtacacatttaaataatggcattcaaaacaatttaaataattactgaatatgacttctggacactctctttttcaccatttttaggggtgtttattgttaaatatgtcatatagattagtattcttatatatttcctgggtttttaaataataatttcttacaatattaaacctgctcttgggcagaaaatataaatacattcattatgctacagctatacttaataatagcataagatattgatgatgaaacactaaacagtgaaataagacatgaatgaagtgataacattgattattgagaggatacttaatcagcaggggagaaatttaggaaaggtttggcctttttagttgctatgttgttaatttggttggctcttcaaaacatgtaatagtaacccatttctcacttcatctgtattgatttgaacttcagaaattgaaaggaaaaggttttccaatccctccaattttacatctacttcaaagtgttatggtccttcttatgttatttaaaaatcattcaataatttgttaatatatattgaacaaatcaacaatgttgcaaagagcaacctgtttttacaaagttaagattggacatttaaggacaaatatggttccagtagataacctaaagaactcggaacaattaggaagagcaaactgtaaacccttgaaatctgtaattctttccttgatgactaagacacaaaattggctctttggtttgtaattactgcagtgattctagaactaaatagatggtgctaagtttataaatcagtgcacacacatcgttattattgccaaaggatctcagtataaatttctacattccaaaattatgccacaaaaggcagtatgaaatgtgggttgaatataaatactgtacatagtcagaagcataataaacactccaaaatgtttactgaattattatcacacatagggcttagaaaatacatacatacattatatttattttaactcaggtatataagtacatttatattttctatgtatataaaataaattaaatgcaaaaataattttaatcacttacttgtttaaaatagtactcagtagacaaagtccatgataaaaacacaaaatcaagaacagatctctggacatttcctgaaaagatattttctgttatatttacagcataataaaaacattttacatatttactataaaaaatataataaaagtaatatttttaggagtcattgtattaaggacttcatatgtattatatcatttaatcctctgaggggttctatgagatggaaattcttttattccggtttttcagaataaaccatcaaggccctcagctgcatgaactaggtcacacaacagtaatggaagagccaagatttaaatccagacctgtcttgattgcatagtctcttaccattctctctcttcctggaactgcaaaggatgcaagttttgcatgtattatgtttacgtgccagtttgtaagcaatgctgaagacctacaaaatgagaaattatgaaaaaagtcatgaactttatgaataatagttttcatccatgtcaaaaagtcatagattttaatgaataattgtttcatccatgtcaaaaagtcatggactatgaatagtagttttcatccatgtgggtttcaggataaataagacagtaatctgtaaccctttcctccctttagctttgtaataaaattgtttttctggtgagttttgttggaaatcgtggcacgttcacccgtgggtaccgagcagtcatcctggatatggcctttctctatcacgtggcgtatgtcctggtttgcatgctgggcctttttgtccatgaattcttctatagcttcctggtgagtacatctctatgtggacaatcactgctgaaaaagtacacaatgctgctgcttcttatgcctcttcctttgatttttttttttaagcaaagcctgacatttaggacaaattatgttatttttagaatttcctaggaaaagcgtgaattattatcatttgtaatcttttttctttgggaaaccacacaggtggtggagttctttatttcctctttgagaagcaaccagtcaccccacctcttgacccaggcttcacatgacaagggctgcttttgctttcagccaactaatatttccctttacatttaaagattctctacagtgtgggagacaaaataggggtatattttcttaggtactgaaatcattgtattttatttataatatcaaaaattatgtgtacctttagaatagcatataagtaaaatgagggggatttaaaaaaaccatcatagcaaagagacagttgttttaagaacagtcttatagtttttggtttaatatgtccttgctgttaaacttatctacatatatttaactcattaagtggctctttcaaatttttttctaaaggttactttttaaaaaaattctgatttaccttcctatatatgtactggtttatagccataaaccaggagaggagtcaatataaatatgtgataatgttttgaagcttaaaaagcactaccaggttaccatcatgatgccataggaacaatttatttatctttccagttcatagttggcatgcagtggagagcattgtccaataagatgatccctgaaaacaagttaaacatctaaaaacattttgttgaggaatttgcctgagtcatgagggacaaatccagcacctcctgcctccctattatctagcacaccgatttgagaagactgaaatgaggccaattttccatataccctcaaacatttgaaagagccacagtgaagagtagatttgtctattatgttttcatataaacttataggcagttaagttagattattcagcaacagatattttttccgttctaacaatctaaatgaattctttttgccctgattcaccagaaaaagttcattttttaaccagtcagtgatacataaagtcctattatacccagcacttttacctgactgacatgtaatattctataatttttaaaccactttactgaagtatagctgacatacagaaagctatacccatttaatgtatgcaatttgatgagtttataatacttttgtgctcaactttcttgtttataaaatggataggaatatcaagatccattaaacagatgtgttagtccgttctcacactgctatgaatatactacctgagactgagtaatttataaacaaaagaggtttaattgattcacagttccacatggctggggaggcctaaggaaacttacaatcatggtggaaggtgaaggggaaacaaggcatgtcttacatggtggcagaagagagagaggagagcacgggggaaactgccacttttaaaaccatcagatctccagagaactccctcaccgtctcaagaacagcatgagggaaaccacccccatgatccaatcacctcccaccaggtccttcccttgacacatggcgattacaattcgagatgaaatttgggtggagacacagagccaaaccatatcagataatatgaaaaacatgtgaaatgatgtacacatgtttatgtttttattaaccccattttctaattgtattttcctctggtcttttatctttcaaatcttacaatattgatggtagtttgtttttagtgggttggttctgaaaaggatatagtccattttgatgtttagaggactagaagaaaattgtggtatacataatatcaaaaatcgtatgtaagtatatttttaaaagattttttatatttgaaaaaatatttgaatattccctgttgtacccacaattgtcagtcttttatccagaataataaaaaccacactctagattttgttttcagaaataaatggaaagaacaatcagcttgcccaatgtcaacagcttttgtaagattctgattccatgggcctagaatggaacccaggcatatgcatttttagcaagcatcccaggagctcctgaaagctgtaaacgttctctagagctgacctacagcacattgccagatttttttttctttaaacctcagccgagttgacttaaagaaaaatctcgactatgtcaacttactgcttaaataaatttaataagccacagtgttgacaatttggaagttgaatgtgcattagttaatttgtctgtactgaagaatattgacttcatttctaaagctggctgctccttccaggaggtaaatagattgcaaaatagacttttaaaaaatttaaccatcgtaaaatagcagtttccataggtgagcaaacaagttaatatctagacagcaattatttgcaagactacaattaaattggacagtaactgtataaccctcagtactcagaaaaaaaatagacaaggtcctgaaagggtatatgacacataattgatcatttcagccagttcagaaactctaattactgcccacagatagaagacaaacctcaattattccaattttaaaaatactattcatttccaaacagatatttatacctttctaaaagtgaatgtgattttattgcatttaaccagattttaataataaaacacatactttctaatgtataatttcaactttataatgtagcaataaataaaattgtccttagtgtctacacagattgcaaacacatagcttgactagtgcatagattttctactactgaagacaaaataggtagtaacctattagagaaaatcaattagcaatgtacatattatatttttgtttatacttccatttccaaaagtatatactaaagtaataggtttttttcctcattataccctgttactaaggaaggatgtttgcatttcccaaatagttttaaatttcatacttttccggctgcatcagactcatgaaactgttcttacaatttcacctctaatcccttgattaagtaatacatttaatgaatttgtcaattgttcatcactcaggaggacctaattcagcattctcacttaagccattttacatattccagaagtaactgcagaatatcagtaagaccaaaaataaagaataagtgaataagtagctaagctggtaaagtacaatgtaacttttctgaattcaaatgtaaaactaagctatttctgtaatgttttagtaaattgatattatgttggttttgaaaccaacagatgcacattatatgttgtgctagatgtatctttatagaaaaacaatttattaatatattccagctggagaagaaataaatactttggttcattttaaggtggtttaagttatttctttatatataaactagaatggcttgcatttgtatttgtaattatatttttgtttgttcaccttttcctccaatgcctattagtgttttctttatctttgtagctttttgatttggtgtacagggaagagactttgctgaatgtcataaaaagtgtcacacgaaatggccgctctattattctaactgcagtcctggctctcatcctcgtctacctgttttccattattgggttcctttttttgaaggatgacttcactatggaagttgataggctgaaaaaccgaactcctgttacaggtattgctattaccactaaatgaggtttctctgatggcagatatgacttgtgtgtagcttgttaacaggatcatagataaacacgaatagaggaaatgttttcttttattcctttgagaatatgttttgtttactactaagagtcaggaatgtgaagtactcttaggctgtatattagctgtcaatgtgtatagggaaatacttacatgagaaacaccatcccagctcagtctcggtaagaaagtttcaataaagctgactatattccaaaagatagtcaacaacttcagtgcaggataataactttaaaaatcttttcctcctctttttccctgtctccccaaaaataacagctagcatcattcacaatcattattccatacatgtttgatcatagtgtatcatattatacttaaataactgaaaatgataaatgctttgatttgaaaccaccagatcataagaaatttgctcaaaatattgagcaaaagaaggaagacatgctcaaaatattgggattaatggaccaaatctatcagtgtgtgactttcagaatttctatactctatttttgtcgtgactggttaggcaccgtccatttataatcagtgtgattcctgtggtgttaggctttattctctccatgttattttgatttttttatttattaagctttctaaagtgtttttctccctttcctaccttgtgttgttttggttaagcttctgaagtttattattctttttcctcctcccctgctttgctgggtagaaatcatagttctgcactttgctaatggtttctctgggtgattctgccgactatgggttgtagagaatggaaaccaaaatatgacactctttctcctcaaaccgttaaatgtaaaactaggatttaattagtgatgccttgcaaatggtattctgtcttgcctttaacaaacatttcttaattactaaattgacgatatatggtagtacttagattatggcacttaagtctattagtaagtctcagtcatcaaagcacagaatggaaacatcatatatgtggactggaagttattaaacttgagactgtcctgaattttatacctaggtattagtctttattcacaggaacatagagtattttctgttactgtctttcttgttcttcttccttaaatgttacttttcccagagttttacaggtataaatatggggacttgtgtttgtgtgtgtgtgtgtgtgtgtgtgtgtgtgtgtgtgtgtgtacatatatacatgtagactatctgcttcccaaaacctccacattaattacttactagatttgaggcatgatgacactgagtaactcagtacagattgagtctaaagctgaatcgtaatttatgaattcaaaatgtgtgcagtagttattgtcttacaaatcaagtggtaaatattttgtgctatttaaaaagtaacttggttatcattgtgttatgaacataaatattttctttggaaaaatgccttttttctttttttgttttttacaaaatgggcagcagtagaccagaagtttcaagctctttacttaaaaatatttatacacattcatatagaatgctgttcaataaagcttttataaatactatgaaaacccagcatatggggacagttaacaaagttaaacccttgattattcatatattaagagtgtttgtttcatagactgagattatacatgacatgatgccctaggaaaaacacccttgttttcataatatttcaaatttcatttctaatgccgcatattgtctctattgatacatagtgctaagtttattctttcatgtattggacactatttacttgcaaagttgactatgtatattgagtgacattattgaggacacccctgggtagccagtgaaatttggagtgcagagaaatatgcaactctgtagcgaatgagaagaaaagatcagaaaatcagttggtgggagcaatgaggggaggttgagttctaaagctgaatggtaaagccatcacagggccctgtgagaatagaggacgggtaattggcaaatgccattgcaaacgcagatcctgcctgcaggaccagaggaatctgggttgatagatgaagtagctgccacttgagcaatgttcagaaaattggtgtcttagaaaagtctgtgaacttagagagaaggatctgttgagaagtggaggtgacagtttctctcacccacacctgtccctcttccccattttcagcgccatcctcctgtttctcacccttctgtttctcaccttcatttccactcacccagaattctgctggagccacctatgtggcttccccacctatagcctctcttctgcctgcccaaattactcattccaaccatagctctcactgtctctcattggttcacagcctttagatctgcactggatgtggggttcttggtttaaagtagtggctggtagctctggtcactctggctggtccatgccttcattgacctctgcgccttttgtcagacaaattgtacctggaatcaccccctttgctccctgccttaccttgatgaatctaagtcctatgactcctttagatggacccttttccaaaaagctttctgggtttttttccccctcctagaattcacttcttcctcctctaatgtattacattaaaaaagaaatctgtacttcactctctccagtcaattataattgtgtctatatctctctatgtcctctagctaactgttgttcttccaggcctcagctctgggcctggggggcctagcaggatgcttcagtaagtattaagtaagggaatggccacagggcacactcttctctcactttctgaccccccacacccacacaccctcaactcaggattaatggggatgtgcccaccctcaggggatggaggtaaatctgtgtctggggaggacactagctctctcagctccagtgtttgtgtggctggcaaccccagcctcactctgcctcctcctcctcatgtttccttcaaactccagctttcctttgccatttctaccccatctcagctgattagtcacagtcagggtaatcatggtgtggcattgctgggaaatgcacttcaatactgctacagcctttgtagctacaactggacctacccttgtctctccatcatgaagacttccctcgatggctctatgggaaaaataggtttgagaggaacctctttacttcatgtgtgttactaacaaaaacaacatttaaaaaaataaaacgttgtttcatacaaataggagggtgactattttctattctattctgtgtcagggaaataggtggtgagccaggaagcagatggattcctggggactatggaagaatagaagatcctgaacacagatctggcagaagatttttgctccccaaggcatatgatgcccttagttccctagagcctgtacctgactgttagaaccactaccagcagcagtccctgcctcagttgtagggacgagtggcttagggctcagggactgccaactgcactgaggggaatatgttcctggcatcccaagtcagaaccctgaatgagtttgcccatggaaacattattacacatggatgtaaaggtctacagtattaatactttatctcaaccacttaaaaaaggtataaaaggcttttagtgggttggcctatgaagctattctccatttataaaattgcttcaataggcaaaactgtgttcagaattccatactaacttcctaggactttaggaacacagctaagttggagtatgaatgcctttaatttacatatctttagaactgtaggttcagttttcatcatgtgcatatttgactctatattatatactactttgtattttcttaggcagtcatcaagtgcctactatgactttaactaccatgatggaagcatgtgccaaggagaactgttcacccacaattccagcttcaaatacaggtttgtagaaaggactctgggtcagtatgaacttgatatctttgaagttttatttagtaaatattattacctcttagggaattgctctacaaatttcatgatggattgaaatagaagaatagagagtaaaagaaccaagatgatttgaacaggagaaaggattcccacattggtcattttgtacccctctcctgttcgttatattgtttctattcaggaggatttagcacatttaccctgtggtatgtgctgctgaagattctattaccatattgcaaaccacactaagtgagtcccttttagctgtgtagcctttcacacaggatcgggaagagtatgggcttataattcaaaagacttggtaataatcctggacttgacagtctctagctctatgtcttggacaagttatgcaaatttcctggactttgttcagatgacttgcctgcctatctctctctctctagagagagaatgagaatgaaactttccctgcctccacaggatcaaatggaaccatacatataaaaataataattctttaaactctgaattgatctcataggatgtggcaggctggaaactatggcatgtgtcatatataaggaactgtagaagaaattagtgacctgtttcctgaagcagcaaagatttagggagtgtatgtcttcaaatatcttaagggttgtcatatacaaaaaggagcagatttagtaggagttgatgtgttgtatctacagagggcaaagttagacttaggacagataagggaagaaagagttaagcatagtgtaggtgcggagttccccagtttccatctgggaccacactgtttgtctggtcataatgatagcgctttctttcctaaacggccttttccttgagatgttggactattgcttgaggaataatgaatagacccttctactgactaaatattttatgcttcttgacctaaagagagaattaagcacatgaatacattccatccagtgtcccagcagccataggcactgtgggcagccgtcaccagcacttctctcccctgccgcctgctctcccagtcaaggctcacaataagaaccagctcattcttgactcgtatagcattattgtgctctgcagtttctaaaatcctgctatttgcatcctccaatctaaacacctccgatttcttcagctttcctcacatactataacagtgagtactgccatgacactccagggcaagcagttgaaaagtgctgtcttgttctggatactggagtttagaaccacatcacactcttgatccatatttggctgactcttggctaaaatgccattcttcactggttcagctgtcatgtcataaacagccaccctgttctcatataattaggagtttgggatttcaaatagaagcccatgcattttttttctacatatttctgccagcccataatcccaggtcgtcgcaatttgaccagtgaatagacaggaggtctttgcccggaagatctctcggtttcaggtcccttccagttctaatgtgccatgagcctcatggtgtccgtatggatcctgattctgtcaagcaatatatttattctccttcatgtcctcaagtttgatacacccttgaacagagggtggcaaactatgtcccatgggaaaatatgacttgctctagttttatacagccgttgagctaagaatgattgtaaattttttttttcaagaaaaacatgtgatggaaactgtatgtaagcctaagatagttggcatctggctacagaaattttttttttgccaacctctgttctagaagatttccattaagggtgccagaaatgcataggacagcaatgcagtgctaagcactagaacatgctctcacatggacatggttgcattttgtgcaattcttcagttgcatagaaatctctcttaaagaaactgttaacatcattccgcccatgttcctctatcttttttcaaaggatatcatgagactttttatcaaagactttttgccaaagcccagatacatgatgtctgctacttttctaatttgaggttagtctgaacgtgtactgaatgcactgatagtgtgggttagtcctaactcacactgtctctttagtgatccactttagtatcttgtcttggtgtcaaacagcatttttcagcagcttgcagagtctgtcacagtctcaaattcaggtctacaggtgtccctcattttccatcattatccatgactttttaaaaaatcactttttaaaaagagacattttgaaaacttgaacatagttgaaatagctgggtaaaattaaatgactcctgggatctctttggccacctcaaagttcagattattgtcatcagtatttatttctcttttaattcaacatttccccccttaacagagtatgaaaaataatatgttaaaaagtttattattaacacaaatattttattgtaacaacatggttccaagtatcagtggccctatgcttgcattggtcttctatctctgaatatttctttaatattgtttcctttattttaaagcaaatatactttaactgtggtttgatttcaagacaaaatattgctttgctagtgaaccagcaacaaagctagtacttgttgttccagagtatacaaagagggctgactcagtgggcccagaagaggatctgagtctcacccacagcgtggtagccagggctcccaaggcacagagagagagaactgccagggccactctcctagaatgaggtcttccaggtcattcatagtgtgagactctcccaggatggttggctgcccagctctgtgtaatcctgtaaatgttaggctttatacaactccccaggcatgattgttgatgctcaaccaaatggtctattgtaattatttcatacgttattactattgtgacattttgatcttaaaatttaaaaagtaaatatttttagaaaacgggagagtagttaagtctattcagtacaaaccttgatgatgaggatgataatataataaaagccttgtgtattcattccttcattcattttttcacatagttatatttgttgagcctctactctgggccagtcaccatgctagctgttgaggacacagtgttgaataaacaaacatgattctggcctttatagaacttacagtaagggaaacataaaaagttataagataaggtgagtattactaacagtggtatgactgatcatcacaatagagattggctgttgggagattagacagagagacctttctaagaggaattacttaagttgagacttggaggatgagaaggagctagtcaggccgagaggagggagaagtgtgttctggccacatggaacatctgagagtgaacgccctgagacatgttcaaggacctggagaaggcttactcatttcaggtactgtgctgagcgcattgtgtgcattatgtcacttaattatcacaacaaccctgtgagatagatagatactactagttatccttacattttcggtagggaccctaaggaaagaggcattaaataagttgccaagatcacagctagtcagtcaatgtatatcaacatagatttcaaagcttatattccaaccttctgtcttattgcctcctaattaaaagatcactataaattatttcttccctaaccaaaatttgagatcatttcatttcactgagtatgtttggatagatttttttaagcctttctttatacctactaaagacaatttcttgaatataaatattctctgttacgtatttatgaactggagttgattttgtccccacccctaccccaaccccccagggacatctgacaatgtctagagacatgtctgttgtcacaactgggatggggtgctactagcatctagtgggtagaggacagggatgctactaagcatcccacattgcacaggacagtccacaacaaagaatcatctagcccaaaatattaataatgttaagcttgataaactgttctgtttggatgttattcatgaccctgaatacaaactcttataaaaggcttcccaggaaaacctctataacctgcacttcacctaatatattacacaaagaacatcatttctccttcctatgaacaaatggtgatttgttcctcccaggcacattgggggaaagtctccatcttttaggctgcagcagagctaggagttgggggaagaggtggagatgattttgtaaggatagctgccagagtagggaggaaagcgaggattccatctggagagtggaggagtttcatctctggagatgtgtcacagatactgctggaagccagagatggtggcaatagcttttcacaattagggagtattcctacattagtaataaaaatacaggaatgcctgtattaatctactgtttcttccatacactttttgtatttgacattgtaagtgataaaattcatctgtttgaaaatgttatggatttgatctgctagcgtttggcacttttaaattttgactgcatgtagttaactgcaaaagtagagtgaaagctagaacctggggtttgttgtgcagcatgtgtcacttaaatttaaaaataacttctatgtctaagaccaggattaaattttaacttgcaaaccctagtgtgcatccatgacagccttagtttgttaccttgtggacagcaggtccatgttacaaaaggtacagacatacacagtagcttaataacaagcctcacggtgactaggaggcagagtggccagctccctcagagggctcctgtggatgcagggaaggtcattgtcccagcgccagaaaattcacgcagtaactggcaaccaactgtgtttaaaaaaaaaaaaaaaaaaaaaaaaaccttcatatttcatttgctgcagacctccctggttcctgaacaaaaatattcaccttaaaaaaagcaaggcctttttgcaacaatttacaaaatacaattacaattattttataagtaaaaatcattcgaatgtacagaaaaaaggacaaagttcacagacacttaacatttatgaataattcaaatttaatatgtttggatattttactttaatagaaaagattgatgaataccagaaaccagtcagccttaatgcattctacattttggcttcccactgggtccccagtgttttaaattttttttctcgttaaaatttttatttcttattatttatttatttttccagcagtactgacattttggatatagttgaaatttttaaaatcagcatttccaccaatgaattgattataattaaagcttaagactgacaggcaagaggtttttttgttttgttttttcttttttgtgatggagtcttgctctgtcatccaggctggagtgcaatggcgcaatctcagctcattgcaacctgcacttcccaggttcaagtgattctcctgccttagcctcctgagtatctgggattacaggcatgcaccaccacgcctggctagtttttgtatttttagtagagaaggtgtttcaccatgttggccaggctggtcttgagctcctgacctcaggtgttccacccacaagaggtgttcatttgcactcatactttcaaacgtgtctcagtgacaatcccttgttttctaagaaaccataacaaacactgaatttaattattaaagcagaaaaatggcattattaaataccgttattcaagcatggccaatattttttaaaatttatagattaacacctcagattagagggaactatttcagagccactaaaatatgtttgtattccttccctcatataaaacattttatttgcattataaattaagaaaaaatactgtattttactagtcaactgagaatgaggattatttaacctcatagaattcaagattagaatttgtttattgttttaaaaccaaaacttttcatgagatttaaccactatctctcagtaatgataattatgatagctagaatgtattgagtcctaactatacgccaagcactgttctaagttcttcataggtatatatttagttcttttaaatgtctccacattaaaagtctattttcactaattctttacttttgtttataagcaacatgttctctccctcctcctcctccttctttcttcttcttcttctttttttttttttgagacagagttttgctcttgttgcccaggctagagtgcaatggcacggtcttggctcactgcaacctctgcctcctgggttcaagtgattctcctgcctcagcctcctgagtagctgggattacaggcttgtgccaccatgctcagctaatttttgaatttttagtagagacagtgtttcaccatgttggccaggctgatcttgaactcctgacctcaggtagtctgcccacctcagcctcccaaagtgctgggattacaggcataagccaccgcacctggccctctcccttcttttataactacccctgtgtttatcattacttcctggccaccatcagctggaccattgttcttacatctgaaatcttttccttgtcatcatctgttctctctctttcttcctacacacatcttaggtcccaattcaaccttcctctgggttttcttattccctgaaactcccaggaaactactagtctccttccttcagtaccaaatttccctataaaacagttgaccgaccctctctcctttaatttctgcactgctttttctctaccatttgccttcttcctactgtttcctgatgaccctattgtttaatccagtgactatttttttgcttctcattgcctttgactattctgcaattttgacatctttaaaattattgtcttccttaatttggatcacagtatcctctgaactctcttgtcctctctgacttttaaaaatgttttattgtcttctcattctataaacatacaaatcatctgagatgctttgcttgccttcatcaaaacaccctacaaccagttcttccttctaaatggtctatttctatggtctaatgggacgatccttttcctaagtcacccatggctgggaggcctcagagttgtatttaatgctgccttcccccttctgcctacagttctgtcagcttcctttcattcatcctttgcctcttctctcccattaccctggttgaggctcatagaacatcatgcctgaattattgcaactgcctcctaagtggtctttccacctccagtcattctttcctcttcaattcacccagtatatcaccactagactatttgtcagaaatcgctgccttgaatatttcctcccctaccccaactcaggctttccatgatgctccatttcccgcccaataaaatccaaactccctacagcttcacagagagctcccagtttatcgctccagcttcgtcttccactcctctcacccatacttactggtttatttgctgttcatcgtacaagcatacatttttctacctctggggctttctgtccctggcacttgagatgcctttctactcaagtcttagtacattgatgagtcaaggcaaactcgattctactacttaatatagagtctacattaattagagggactcccctctatctgtgtacagtttatctccctatttctgtctctttgcatcactgctacttctgcattgttgtttgtttgcttgttttttttagagacagagtctctctgtcacccaggctggagtgcagtggtgtgattatagctcactgcagtctccaacttttgggctcacatgacattcccccttcagcctcctgagtagcggggcctacacacgtgtatcaccatgcctggcttccacttctgtgtcttttaccacatgctaatttgtcttctacatgttttatcttgtactatttcaccaactggctggatagccaacttaccctgttgaaagtcttccagtgcctccccctaatttcaagattaagtttaaattcttcagcttgatgtgtgagtctccttatgacctggtaccctcttgcgtttcttctctcacctcccacacccttctgtgtttaccaaagtctaaatcattcccatcttcctgagtttcccaaaacaccccgcatgcttttgtgcctgtttgcctttgctcatcctgtgttatctgcctggaatgtcttccctcattggttttactggccaatcatgaccctctttcaaaatccaactcaggtgatacccccttcaggatactgaagccctcatctgtgagatacgcatctgttttgcctccgcagcatcctgtgatactgcactgcccttgttcagctgctgacccacctttcctagggaccataaattttctacagatgggacacttccatccttctctcatatattcctagcacctcgtccagcggctgttggagtagtgaaaggaggcaggtgtggcatgggcaaggccagctgattacacaggtaaccacaaggtggcatttactagatgaatttaccatgactcagagcctgactttcaggctggatgcctgggaacttggcttaccatattgagagtggctgcatctcacgaaggtagaaccttattaactgagggcatagaggcttctgtataaaatcagcatgcatgtgtactgattatcttgagcaggatgattgctggcattgacctgaccagggtgttctcctcccatttacatgacactcagaaaaccaattctctcattatagatttttcagccaattcgttttattccacaacagctaatcacatgaattgtgtgtggattttactgagctcacctgttagagaacaaacaatcttatttctaaattctcggagagaggtagaagccctctcctgtagcgtttatgtgctgattaatcagcatttactaagcctttaacaaacacctgtgacatgaccaggtagttcctgaatgaataaatgaatgcagatcgtgacgctagatagacggtagtgatgggaagtccagttgtggcaaagtagcatgtagacatgctccacatgacctgattattggaaaatgatttttccccttaaaagccccttttgctctcttacacatttctgactgtttttcctcatattcttctcagccatcatgttggcatctactgccatgtatggggggacctcactagcacattccagactgagcttcccccacccttggtctggcttccttgtctgcactgctgctctgattgctctcaccacaggccctacctcttccctatttctccttcctccaaaggagttctagttctcctactttttaaatcagaatgtgccttggactcagcgctaaggtaagtgaccaagcacagattctgccaatgtctttgatgctgcattttgcacttgcaccttcatctctgacttcagccctcctctcaaggtgtatcccagcatgttttaaaaggaaacagctccaaagaaagtaaaaatatcaggatcccttatccatagaatgttaaaataaagtcggctcagaagaggaaaattagccttttcttaacgaagtatcaaaggcactgtaggcatgaagcacgtagataaagttggactgaattgttcttcttgtttttatacgcatgccttgacgggcatattgtggctgcataatcccaaaatttatcacccctgtggttctttaaccttgtagtgagaaaaatacatttctggtcatttgccagtgttaggaatttctgattctaatatccaacttagtattaatttttcactactttaaatggctaagaaattatgtttcaagttggatcccaatacctttaaacaaaataagaataggaatttttctgtcacattatgtctttttctctttcctcctttatccctaaatagaatttttcacataaatacattgtgcttcttatcaagagctccaggttggtcctcgagaaagcttagacacttaaccgcagtaatgaaataatatctgccccaatttttaagcaactattgtgtgtatgccaatctctgtgcaaagtataatattttacataccctaaatgtattttttttttttaaagacagagtcttgctctgttacccaggctggaatgcagtggtgtgatcttggctcactgcaatctctacctcctgagttcaagtgattctcctgcctcagcttccctagtagctaggattacaggcacacaccaccatgcctggctaatttttgatttttagtagagatagggtttctccatgttggccaggctggtctcaaactcctgacctcaagtgatccacccgcctcggcttcccaaagtgctgggattacaggcattagctactgccccaggacggctaaaggtaattcttaaacaaccctctgaagagtgtaacccccaaacggccctccccattttacagatgaggatcctaaggttcagcaacttgcctgagtcccagtgtgggaacggagcagaattggaagccaggcaagcttccttgttcacgctctctcccctgcagtccttttgcctcctgggtaacgtggctgtgtttccaggttttgccacaatctcttcctaccataacaagcacaacgaatgtgagccttatgttttgtgctttttgtcctgttattttctacctatagaagaaacaaaatatttgaggacattacatatgtggcttcatcattatgtgtcagtcatgtgctgccacatatggaacagatgctgtgtgacttccaaaagttgtgtcacggcacaattagaaatagccctttggaaggaggtaatggtatttttttaaaacgtaagtttgctacactttttaatattatattcatatacatttgtatgtatcttttattttatgtatatttaggtatatttatttattgtatgtatatttacatatgtgtataaatttacatacttatgtatatgtatgtatatttattgtatgtatatttcattttatgtgtattttattttatatatttttacataattttatatcatatatttgtatgtgtttttatagctgatgaagagtatgaagatggaattgaaaggacgtgtgacactctccttatgtgcattgtcaccgtgctgaaccagggcctcaggaatggcggtggtgtgggggatgtgctaagaaggccatcgaaagatgtaagccagagtaaaagtattttttcaaggagcacatcttttttttaaacctttcttcacagcatttataatttagttttggttttcaggaaaatatattgtaccatttgctttaaaagtataaccatggctgttaaagccaattaattgtttgctaggattacatagctaatgtactacaactctttgtgtgttcgtagagtggtgaaatgtttccaagttaatctgtgtattgtattacagcaatgaaatcatgactgcgaactttatataggagttgattgttacacaaataacataaacgaggttgcctcttgcctatcaggtttcttgagcatgaagatttactctttgcttctgcataggaatagcctccatcatttatctatgataaatataacatttgagcaaattctaacaggatttcatatattaaaatggcaaagtggaaacatttctcactagctgcaaaatctcaagtgccaggctgggagcttgaagaatcttagctctgctccggccagttgtatcatattgtcaaatcatctaacctcttaacctcaggttcctcttctgttaaaaaactggattgcctggtctctaatttgcattttaacactgttcatcaggaagaaataagaaggagctatatatacttgaccctgtatggccaagaataaagcctactccagaaattgacaagtcattaggtcctccttagctccccaatcactgacttttggaattgacatttaactaccttttctgtaatgtctgggataggagaccactgtgccaaaatgcatttagcagaatggcataataaagtcctttctaaagaaagtgaagtcccaccattgtgggaaagacatgtgtcagtcctagagaaatgtaagtggttctggaaataggctaggaagtttttcttacaacacttaaagtagagatggaaagtgagccttatttttccaacttgggatactatttatattcatttcacaaacatttattgaatatactctctatgctagacagtgtgctcaatcactatgcctagtgtgatttttttaaatatttttatttcaggagcccttgtttgctgcccgagtggtttatgaccttcttttttatttcattgttatcattattgttctgaacttgatttttggtgttatcatcgatacttttgctgatctcagaagcgaaaaacagaaaaaagaagaaattctaaagacaacttgtttcatctgtggtaagtgttcggcagatgctaaaataatagatgaatagactgtttgcaggaaagaggggctagagggatttttatttttcatgctttcggaaaaattatttcaaaatgaaggttggataaaattcagattatgtaactgagcattagactggaattctctgcttctataaatagagagaggaattataccccaaagctatcctgtcattatttctgtgatttacatgattctctgactatagaaatgtgatgcaaaatgccaaaaggtttcaccaactggcaaacagatttttaatcacagtaacatatttattatgcaacagaatcacatttaattttgttagaatatgaatccaaatatgatttttcagcatcttgaacttctactcactgacatcactatgttttggattctgaactgagccttctctctgtttgtttgtttgttattttgagatggagtctcgctctgttacccaggctggagtgcagtggcacgatctcagctcagtgcaacctctgcctcccgggttcaagtgattcttctgcctcagcctccctagtagctgggactgcaggcatgtaccaccacacctggctaatttttgtattttcagtagagccggggttttgccatgttggccaggctggtctcgaactcctgacctcaggtgatccacccgccttggcctcccaaagtgctgggattgcaggtgtaagccaccgcacccggcccttctctcagtttttaatttctctctctctctctgtctctcttacacacacacacacacacacacacacacacacacacacaccactcccctccccttctcctgtcatcatctctcctagtgcacacagccttctccttccttctcattgccctcatcatccccctcagctctgccctcttctctgtacccatcacctctttctggcttcagttgtctttgtagctggtctctcggcaccctagaatctatcctcttctttgggtgatcacccactctaggtttcattcaccctccttgttgccacattaggctgaaaaaaatcttttggtgatagtcacaaaacaagcctaagggttcactacaacgttactgtatgtaacaaattgggtcctcaatacatttcattctctccttgcttcaacttttgttgagtgtttcgttcacctcaatgtctctccaaaccttttctaccttcctccaacagttgtaggtgtaccaggtaataatgtgtaatattatgctatattcagtggaaacaaatagaaagcagtcattccctgttttggggtgttcacgatctattttgggatacaaacacaataaatagccttgatatctcatgcattgaaggaaatggtagagaagtttacaggaagctgcaggtacccagaggagggatacctctccagcatggggtagggagtgagaaagaagagtcaggaaagcctttagaagagatggtgactgagctggtggtaaaagatgaaagggagaggttgccagatcaaagtgagtacaagcagaaaggccaggataagcaaagtcatggaggtggaagaacagtacaagggtcttcacttactctaaagcagctcagtgttgctgacgtaaagttcagagcagggcgtgctaagagatgaggttggccagaccacgcatggccttttatattaggcagtttggactttatcatctggacttacagtggaagatgaaccattaaagaattttaagtagaacactgcagggtctattttttttttttgctttagagcaccatggcagctttgggaggtcattcatcaggaaacagtaccagaagcagagtcatcaggtaggaggtcattaccacagtccaagtgaaaggtaacgaaagcaggagagttagtggtggcagtattaaggatagaaggcagagtcaagaaatatttaggagataaaatctttaaatcttgatgcttaggaaaggatatgaaagatagctgggatgcccaagtggatggtaatactaacaagtgattgagcttgagaatagatgaaaaaaacaatttaggtaggaatatgctgagtttaactttgagaatcctgaaattgagtgtgtactgacccaccccagtgggatacagcacagatcaattcatgagtctgagcctcagagattgagtcttcgctggagactataactggggaatcctcagcctatgtgtgatagtgaaatctggagtgtggaggagggtgtccgagtgagaagagaagcagagagactacaagtggaaagccccagctttgaagacttaggagagaaagaggagcacacaccaacaactcagagtaccaagtcagaatggtgtgaggagaagcaggaaggggtggcctgtggaagagaggggagaaaacagctttggaaagaaatgaattcgttatcaactctgcccaagcagagaaggccagtaacatgacctaaaaagcctactggtttctcatttaggaggctttggtgaatttaggtagagtggattgtgcagtgctgagtagagatttgctagaaggaaactgagagagatcaggaagaggctgagaggacactccatcaaccttggaagataaatatacctcctcctacctttatagaaaaataacccacaccctgtatttttttttctatttttctctttatgtgacagctatcaccacctccatttcttcacaatagatgtatgtgtgtctcctttcttttcttctcagcagatccttcaggctttccaaggatgattctttcttcccttgggtcacctcacctggagctctgtcctctttcagccttatcataaaaaaatttttaaatgattatttattgaatacttactacatgtctggcttttcacttaggtatttcttttcattttattcttaaaaaatgaatactatgtatgatgtatattaccactcctttacaaacatggaaacagagacttggctcccgtcaacatccagttagtaagcagaagagccaagatttgagcggaggactacctaactcaaaagtccactcagctatcctattctaaaatgacaaagtgacaggttctcattcaagcataaccaagcctgagaacagatcctggtggaagggtatagcgttatggggccaagctgttgtttagaagggtgagtcccatacaggagaatgatgctgccctcagaaacctctctgtgtatctcgtggtctttcttttgcactgcttcttcctccatgccctttttttcacggtcataatcatcatcatgttggtacactacctctgaaagagatgctctttggaagaatggaccagaggctggaagcctcattctaagacatgatattgtctcctatattttaaccaaaaacatgaacagcaacgtaagcccattgcttacccaagattcctgctcctctaagctttcccttctcggtcagaattctctttggcttttcacagttattaaaaagccagtcacctataaattcctttaaacatcacaataactgtcatcaacaaattgaagtgttcttgaatctcactgttaacttcccgctgaccttttattctccctctgcttgctttctctgggtcacagggtcctattccgtctcccaaaaccccttaatagaaggttttgattttgcccttgactccttgtctcctctctgtcctcctctttgacatcacttttatgtagattattgccaagtatgcatgctcagctccaacctttccccaggctttcccctctgttttcagtcactcactggacagttagacaggcatgtcttcccggcagccaaaccggccatgtctgaagccagtccatcatccctttctgtctccctcctctagcctagctctttttcctgacatccatattgctattagtaatatcccacagtgccttcagttatctgagggaaccacaccatcatgtttagcatctccttttttctcttccaggtgccctagctaccatgcgctaatgaacccaccttcacaatctcacccacatccttccacacattcccacagccacatcttagtttttcaggctaacccgggctcacaaccccaaatggtctgctcggtgttgccagactaatttttccactctgaattaatcatttccttactcaaaaagccatcaataacattgcacagtctataactctgtaacttgaattttcctggcatctaagctacccccacaatctggccccttctttttttgcctaccttctcccctgttgttctcccatttatagctcaagttccagggcaactacattacttacctttaacttcccagactctccatgtattcttagttgtgggagaacaatttcatttggaatgccccaattcctacgctgttgaactcctgccctctctctgaggcccagctctaatgccattgttctagaagtcttctccgatctcacacatcggaccctaaattcctcacatcacacttagctatatagcactgtacatatttctgttgtctgatcacctctgctggatgccatgcattctcatatcaaagaaaatgcatgaactttatagacaagtagtcataggtctacactggttctgcatccttgctatgtgatcttggccaagtttctaatcatcctgagctattgttccctcacctggaaaatgaggaatataatgccacggtttggtgttgtgatgagtataaatgagatcatgtatatcaaaatctctagcacgaggcttaactgagggtctgccctcaacacatgttaatttctcttctttaagagaaccagatccatgtcttatccatttttttttgctttcataatgtgcattggtgaatatccataaatatttgcttaatgaatgactatccaataagtcagcctcaggctgatattgtctctatacttgtctgacttataatctacaaaaggcagataaaatattgagattgtatatactgcagacaacaggtgtgctgattccaggttgctccagattttgttacatgcagggtattgtttctgtggagtgctgcccacaggaatgtagggtgacattgcaggatgcacaaagagatgtaagatcaatattgtctgttttctagaagcttcatgtttattcagaaatctgaggaaacacttaagtaatttaaactaagtgtaaatttaaatagtatttttatattagaacaaatagaatattgtaaaatagaacaaattcagcgtgaatatttaaaataaaatagaaacttttttaaaaaatgaataattggcttcaggtactttttgctgctactttctgtaacctcagtaacagaaaggtatacattttctgctcccttcccttaaaggaccttgagcagaaacacataagaagcattatgataatgtatatctagatatgcattcattcccagaagctccaaccacacaaatgatataattcatctcatatatgttaggagaacttagttacaagaatgatttaaatggttgggatatttgggggttgtgctagtaggctataaaatagtgactggtctagacatggttcctggtaaagttggatgtgaagttgtgatccaaagaaggacatagtaccaaataacaaaggagagaatctccatagtaagagagaactggctccaggtgtgtgccaagggacacccagagtaggacaagaggatgtagattctgtgacaggcaatggacctagttggaactttcccagccttgaagacaatgtccagatgtttggaagtgaaacatgactcagaaaacaatagctagtgatccagaaggtggccctggagggtgaggattagcagatgacagagctgagcaggaagcagagacacagattagctcttgcatccatattaattatgaacattgagttactagaggctgaagatccagtaagaaagagatgtcgaaagaccaggtgtgacaaaacaacagaatggagaaaggatttgatgataggtcagaattcctattctaaggatagggtatcttgctgtggcgatattatcataaactcagtcattcaagtatcataaactcaagttattcaagtcagaaaattcagagtcattactgatttctccttcttctaaatctatatctctaattggacatcaagcccgttcaagttttcattccaaaatgcctcttcagtctctcttattcatttatttaattattctgtcaaatttagttgcatgcctactgttctccagacactgccaggtgctggtaatgcaaaaatgagtcagacagtaaaatggtagaggctaagatggaaacaggcacattttcatagtgaagtgttgtgggcccagaagatcaaacagctggttgtgtctgtgggagtcggtggtggaagtggggaagcttgaagaaggaatacttggaaggcagaaaagagagtagatgaaggtgtcttggtgtatttggcgaatgatgagaaagtcagcatgactacaagaactgtgctgagtggaatgtcagtgcatgagtctaagaatgacttcaagttccctggtcaacaaggacttcattaacagagacgaagaagagggctcaagaaacacatttttgacgagttaagtttgacatccccacaagctatccaggtggatatatacagcaggcagctggaaaaaggagtggaaattgagaagaaaggtcagtactggggataaagattgagaaaacatcagcaagatgatggtaaaaccgtgagaatggatgatgaagcttagagagcaagaacttacgaagatgaaagacaaccagtttccctcttttacatttccccctccactgccctggtgcctgggtcttgcatccttagtctcttatcccaatcttcccctgaatcctgccacaggaacgacttgaagtatagctctgaatacactagtttctactcagaagctttcagaataggccgggcacggtggctcatgcctgtaatctcagcaactttgggaggccgaggcgagcatataagctgaagtcaggagtttaagaccagcctggccaacatggtgaaaccccatctctactaaaaatacaaaaattaattgggcgtggtggcacattcctgtaaccccagctactcgggaggctgaggcaggagaatcgcttaaacctggaaggtcgaggttgcagtgagctgagatcgcaccactgcgctccagcctgggtgacagagcaagactctgtcaaaaaaaaaaaaaaaaaaaaaaagaaaagaagaagaagaagaagaagctttcagaataaaatacagatgccttagctttgagtttaaagcttgccgttgtttctgccagatgtaccatttcatctgcatctccaaatgttccctttctgccacaccagagtaactgacattccctaaacaggtcatgtaccttcatctctggcttttccatgccatttttcctgcccagatggcaaaagaacatgggctttagagtcagaaatatttttatttaaatactaattgactcttccgctaaatagggatattaacttgagcaatttattgaatcattctgaatctatttcctcacatgctaaaaggtcagattggattattgtaattataatagcatatttagacatctttatagttgtcagcatcaatagatgctcaataaaaattaagtaccttttattaccattcacttcttctccacttaccataatcatgtactgaggctggatttttcaagctttgcacctcttggaaaccttttaaaatgaccctcatcagagttcattttgcccttctttatgctcccttggcagtttatacctcttcagaatataacgcaacgtgcctgtttcctctaccgtattacagattaattgatagtaagaacctaatttttatagccccattaccttgcaactggtagatgtttgaattgaattctgggaaaatctactttaacattttctctcttttgtttgttttgtttagtttgtttttctctcttttgttttttagtgttttgttgttgttgttgttaatagctctattgagatataattcacacatcatataattcacccatttaatatgtacaattcagtggtttttagtatattcagagttgtgcatccatcaccataattgattttagaacattttcattgtcccagaaagaaaccccataccctttagccatcatctgatccctaaccttccatctctgcctcggctctactttttgcctctgtggatttgcctatattggacattttatataaatgggatcataatatgtgggcttttgcacctagcttctttcacttagtaggatgttttaaaggttcatgttgtagcaggtatcagtacttcgttcctttttattgtaaaaaattatcctgtcatatggatataccatattttatcctttcatcaattaattgacattggggttgtttccacttttagctattatgaataatgctgctatgaacatgtacaagtttttatgtgaacatacattttcagttctcttgaatatatacccaggagtgggttatgcttagttatatggtaactctctgtttaaccatttgaggaattgccaaactgttttccaaagtagctgctgcaccattttacatttctgttagcagtgcatgaggattctaatttctctacatcttcaccaacacttattattatctggttttggttataggcattctagtggaacaatattttagtagtgaaatattattaattcaatcaatcagtatttaattgagtgccaactatgtgccaaatatcattccgagctattgggaccgttggtgaagaaaagaaatatatctgcccaggtggctcttatactctagtgggaggacaaacacaatacataataaatgtaataaatttttatccaagttgctggatgaaataacatttctttctcctttgctgagtatcagacaggctttttcttacacaatcattttacctctttatcttagagatataatccaatttaatttaataacttcgatttggctatattcagtctataaggaggtggtaagcactataagaaaaagagaggaaaagggaaaaggtgatcaagaaggtcagcagaagggttatatttttaaacaggatgatcaggttaaaccacattgagatggtgagatttcagcaaaaatttgaaggtgaatgagttacttaaagagatgtcagtgagaagagttttgtaaccagaggaaacaaccgttccaaaggtcctgaagtccaaaggccctgtgttccaaaaaaaaaaaaaagcaaagaggccagtgtggttgcatgggaggtagcaagggagagaacagtgagaggtaaggttagtgtggctgtgaggccaagtcacataggatttagcaaatacatattgcatgggactcatactaaagaattatttattatttatctgaaattcaaacataactgaccatgctgttgcttatctagcaactctacttgtaggtccttgtaaggactttgacctttatcttgaggaggtggaggagccattgttgggtttacaacagaagagagacaccatttctcttaggtttttaaaggattgctctggctgctgtgttgagaatgggctgtggagagtaaagatggaaacaggggggcctgggagtctattgcagtaatccacatgagggatgacaatggcccagaccagagtgtagcagcagagcgggtgagaagtggtcagattctggatatgttttgaaggtagagccaaaagcatttcaacatggattggatgtgctgtgtgagaggcggagaggattcaagaatgacgtccaggcttttggcttgaacaactagaacagagctgccatcgaataaaaggggaggactgtgggtgaagcaggtttagggaagaaaattgtagtttatttgggcatgctgagctgattataggtcaaataagatgaggcctagccatcagccagcagaatcttatagtattttccatacagatatccaataatgtaagtaaaaagtcaccccttcaatggggacagattttttacttattgtgctttatatcttattatttaaaaaaggtcttcaggctgggcaacattgtgaagctccatctctacagagaaaaaaaaaaagatacaaaaattagccgggcatggtggtgcatgcctgtagtcccaggtacttaggaggctgaagtaggaggatcaattgaacctgggaggttgagtctgcattgagccactgcactccagcctgggaaacagagtgagactctgtctcaaaaaaataaataaataaaagggtcttctacatccctgagtgaacttacaaaaaatgcttagagaaagaatagccagggttggatttcagtttcctggtttcttcttcagtatctgagctgtaacaacctaactgaatcccaacatcccacttcacttggcactcaaattcatgtttccatagatgtttttcttcatctctattcatttcttttcatctattctctaactttgagagaaaagaattttattatctaggtgctttctttactgtacttccaaaggcttaaaaatgtgccctggaaatggaacagatcaccccctgcccaaaatgcctggaacacggtaccctagagggctggcatagtctgagcacttgctgtcctcagcgtgtggacggccatcttctttgtgttcctttcactgattccaagtggttttgaacagatgactgtctcaattctttccctcttttaatccaagtttctgggtaaaatgacattttttttttctgtcctgattagcaagcataccttttcctgcatgatcatttttacctctttttctcagacttgtggtacagtttaatttgaaaattttgatatggctgtatttaaaattatctgcaactttttcatctattacaggactgtgcatttccaaggatccatggggaaaaataaatgttagttgggaaaaaatctataaacgatggcctcttttctggaggtcttgtgtactgtgttgtttttaatcatagcattttaaattggcacactcttactgaaagcatttttttcacaataattattgtgttttgtttttatgctaagaagcaagtactgattaaatgacgaattacatatattgtgttgcctgtgtttttcaggacttgagagagacaagtttgataataaaacggtttcatttgaggagcacattaagtcagaacacaatatgtggcattatttgtacttcatagtcctggtgaaagttaaagacccaacagaatacactggacctgaaagttatgtggctcaaatgattgtggtgagtgaccagaaggttttaatttgtgactatattgtatcttttaggctttcatcttctctaccctaccatcctcccaaaatatgaagattgtagcaatcattttttgttaacatttaaataggcctgtcaatcactgaagaacatctacactgactaagtcattggttcccagtagactccttggttattcaaaccaaatttgagtctccagtgcacagatgatatttcctggattctctttgcaatgactagcaccatctcagttatgttcatcaccttctgacatcataccttttatcattgctgatgtcccacttcctgaaatctggaactttcccattgttaaatatgaacagaagattcataccttaaggaatcccttgaatttcaaaaatcaagagtttaagaaattgaattgtgtttggggatagtatgatgttcagtcctaatgggagagcactgattttccatcaacacatactttggattgatttaccaatgttgctgatgaatttgcactgatcctgccacatctagttgcttataactcctcagcaagattaggacagaggatgtggttgtccatgatttgaagtttcttctgtctcatagaaaattaaaacaaattggcccgaaagggaaattaaagttacaacttcagtgtatatgtgtacacatttagtgagtatcgttacatctgatataaatgtttgcatttttataattaaatatagctatagattggatattccccccaccccccaaaaaaatctgacaaaattgtgttcaccatttgagaaagaggccttagatgactcatgatcctccttgctacttggtcctaaggaaaacacttaataagcaccaatatttgcaccaatgctgaaatgtcagcaaacttatcatctgcttaggaagagactgtagttagggagcaaccaaagaacatttttggaggataacatattaataattataagttcatatagtcatagtttaccttacctgtcaatatttacatgtcacaaaagagctacatgtaaattggatttatatatttcagcatttttcatgctttgttattaatgacttgcattctactctaagttgttttctctgcattcttcattggacaatggacagaacctaacattgtttgtcttctccacttttgcctttctgcctcctcctccttttaaatcagaggaaaaaggtaatcattttaaggatatatattcatggtcatcatttatactttcttgatctcacttgtgaaaaacattttgtttctgcttgctgagggtaaaaacatgtaaaacattatatttaaaatgggacctcacattgctgtcttttttcaaagtttgagtaagtttcatcaatatacatttattagactcctgttatatgccttggatgaatagatgtttgggtatactatacactaaagagtatgatatatttcccctctgccaaggaacatagagcttagtaagaggaaggggggaataacaaacccaaagtagaatatgccaggttctacaagagaagtccaaatgaaaacctgcgaaggcttcaagatggagagtggcatccaatgagagcaggtgaaaggaattgatggggggtggggtggcaatatgcccgagagaggaggatttctgtagatggggagtgtctgtctataagagggagtagcctgaataaaagcataaacatgagacacttggacactcaggggatcgtgagttgcccagtttcactggcacatggtccacttatagggaaactctgagagatctgacaggaactgtagattggaactttgaataaaaaaggtagaggcatttggatgttatttcatcaacgaggggaaacctctaaaggttataactaagggaataatgtgacctaggcaaaaaggcaggcagcagtgtgcaggctggtttggagaggagaaaggaagttaaagatggaatttggcagcagatgagattaggggtgaggatatgtgaggagcaggggaagtcaaagagagcaagatgagcctgagatgccagccagtgtgtgcctggtcattgggagaaaggcggtgggtcatttcagaaggtatctttgttagggaggcaagctggtcagagaagaattcttgttgattttgaggtgagactggaggccaggagtcatgggtaggaggagcagtgttggggcaacagcttgagccttggagccaggagtatcaaaccagtgctctgtctcttatctgctgggtggtcttggatttcatggatgagtcttgaaacctgcctgagcttctgcctcctcatctaaagggaggaactgctgcattgcccacaggagggttgtgcactcagtgagatgatgtgtagaaagtgcctcatagagtgcagagatcctctctgtaaatgatggttctcactgtgacagttcacatagaatgaccatagaagctgtcagattagagaatggtggggaaagggaaagagtataaagacagaagagaaaacttgagacagaacccaggggatcccccattcaggaaaaagaagaaagacaagtaaagaagcaagaaaggagacaataaagaaggcataaggagagccaggaacaggagtatatctaaagccaagagttgaggatttcagtgtcagagtccaacagcatcaattgctgcaaagaggccagaaagaagaaacaggtcaaagcctttggattttatgacctagaaatcaccgggtgacttttttaccttaagagaagactgctgtgaaaatgttgacccatctctggccttaacattaaaagcagcattttaccaggcacttgtacttgaatttttaagtatccaagtacttatccatgtttctccccagcctcttctgtcagagctttctccagagccatgacaagagggataagaactcccaagcttattccaacatgaaacgtttcattttcatccaagcagtgcacatccaagagaacaagctccattcctgaattttaatggccaggagaaggaagagtgatattaactcaggtctgatggaaatgaaaagttgtttgcatggaaggttacttatggaaatagcctctttggaaaacatctaaaaatctgtagctaaaaaacccatttcagaaaatctgttactccaagctctgtggaaatgatggccttctgactatcctcctagagagagagaagattttgtagcacgtggaaagttgaagcacatctacagttcagttcaaagactgttctttctcttctctttctctgctcctgaggtagctactcttcaaactttggtaggaaatcttccagacattttctgccactcttatttttgttctttaaaaataggttcacttaacaagttgatttaggtgcttatcaatagggctttggaagaagtttcaaattctttataattgatgttgcttttacattcatggatttatgcaaaggaaaatgtgaaaagtccttcctcatattagttcacaaaacaactcatctgaatcctgctacactgtttatgtaaatctgatttgtaccttgggacccttagaaaatgcctcctacctttcagagaaatgggaaaaacaagaatagaggttgggtgtggtggctcacgcctgtaatcccagcactttgggagactgaggcgggaagatcatgaggtcaggagattgagaccatcctggctaatgcggtgaaaccccatctctattaaaaataccaaaaaaaaaaaaaaaaaattagccaggcgtggtggtgggcacatgtagtcccagctactcgggaggctgaggcaggagaatggtgagaacctgggaggtggagcttgtagtaagccgagatcacgccactgccctccagcctgggcaacagagcaagactccatctcaaaaaaacaaacaaacaaacaaacaaacaaaaaaaaaaacatagaataagttctgggaatgttcctccctctgtatattttttcacctccaatgcttcagctttgttaccatgtcagtaaggaatatttatactaatatccattaaagcactgtgttagtctgttttgcattgctgtaaaggaatacctaaggctgggtaatttacaaagaaaagaggtttatttggctcacagttctgcaggctgtacaaacatggaactggcatctgctcagcttctggtgaggcctcaggaagctttcactcatggcagaaggtgaagtgggagtaggtgtgtcacatgcaagagagagaacgagagagaggggagggaagtctttaacaactaagtccagagtgaactaatagagtgagaaatcactccttactgtagggagggtaccaaacaattcataaaagatctgcccccatgacccaaaagcctcccactaagccccacctccaacaccagggatcaaatttcaacatgaggtttggaggagacaaaccatatccaagccatagcacctcagtttcttcatttgtaaaattcagataatagagaatattgtatctattgatgacattttaatatgaagtttggaggggacagatatccatactatatcaaacatacattgtaaataaagtaatacattgcttctaagggttagaatcgcaggaaacacatatgtgtctttgtatccatccaataataggatcggggtctgaaatattaatcaaaacttaaaactttcttacctctgttttcaaattctttttttttgtgtgtgtgtgtgtgacaaattcttgctcttttgctcaggctggagtgcagtggcacaatcttggctcactgcaacctctgcctcccaggttcaagagatcctcctgccttagcctcccaagtagctgggactacagtcatgcaccaccacaccttgctaatttttgtatttttagtggagacagggtttcaccacattggccaggctggtctcaaactcctgacctcaagtgatccacctgcttcgatctcccaaagtgctaggattacaggtgtgagccacagcacctagccttaccttcaaattctaaaccaagctatttaaatagccactgtttgattatttgaattaacatggagcatcttctgggatattgttcagggaaatatgagtagatcaaggtattttggggatgtaaaccctcatgtttgataaaataaatgatattttgagctagtgtttgctgggaacagaaagtaagaagggaaaaggagcgaccatacaggaaagtaaaaataataaaagaaaatttagaaaactagaggaaaaggtatgaaaggataaatcctccatcccatactgataatggcctttgagcatcactaagcccctttgcttctcccattaagcaaaggatgatgactgaggaggaacaaacaaaaatagacatcattagaaaaaatacccaagacttttagatgtttctctaacattttggggtcattttcagattaccagtgttcatttgctgaggtatattaacggatatttgtacttaatttgaaaaatagcaggatccaaaccagaggtctgtataagagcaggcggcatgcgtgtctggagagctgctgcctccacaagtattctgacagcactgggctgctagtgagacctggatggccaccctccccatgtcatggccatgggttttcgggaaccgtttcctccttttactgcatcacagttgcaaactcgtctatttatttttctcttgattaacaactgcactctgacattgcagcagtgttgatgaagacaatttaactcatgtttttgttaacataataattgtctgtcgtaactaaaatataagtttcttgaaagctataatcaggtatagagaaaatctttgttatgcacaataccagggcaggtaatatctgtaatatgtattaacagcaattcactaaacattgaatgtctctgtatgctggcacctgtgctaaagatttgctgtataaagataaataggaaattgcctcttctcccacgaaactcaaaacatttattgaatgaataaataataggtgaattaataaataaatgaatggtttctttttagccctctgggagttggacataatttacagaaagatataccaagatagatgtgagacattgcaacacaaatttctcattagtcaaatgctatctgtcccttcttttgaaaactgaaggataaaaatacagcaggaagggttatgtcccttgacccaaatcagagggctgatttgaaagatgaggctgtaggcacattaatccatctgtggcctctctcatcgtgtctctccaacccagcctctccctcccacaggagtaggccttcccctgctctcctagcagaggggtggggatgcacactggtggggttttcagcataactcacccttaagaatgaattcctccttgccatgatctgttaagaccttaaaaagaaaggtcatactttaatgagataggaaataaatctacccatctagtcacccagtactttagccacataaggaggggaaagaactagcaatttcccaaatgttgttttctgagtctggaaatcaaaatcagtcttgtttagttaaaacatatttttgagcagtaactgttggaggggagatgtttgggctcatgaaagccatcgagtcttctaagatttctatgcacccctcctgctttagcaccactggccaacttaatttctgcattattgttatgtgtcataattatgaaattatatgttctgttctattacttctagtttacactaattttgtaattggatctcattaagccaattatgtaactgcttaatctttaactaaacactattttaaagacttcagaacttaattttaaatgtttacatttcaaggaaagccaagggggtctttgcagctcagaatgcacaattaaaaagtaaatttgagcgttcagggagataccaccctcacttcccacatgttaagtccagacatgtgtctgtaatttaagatggatcttttaaaatgcccctctctggatttttattgtcactatgggatctgtcccctatgttattctcattttctctttagtattcatgtgtaagaccatgaattacctcatttttgcacagatgttaacatctttctattcctcttattagtttgtgaaacagagacagaagtaataggtacttaacagtgtggctgaatgctgttaagatgaagatgaagaagaagacttcatcttaaggattctggtccagtgcttaggttgttagactttggtgctggaagtgaggataaaaggatttggaccaactagtgtttaaatgattttcatgggtagaattgccatggagaataagaatgagggaaggcaggtaagacactgaacctgagatgttctaggttacttcctgaattgatcagaaactgtagatctgctagtgttcgggtgattggccacagagttacagaacccaagtggcttttgttagcttttctaatcagtgtttaaggagaagttccgtgtgaaggaacaaacctgagcatatgaatctgaagtttgatttcttaggatttccatttacaagattagtgactttacttatctcctctgtacttcaatgtacccattgataaaatatgtataatgggccagttagaactcaaaatagaagccaactgaagtgagctaggactctggaggcctctggctgtatcaggcattaacccttcagttgttggatcatgcagaggaggcgtggtggggatcccagaggcagactagggcagataaatctgcaggggtatagggggagggcgtatttggagggcttatgagaggggcttacttgacaatcaggagatattgcagtacagccatatctttgcataccagctaaatattggtactgggtataactgcactttttttgcagagctgctatgaggattcaataaaatcatgccactaacaacactacaactaacataactgacatggataagtattgactgtggataatagccactaatcatgccactaacaacactaccactaatataactgacatgggtaagtgttgactacttatccagctgacattagataagtgcctgtgctatgctaagtgctttacatgcatgatctcctttaaagcctcgtgacaactctaggaggcagatcctattgttcttattatccccattgtacacatgaggaaactgaggctccgagaggattggtagcttgcccaaagtggcacagcttgcacaaacggatgccatgcccataatgtgccaggtgcatgcaagtggtcaataaatgtctattagtattcgatcccatacaatgtgtaaagctagaagttgtgattcctttgggaacaagcaaggccagctgtacccaaccctctcggcagcgcacatggcactttacagaaggactataaaaattcagtccacagggcagggagtagacctggctaggagacaggaagtcagatgacaatcctacaatggcaggaaggcctgagaggaattcaaataggaaaaaaagagaactcgttcagagctggttggcaactgcatacttcctacaaagattagaagtattacaattacaattattacaattgcaggcgagaaagaaaaagaggctgcaggatgtttcaatttaatttgacgagtatttactgaggagaactatgcatgaggcactgataagaataagaataaaatatcattgccctcccaggaccacactataactagaaggacagctttattcaccagaaatgactgtgcaaatcagaacgaactctggtacagacattcagcggccagagaaaccttaagtcaaatcacaccactgcacccctgcttaaaacctgtccatggcacttagattaaaatccagaatccttcacagactgcttatatagtctggccccattctatattaccagtctcatttcatcccacgtcccttagccaacaacagtcagccacattggcccttcttttctcaaaaatgccatgcttttccctgatgggagcctcggcccacgtgtgccttctgcttgtggtcatggtcctctggctctttgcagtcatggtcctctggctctttgcatgtctgtgccttccctgacatccccattcccgttacttcctagcccaccaccctttatttcctttagctttatattgatctgaccttaaattgtttttatatttattggagtgtttattcttcatcagtaccatatgcaccccattaaggcatttacacttctgctttgttctcttctgtattcccagcacctaaattaatgcccagtatatagtaggcactcagcataaattcgttgaacaaaataaataagatatagagccactggagcacagaggacaggttctttctggtcgaaggcactaaggacagtttcaccgagaagattttgaggagagtcgagctaaaaatgaggaggattttgatagaaggatggaggggaatatgttccaggcaaagtgtgtatcttaaaagaaaagtgtgagaacaagaaaggaaacgaattaaggatatgatatgtgttagcaactttgcgtgttatcttatttatacccattttatgtgaattgaggctcagaaaaatgttagtcatcccaggtgctctgtaaataagtacttgaactaggatgcaaatccagattttcctgggaccgatgtctatgattttacctttagctatgccttcttctagtgaataatcaggtaaaatttgacaaaggctaaatatatgtaaatcaagtattggagaacaggtagggaaaacctcaaaaccaaaagccaaaagacatcctttagaaggaagaaagctgtttctgtttctccaatatttttaggagttagaatttttaatctctaagctgcattcgtggaggtgtgatctaaaatgccttgaaaatgcaggacaatgaatcattttttattttttaaagatgtgtttattcaacaaatgcagattgagtgttattgtgttcgaggtgctaggcttggtttagagatgcagagttgaggcagattctctaacttcccttgggaagctttggtaaaataaaggaaatagataaaggagtgatgataacacacggcagcagtggagtctgccagagcctagggcttgggaagggaggcttcatggaggtcatgcctggatgcttgaggctgatcgggtaaatgaagatggaacacgtagagggagcaggtaggtatgtctagaaaaacagtgaggacatttgggagggcaggaggctaaagtagtaaccaggagccaggttgcaaagggccttgtgtgcttacaaatttttactttatcctgggccgggcatggtggctcatgcctgtaatcccagcactttgggaggctgggacaggtggatcacctgaggtcaggagttggagaccaacctgatcaacatggtgaaaccctgtctctattaaaaatacaaaaattagctgggcatggttgcacactcctgtagtcccagctactaaggaggctgaggcaggaggattgcctgagaacaggaagtggaggttgcagtcagccactgtactcaggcctgcgtgaccaagtgagacttagtcaagaaaaagaaagaaagagagagaaagagaaagaaaggaaagaaagaaagaaagaaaaaaaaagaaagaattgatttactttatcctgaaagttaagggaagccctgcagagatattaaaccaaagagacaggagcagatttacattttagaaagcatgctctatagcagtatacgaaatggattcaagggagccatcctggaagaaaaaaaaataaacaggcagaaagattttattacccagcaacaataatgagatctggtactaaggaaatgccactggaaattgaaaagaaatgatggctatgaaaaaattaaggtagaagttttaatgaaggtaaggggaagactgtttaggtccctgacctcagagagtcaggggagggagggttgagcactggggagagggaaagggttccacaggaataagttgaggagatgtgatcatctcagtttggcttatagtgcctaagtgcatatgtggacttggacattttcaaggcattttcattttcgagatattttagatgatacctccacaattgtaagttagaaattaagaattctaatacaaaactgagtatataggtctgtaattcggatgagaaatctaaaatggacaatctactaaaaaaggttaattaccacaaggataagattttagtgtcttttttgagaccgggtctcgcccttttgctcagacatgatcctggctcactgcagcatcggcctcccaaggctcaggtgatcctcctgcctcagtgcccccaagtagctgggactacaggcacacgccaccatgcctggctaatttttctatttttagttgaggcggggtttttccatgttgcccaggctggtctcgagctcctgagctcaagtgatctgcccacattggccttccaaagtgctgccagattttattttatgcactagggcatcccaggagaatagaaaagtgcctggtatatattagatactcagtaaagatttcttaaatgatcacaaagatttgtaagttgctggagtatacttgatagctgaaatcacagatttaggtaaggctatgcaaaggaaactatatagactgagaaattcagaaaaagcatgccctcagacttggaatagcacagacctatccctgttatttaataataatgatgataataatgtcaaaagtctactactcagattttactcatcaaaaagtagaaccaggagaaaaacagttttcatggtggggctctgaaagaggatgttgacttttcattagccagtgaacctagaggtggtgtggtcagtttgtggatatcatgtgatctgacattgattacattttagtatgaaattatgctgcaaacccaaatgtttagagcaaagtaacttggacatgttcagtatatggaagcttttttgaaatgataacccatcctaagtcatttattttagacttatgaagggatgttcacttctctgattctcataaccttaataaaaagatttcctcctgctgtgctgaagaaaattcttgtttcccagttctagtcattacggtaagatcttgttcaattctcagttggctttctggaataataatgtccacattgttaggactgatacattttacttagaaactctggctttcttccagggagtaacagatgccatcaaaatgtaagttgtgggaataagaactatatactgtaaagccacacgaattctgtctaatggtttttaataggctagcatagcccatgccatattgtaagtaattagttaagatggcaattaagctgaaatactactcttgttttagataaggttatcaggcaaccgcatgtccataggatttgggactaattttatctaagggaatttctgaaaaataattgctgaattttacaaaagtgattcagcacttggatttcagagattagtcatttaatatcaggttagtggagtcagctactttgatgggatttagagatcaagatgttttggaaataatagcatctgaggtaagttaccgcagctctctgagtctgtttcctcctctgtactcccctttactaggattcctgtgtggattaaacacaatcacatctatcctagcacctaacatggtgtctggctcacagttactgttcaacaaatgtttaatctcccacatctacttaaaatatttggctaaataaataatatggctaactttaaatactattttgtggattcaaaacattcttaaaccattcaatgttcaaagtcttcactgattctacatagtgtttcttttataggttaggcaaaggtcaacttccatatgttcaataaatacatagcacctataatgtcctagatgctgcgcccacatctggaaagggacgcagaggagataaagacagccatggcctgttgcacagttacctgtttagagctgaaggcagatcctagacaagtcaccacaggttttacatagctaaatagtgagtattaccatcaagcgaaggtcaggcagaggggcttcctatattgttgtctgacacaaacctgtttggcatttgttcctttgtctaaccaaaagttgggagcttccataaatatttgcattgctggaaccattgaatccatttgagtttacaagtgatgttaagacagatcttaccacaaagaggtgtggtatgacaccatccggagtgccgcagagaggacatgaggacagacatactgtgaacaggagtggtaggagctaattctgagtcagaacccaaattacataagaagaaatgtcatctagtttacttctatccttaccctgggaggctaggggcaagctctgcctgcttctaggttatatcatgaaagcaacaaaggatgtttatttcattttccaaagaatacattttgggctccttcaagtgaagaacttgaggcatttttcacacatgtaatcagctttttcattttttccaacatttgaaaaagttccagtataaagcacatattttttgctttagaaataatattctggtctgtgtccataccactctgaatgcaaccgatctcctctgatctcagaagctaagcagagttgggcctggttagtacttggagaaataatattccggccctccaagtttccttctgaattggggttctactgtgattgttaactcttaagaaagatttcaagtgtttttgccattgtgtgaggttattgataagcattccaaatacaaatgacataaaaagcaccagttcaccagaacctgaaattcaaaaatggccaaattcagaggtggtttatttgcaaaggtacctgtaacttttcagaggtaattactcagggatttcttttgactctcttggcaacaggttgtgatataaaggccctgggtcctggatgcactaggtaggcctatgactttgagaagagacttgattgccacagatgtggattcttcattcataatgagaatccaagtgacttccattatctcttctgtcctggttctaaaattctgataactctaaaatatttaaaatatttctttacatgaagttgtgggtatattaatgtttattttatcttacaaaccagaagcaactgggacaggagttttagagtggtccagatttgactatttccattgtattccttggggggatcatatgtggatcagctttccccggctgttgtctggctgttaagttctgatgttatgcagtccacatgattacacccttgtgctgcggccttttcagtaggacaacactgattatggacagacagtgaattttcttcgaagacatggatccagaccctctaagagaaaattaaatggtgattctggctggggtcggggggcagtgggaggcgcgaggaatttccactgtctcaggctacacctatgctgaagggcctgtgagaatttctgtttcccaagcttaggacccagtaccatttggaagcactaaacccagtttgaaaatgctgttttagaaaacaaagacatactgccaacagatatataataagataacccattttattggggtgataaaagttattcttacttgagagtatcacagttgcctcactttattttctgatgtataactcacttgtgtccaagaataaatgaaataagagtctggattgtagaaagagcgttaatggaaggggtgctgttgtgtgttagacacagtgcgatgtggtggtttagacagactcagggactttggaagccttgggcaggcatttaacctccctgtacctcagtatcttcatctgtaaaatgcgtaaacatccctacattcagcgtttcctaaggattaaacaatttaatgtttttgcattatctaacagacagtacattttaaattaaactgtaaaatatgtatgagtgttagaatagcatttcagggctcaataaattattatttattcaacaacttttgcttagtgcctaccatgatctagggcaatggataagatcctgcaggagagcacaaataaaggatgaataaattccctgcttcaggaatcttgggcctaatgagaaataataatatatggtcataaagatgagttaataacaggcagcaatatttgatgagctaagatgaggagctgtcctctagcatgggaagaggaccttgtgtataaaggaaaataggcagatctgaataattgaagctcagagagtaggtgaacccacctggattaggttggagctaaagggaaacaggaattaattctcagggtaaggagttcctgtttgatccttcaaacacaggagaggcattgatgacttttatgtagaggaattatgtgatttttttaaaaatccgattttaaggaagtatcaaagagtctatagcaggatttcatgaaggggcaagagtctggcagaaggaaaatcagtgaccatcacactgatgaaaaatgtgatagaaggaactggaaataggaagggatgggtgtggtggaaagaagatttgaccaagagtgacaatccataaaccaagagggctcggttcccgtacacccaaccccgtacctgcctctctcactaggctcagccttcctgatcttctttatgaggctttcaattctgccaaccttggcttctgctgttcccttcacctggaatgcttatcttcagaaaataaaatcttccttttgtggccaatccacctaaagacctcaggccctctataagagcacttcgtcatagtctatccaaagcgtttaccactatctcaaattacttgcctgtggagttgttacctgtttttcactgtctttgtttccttgtgaactggactcttgatgtcttggtaactgtttccccagtacctagaactatttctgaaacccaaagggtcttaataaatatttattgagtaaatgaatgaaataattgatctctaaggtcctttctagcaccagttttctgacttcctgactttaggtgaaagagaacttaagaaaactgcttgctgacagagtatttaggagaaagggaaaaagaagactaaggttttgagtttgggtgacttgaagaatacttttaatgactgaaatatcagtttttatcctctctcctcaaacattcaggcacactgattttggttgccagctcattccatgtatggtgtcaatgggccatccagagggcaatgatatcctggtccctggagacaacaaaactgggatgtttcaggagagaaaacagaatgaaattgaagatgggagttttggaaatcatacataagactcgtgtttggccggacgcagtggctcacgcctgtaatcccagcactttgggaggccgaggcaggcggatcacggggtcaggagttcgagaccagcttagctaacatggtgaaaccctgtctctactaaaaacacaaaaattagccggtggtggtggcaggcgcctgtaatcccagctactggggaggctgaggcaggagaatcacttgaacctgggaggcagaggttgcagtgagccaagatcacaccactgcacttcagcctgggcaacagagcaagactccatcaaaacaaacaaacaaacaacaaacaacaacaacaacaaaaataaattcgtgtttgccaactagtagtaacagactgatttatttgaaactgttagtggagctagttatattttagtgaaaattccgcatgggggaaaataacccaaaagaaaatggtaagagattttagcaggtaagtccattttatcatgtaatatttacatggatttgctcattgtttaggagagagtggcagtggaactaaaacactcccttctcattaggacctggctgtggataaaaatttctccccaggtccatcccatcttatgcagtgacaatgacctgtaatgctatcctgacaccaactggtaacatactgcagtataattcccgggctaaccacccagagtcagcacagaccacacaagttccagggcatagtcctcaaaaagatgcccttacttcatacgccaactgctttttgggtgaccccaggccactcatactttggaccaaataggtacaaattcaggggttaccatcatcccttcagtttgataattcactagaatgactcacagaattcacaggagcacagtacttgccattacagttttattataaaggacacagatcagcaacagccaaatgaagagacacatggggcaagatctgagtgggttttgaacgcagggcttctgtgccctgtctttgtggaatctgggtacatcacccttctggtacggtgatgtgtttaccaaccaggaagctccactgagcttcaatgtccaaagttttcacaggggtttcattacgtaggcatgattgacctaatcatctgccgtataattgagctcagtctcagcccccttgtactctccagagccgggctgactcaaagctctctaatcatgcagttggtctttctggtgaccagcctctctcctgctgagtcatcccatctcttagcctaaactcagatgtgatccaagggctcatgaataacacagaaacttctgtcatttgggaaactccaggggttttagaatctccctcccaagaatcagggacaaaactagtataagtctttattatacatcaggtgtactgcatttttctgcacattcatttgttgctttttaatttaagcacttaattggaaagaaattttaaatcttaactgaaagttagcccttctcattcctctatccctcttatacacgatgtacattcattccatcaaaatatctcttcacattatttaataaaactgatattaatccactactttctaaaacttccatcattctaattcagatagccttcaactgtcacctagaccatgacaggtgccactaaactggtcttttttcttccatacttgcccctctactgactatgcctcaaagaaaaaaatgaaaaaaatctaaaacataaatcagaatatgtcacctgccacctgctccaaaccttccactggctttctactctacatagaataaacccgaaccttcttgtccagtcctacaagctctggcacctgctatgctctgccctttcctcccattcataggctccagctacatggactttgctgtttccataatatgccaagcttgtttctacctaagggcctttgcaaatgttcttctttcagcctgcagcactctacttgttcctttacatcctgcacatctctccttaaatgtcatcaactcagagaggctttctctggtcaccttttctaaagaggtcccatctccccactatgtcattctttatcctcttaccctgatttttcatttccccaaaacagctatcataatctgacatcatgttgcatatttgttttttattgtatgtctccttcatttgaatgtaacctgcattagggcaacaactttgtttttttcattgttgtattatcgggacttagagcagtggctggcacatagtgggcgcttagtaaatatttgctgaatgaataaatgactgaataaacaaatgaatgaacaagaaataagtaatgatatatctttagtgacttagcctagattcttaataatgcaagtgatagctagagtaaaaatgtatggcagctgaaagcacaggtattagtctgtctcagttcacatgccagcttggctacttcctagctgtgtgaccttggggaatttgcttaacctctctgagccttattttgtctctttaaaaaaagaaaatgtagtaatattatctacctttacatttaaaactgtattcagagaccttttataaaaaggaatatactctctcccaatacctataattcttcaatctacacatattcaatggaacctgtgattaaaggatccaacagatctaagatagaccttttatatatacaagactagattagaaactaagaaatataaaagagtttggccaagttactgcttcttgcttccttttttgaaaaacaaggatgttgaattaaatctatccaaagactctttgagtgctgatattttgtggtgttgtaattaaaaccacaagtctggacaaacttggaagccagagaatgatagggaaatcatataccaagctcgaagaaaagcagtgggctctcttctttattataaggttctgctcatttaaatagtccccaaagagtcttccaatgtcaaataaactactttgcagaacataatcagaagagcatggttcagttggctgtgattaggttgccagctctggtctgcaggggaaaatcacaaagaaaatgtagtcgaggctcgagttggatttagtcaacaacccatgtcagccatctctttctccaatgaagtactatctaagaaggactagaaatttgttgatatcattagtgaaatatagtgcactgtgtaagaagaactagaaacaaacagtggtagaaacatgggctaatacacatgaatacaatttctctatctggcaacccatgcaaattatttgatcttttcaaatcgtaataacacagaaagtcttcccagaagaaataatttgttcctactgcccattcttatttgttctaagtttgtgtattagtttggctgtattgccagattacttctcttcatataacttcatttttcatttagtttccctatctgcgttaaaggttttttcagatttttatatttgattgctaacctgctttgtgaaatcttatcctttactatcttcatcttgcatctctggtttttttttcctcagtgatttggtggatgtgaaaatgatagaagctaagattacatcatctttaataaagaaaaaaatatagggtatgtggaatgcaggtgagccatggagaaagaaatcaatcaggttggcaaattgcatcaatgggacaaggtgcaaaatgcttgtttcatgcagtatttattgaacaagcttgttgaaatatagttaaaatgtatatggaaaagtaaggagccattttgttcaatttaaatgacattgatatatttttttacatcataaagtctttcaatatttccaacaacaatctttggcacagtactttatacaattttctcaaaggcccttcagagataaaagtatatatctaaggttataaattgggtatatccaatctacatataatggaagccactacagtcactctgtagaattcaatagatcaagaattatattcaggtattacatagataaagtattcttgagaatttgggagaagttgaggttttgaataatcctcaaagccctcagttgactgtcattttttttaatcgctcccagttctaatggcatctggatgattttttgtaggaccaagtaatcagctcatgctctcttctcttcactgtggaaaggaagtcttaatgttgtttttagagaaccagaaaaatgtattcttccaaaattggcagaaagggaaaaatgacttttctttttttatggttttggaactaccaaataggcatcctttcgagaagtgactgctctacaggttgcttttattgctgtttctcaaaagggaacatttgcttaaagtacaccctcccagatcaagggggtccttccctcctgtggcagaggtaaataggggtttacaacgggaagaggagtattctctttaaaacttacattctctttagtcttcccatcctaaaagaaatcataaaacaacagtggcgaagaacttggtagattgtatttgagttatttcaacaaaaagaaaatgtattttattttgaagatagaggagaaataggaccacagttgggtgattcttggtaaagacgtccctgaaaaatacaaacacaatctgaagctactttctggaaaacagataactatacacatcaaaatatcaaactaaaattagcagaaagaattgttggcaaaggttttgtaaaagaacagttgcacagggcatgaaattgtagtgaaagttcacatagcctttcattacttatttgtcatttagttggattttcttatttgtccctcctgttgctatcattagccattaagctagcagaaacaacattttccacatcacatgggcaatgtctttagagtttgcaaagagaacaaggaaagcaggctacactgtttcatgaaaagaccaaccgatgtaggaaaataagaatatttgttgtataatcactgaaaacctgtcagcaagcagaagaggtttaactggtaattactttaaaatagatttctcttctggtgcctttttaaagatattctacgtgttatttttattttgtagtttaaaataatttatagttttcatggtaaatttgacagtgtgcaagaataatactgaaataaataatattcaaaaagaaatggtttctaagcaggcagcagctgtgggatcagtgtttgtgtaagacttttcctttgcacgctcattggcttttgtgtttaaacacgttggctgccctcttcattgacattgtcttagtcagatagaattgttttaaacaagcattctatttaaactccttaagtgatagatttgccttttaattaaaacattattcctttagctagtatgcaagtattatccacagtttattttccaaagaaaacaccttctctttcctacttcctaacttctagaataaatgcacagatgagcaaatttatttcaggatttaaaatggtaaacttacttatataatggtaaacaagcatgaacaatttaacatttctagggtgtcatgtgtacttaatgaaaattctgatctattacttctgaactcctgtgtcatgagtctggggatacagtacgccaaggagaaaaaaatacagtttcaggaaaaagaaaaaaagagtcatgtaattaaagttgcaggagccatttcttgaatcctggaatgtttgggaaatatacaatgccctactcttacgttaaaaattttgttaggtacccaggtttcaggaatcactaagcttcaaattacattttcattctttgtagtgacaccgttcattttcctttcctcaggtcctctgtgttcaggcatgaaaactgtctgacttgcctagagtttccagtttaaccttgctagtaaaccctaaaataaaactatgactcccttctgtgttctacctgggccagtgtgataccaatgagtctcgcttcgcaattcatgttcattatcgttattccctgattataccagataactgtagtcagaatactgctttgcttaaaatagaacgcagtgatattgggttaccacatggggaggccgacctgaagatcatcagatggtctctcaggacagtgctccagacagtctctctcttaggggacaaaggtccaggcccagtgctaacctttacagactcatcctagaggccgtcagggtacacagaacaaattgggggtagtaacacactaaccggagtcaaaagacagaaatgtggataaatcagaatacctatgcattgatttaacaagataaattgattttcaagcaggacagacacacatgatggcaggtcagtgtatttttccctgagacgccagattataatgagaaggttggttgctgaatgagcagaggttgggagcaaagggagttagttggttttatgatttgaatagttgaccagaccgagataaacagatgtaacctcattgctgcatccagctggagactagagtttagacaagggcttgcttaaatcctgtgtgtgagtcctggctttcccacttaccagctctgtgaccttgggaaacactgactagtatctaccttagggttattgtgaatgttcattcatttattcatttatactatgtataaagcacttattttgtgccaggaattattttaggcccatatcccagaatggcagtgaacaaaacagataaaaatccctaccttcatgatgtttacattctaacacacaagccatcaatacgattgataaataatatagtctgcctgatggtaatgggtgctacagagaaaaataaagcagaggagggaaaatccccaggacaggtggattcactgttaaataaaatcaaatcttaaatgtaaagatgatggtatctgacccaccattttttttattctagtgtggtgttattattatgactttcattttatcttctctgaggaacaggcagagcctagccaaatatccacgggagagtgccagacacataagctagttcagcctcattccaccccatttgttccaagctcagtgcagtcttcctaattgccagtgttgcctttagatttgtaaattccattgattagttaacagttgggtctttctttgttttagaagacattttatacataaaggtgtcattatacacttttcatttcctttatcatgagtcgagattttaggtctaacttcaagcattttagaagtatctccatacttagtgcaatttgtaggactcttttttttttcttttaagttctgggatacatgtgctgggatacatgtgcaggtttgttacataggtacctgtgtgccatggtggtttgctgcacctatcaatccgtcatctaggttttaagccccaccttttctaagatcagatcacgaaaatggtatcagtgcattgtgatctggagagaaagtcttagagtctggaaatcaaaaatctgtattctagttttgctttctcattatctagatcagcagtccccaacctttttggcaccagtgaccagtttcatggaagacaatttttccaggcactgggatcgggggtgagggggtggaggtgggaatggtttggggatgattcaagtgcattacatttattgtgcacactttatttgttattacattgtagcatataatgaaatattatacaactcactataatgtacaatcagtgggagccatgtgcttattttcctgcaactagacagtcccatctgggggtgatgggagacagtgacagatcagcaggcattagattcttaaaaggagcatataacctagatccctcaaatgcacagttcacaataggaggttcacacttctatgagaatctaataccaccgttgctgtgaccggaggtggagctcaggcggtaatgcaggcgatggggtaaatacagatgaagcttcactcactcatctaccactcacttcctgctatgcagcccagttcctaacaggccacagactggtactggtccatggcccagggtttgggggccctgatctacgtgactcgtgatgctgccataactgtgtagcttagtttttcttcctgtgtcttggggagcattggggctgcctttcatagggttcatgagagaataaaataagacttgcccaagatcacccatcagtaggttccccatcttttattccccagttatgctttctttcagctacactaggaagaggtgatgagggagtgtgaaggttctaggataggagagaaaatacctgtgaatagtttgggtaactcgataatggttgggctctaatgttattattgcaagagaccaagaacgtcagatttgataggttagaaaatggtggtgtttgagcagaagagcagtttatgaggatggtgttaaaggagtcccagcagtactgtattagagaaaagggatctgatttgagagtcataagaaaaatatgactgtaagtaatcagtgactaactgaaagtagcagtgaggaagagatagacagtaaaagtctatccgtattcttgcatgtatgcatctacctccacatatttgagcacttgctgggcttgtgggctaggcactaagagaaaaatctgagtggccctcagatgcatgtgacccagggaatggtggaaagatgttttctaaaatgttctgctggtgcttaggtctcagaaggcctatggaagttttaattttggtaagaaacatccttgctagttctgggtttgaccttaagctcaggctggaagtaaattgctagtgcccacctctgaggaagtgcaggttgaactagggcaggtgacacactgccttgtggaatgtcaatctgcaagtgattccatcctgcttaacggagctttagcactttgaccccagcttgaagcctgggaatacagcaccctccagcccctgaaccacaagccacttgcaagctgggcatatcacaaaattactttgatccagtcatcataagtgtatttattgcaatgggattctacacaataaggtggtgttattgtgaattagagaataacagaagacttatgtattcaaagtgggatttggtgggtagaaaatttacaccatacattgcatcagctactatcattctacaaaatttgactgtgcaataaaatgatagtcagtataaataagatctttctaaattgctgcctaaactgatagtgcacatggaaataatttcaacctcacgttatacattaggcatgttattgaaatgttgcttataaatgtattttgtgttgaaagtttaaatcacgttttcaatgttcctttggaaaattgttagttaaagaaatctggtgattattcctttaggagagaatcctttggaaattaatagtagataatctgtttttcatggattttgtaaacttcatttttatatatcacgttaccctaaagccacctgtatcttaggttaaaataattaggttacctttattcttgaagtggttggtaattgtgcacagtctaaaccaatacaagctggattgtataattgtattgccaaatcttcacccatttttttagcaaattaaaaaagaattatgatgcaatggggtggggtggagggtgaacaaagattactctgagcaacaggaatgagaggatattgtgataaatcttatatgatatataaaccatgaccagggattaaatcatagctagaccacataaataatgctgtgtagatcttgctatgatttcaatagataacataattcaaaacccaacttccagcacaattaaacatgaagctattggtaacattttttttttttttggagttttgctcttgttgcccaggctggagtgcagtggtgccatctcggctcactgcaacctccgcctcctgggttcaagtgattctcctgccccagcctcccgagtagctgggattacaggcgctcgctaccatgcccagctaattttttgtatttttagtagagatggggtttcactatgttggccaggctggtctcaaactcctgacctcaggtgatccactgccctcggcgtcccaaagttttgggattacaggcgtgagccatggcgcctggctgctaacattgttgttagttctcaataagtaccccaattgcagaaaaaaaaaattggtaaacttagaggtggtgattacaatgtatttttaaaatacttataatgaccatgcaaagatgtcatcaaactacattaacatcttagtgatagaaaggaaaaaagaaattttttggtgaaatttacaggaagtaacagaacatctattgaagagctagggataaatttgagttcaacaagaccttggaaatcttggctactaacgttggcaagaccatccattttccatttctggtgataaattttaaatccaaataaattctgtttgttagggcactaaaaagccttgtcagctctgaagttaagtaggcatgtattcactggcagtatgtggaagccacaaactgggccaagctgtagacacctcctgtaatctaattttcaagcacaaagtatggcaaagccaaaaacggctctcagggcaaggcttcctgggctcaattcatgaccatgggctttgggaccaggggaagctaaagatcatcatcacttctgcaaaacagcggacctcgaagacgggaaacaacaaggccagaataggagcgagaagagatgaacttccctctcgaagtggttctctgagccccccggtaagagaaataatgaaggaggaagcgagagaggattcgtggtgtgtttagtaaaacaaggaagggctacagatacgctggaacaaagcctcagagcttgctttccaagtagcagtccagatacacaaatgggtcagctctgactgtgtaggcatcaccccttaggaaacctgaccacagaatgcccttgcaaagaaacggagacaaaaatagagtccttccatcctgcagtggcctccttcttctctttgtgtgtcagtgattttcaatcagtagattgcgagagccatggcaacttgaggaatttacattttaaattttaaaaagtgggcacgtagaggcgaaagtggtatttgggatacagaacagaagaatgggttcctcattcccacaaggttaccaagcagtagggtggggcagagtggatggaaactcccaaattgcaattgacatgggaaggtttgaaaactcacatccgggtgacgccatgtgcttgtccctgaaaatgtgttaactctggggatgtcatcatcccatgaggccaatcacagatcattcctcccactctccttttgctttgccccaaaccatatgttccctcatgacacacctacgcttccccaccctgaccccctgccatctcctcccaccaaaagcatgttctaaatattagctttttttttccccacaagagaaaagcattgcactagtttctctacatcattttatgaaacccttacagaaatcctaaaagataggcattcttatccctattttcagaagaagaaactttaatactaatctgatcacatgcataatgagaggtgaggctgggattcagactgagattgccctgcctccaaaacctctgacttttaaatcatagcctgctttcttggttccctgtatatctgagcatcctctcatttggatgatgccaagactggtttcatcctagttagcattaatatggtgcacagacctttccagcacgggacaggtcactttaccttgtacctgaatatttctcacctccagaccttggaaaaaatgaagtagcagtggcgggacactttcttccattttgacctctgtatttcttcacttattcagctagcatttaaagaaagcctgctatgcgcctgacactgttctaggctctagaaacaaaggaagtaaagccctgccctcctagaacttgcattctactattggagacaaatgactatatgatgtaggcaatgtcagctaatgatggaaagcaaagcaagttgaaggagcagaaagggatgaaagtgtgctgggtagggttgtcaatggtagcctctctgaggaggaacattggggcagagccctctatggagtaagtgagtgaaccatggagaggtctaggaatcagcaggagccaacccctggtgggaacagattggacatggcagaaaaccagcaggacagctcatgtggccagagtcagtgagggtggcaggtggcagccacagatgggggaggggagggggacagagactggatcacttaaggccccctgggctaggaaaggagttaagaatttatgccaggaaaatattaaaaacatatcagtgccttttttttttgttctgagatgtgcccaacatcatcaattatttgtaatacacagaattcactcctgacaaggaaatgggtagaacatatgagaataagtagtttaatccacaaaacacagccgggatgatggatttcaaattgttgccagctcttcaggcagaatgggtaagaaataaagagagaatgtatgtaagatcacagtccagcagcacacttttcatgctcaaggctcaagggaaaacaagaacgactttattctttatccatagaccccagataaatcttttctgccttgcatgatcatatcctaaatatgtacatagctgcaggtttctgggtgtattctagcttctgtagctctctttgtaatagttcaaccaaatgtccactatttataggtctctgagcagcaacagttagcaaatgtaaacccagcaacccgagctagccgccctgcagcttcctcacctttgccaccaaggtcacccttcccctctggccatgggcagcagctgatggccacatgggccacaaccagaggtggtgtgtagggtgggtgcctggtctgacaccagctatttagtttcattcccaactgggtgcactgcaactcaattttggcactgcccactcaggcttagtgcagaccgcacaagttagaaagcatgatctccaacaatactgccctatgtccgatgccagccacactttgggagtccccaggctacagcatttatgacaggctggatataaatctggcggttcccgcaaccctctttggtcaataatttgctataacagaacacagaagtcagaaaaacactaatgatgacagttttattattatataaagcatacaaatcaagagaatctgccaaatgaagtgacacaaggggtgaggtctgagagggaacatggagtttctatggcctctccacatggagccagggcagatcaccctccctacacattagtgtgtccaccaacaaaattcaaccaagccccagtatccagaggtttttttagggcttcattacataggcctgattgattgaatcattggccatgtgaatgaactcgatctccagcatccttccttccctttccagaggtggggctgacttgaaaccccaaccctgcaatcatgtgtgcttggtctctctggtaaccaacccccttcccccaacgccataacctcccaacactatgtaggggcccaccaagagtcacctcattagcataaacccaggtgcgctctggcagcccatgaataaaaaagacactctgtcactcgggaaataccaagtgatatgattggccaatcataaaacattatgttatttcatcagactggcttcatcatgtattagaaacaagttttacatgtaggaattgcttcaatatctatttcagtatcttaaagtctttttctatcagattgataccccataaaaacaaataatcagtgaaatgtttcaaaaatagaaaaaatgtataaaatgagctgggcacagtggctcacacctgtaatcctagaactttgggaagccaaagcaagaggatcacttgaggccaggagttggagaccagcctgggcaatgtagcaagaccccaccctacaatcaatcaatcaatgagaaaaatgtataaagttcatataacctaaatagcctcagtttaaaacatggggaatttattcatgaaattgcacaaaaaattagaaatgcagcacctactgcatgatcaacagttgtttccacactccatttgtgtaaaactgatctatggctcatggctgtaattcctgttcaccaacaccttgtgccttttgtgtctacgcatcttataattatgatcagacagagccattatttgaaaagagccaggatcctctggaattagagcataccgtattctttcggtctcacttgtctcctgggaattccatggctgggcttcatcattttaagtttcttatgctcaccctacttggcattacttcatttcttctcaccatgtaacatctgcttggcagagcaggtgaagacctatggctgccaagtaaaggtggaggtgaaggtgtgtgcaggaccacgtggtctgggacccatctagccagctgtcaattcattggtggtgacagtgaaatgcctttccagctgtgcaccaccctgtactgggtccagttcccagagtcagcaagacagttgtcattgctatattctgcaaagctataatctaacttagagttgaatgccattttgacatcacaccgtgtttgcctcacctcccagaataacatattggtctgtactcaattcagatttttaaattcaccatccctcatgccacatgatgccctgtttgaaaaatctagtgaagaatgtttaggtctctgatgctaatgggaaagtttagtctgaatgcaaggtctcttcagtgcaacctggcacatcaccttcatccaactttgaattttttgttaggcctctgtgttgtgctgacccccaaaagccattcaagatctttaacctgagtgtgccccagcctgttggcagtggatttttggaaagctcagagaccagtagagagaccagggatgaaagactgaggggaaaaaatagggattttctagaaaaaggtatttggaatcaaagaggaatttcaagggagtattagcatctgtctattttataagagttaaaggagagaatgggtaataatgaaatgggagtggccagtacggaccactctcacaaaagaaatatgttaaaacccattgttataggcattttttgagtgaccagaatgcttatgacttcccagtagataatatctcaaagtcatgctctcacaattttacacatgtaaatgggactttctaatctagagaagctgcccaaatactgtcacagaattatttcattcttacttagttggtccagatccaataaatgatagtctaggttttaatggaacccagagaggaaccatagttttgactggagcagtctttcacctaatgtcctcgtctctacataattattagtagcactccttttatgctccaatgtgtacctatttagccaataaattgtttgattaccaaatcagcatgtacgatgagtatggttaagaattttctttatagttcatccaatgagtagtgatgttaggaaatcattggttagaccttaagttatctacagtggtcattctcaaactttagcatgcatcacaaccacctagaggtctcattaaaacaccaattactgggccttcaaccccggagtttctgattctgtagatctggagtaaggcctaagaatttgtatttctaaccatttcccaggtgatctagggaagacagactttgagaaccaccaacttgccaggtacggtggctcacacctgtaatcccagcactttgggaggccaaagcaggcagatcgtctgaggtcaggagttcgagaccaacatggagaaaccctgtctctactaaaaatacaaaaattagctgggcgtgttagatggcatgtgtctgtcatcccagctacttgggaggctgaggcaggagaatcacttgaacccgggaggcagaggttgcagtgagctgagaccccaccattgcactccagcctgggcaacaagagcaaaactccatctcaaaaacaaacaaacaaaaaagagaaccaccaactctcttcctcttgctgggtagaattttgaagacaatggaaaagacttaaagagagacttcacagtttaaagaacaactaaataaaatggcaatgtcagggactagtgaaagaacattagctggtgagctggccggctgcaaacacagtacaatcagatgacagcaggtaacgctctgtgactatgaccatgtggtggacccttccttgagctactctgtaattttaaggtttcatcatcacttgttaaatatttttttttcaaaaggagcagtagacttttagcagatttacccatttatttgtgtgagacaaacctaaaaatatactatcaaaaggtaacagatgcatttaccaaaacggattttattatttatttttttgagggagtctggctctgttgcccaggctggagtgcagtggcgcaatctcggctcactgcaacctccacctcccgggttcaagagattctcctgcctcagtctcctgagtagctgggattacagacacctgccaccatgcctggctaatttttgtatttttagtagagacggggtttcaccatgttggccgggctggtcttgaactcctgacctcaggtgatccacctgcctcggcctcccaaagtgctaggattacatgcatgagccactgcacctggcccaaaacagtttttaattctatttttgcatttttgttgttgcatttggttatggtgctaaacaatttctggggatggtttttctttaggttctcaggtatagtattttctgtatagtcattgtatatagaggtgtgtgtgtgtgtgtatagttttccttgagttctgcatatgagtacttattcctaattctccctctaataagtcatctacagtgaaaataaatataatgatcatatctgaggaatttcagtgacatcctgtcaaagtattaggcaagactgacagaaaagctattttgatttacattttaggaagaaatttattgagttgtggattaactgaaacaattatggagccaaattattattgtttatgactaaagcacaaaatggttgtattatttgaacctcagcataactggaaaatcctgaatcctgtcttcaggttgctcttaaaagatgagcagaggagagatactcagactgtcatggaaaatttgggcagacccctctgtaagagtctacctaaaagactcagatctagtctttctgtaggccaccttgagtctggtgccatcactggctattcagcattttctgagtagtatttgaaaaataaactgcctttttgttttgttttgttgttgacctttttggattttaaggagcaagatgatcttgatgtaacaggcttttcattatcatgatcgaggactttgatcaccaaaatacacttgtaaatacaaaataactgaaagactcagaaagacaatgactgaaccatgagcccagtaaactaaaaattccaatggtaacatgttcaaaggtaaagaggcttttaaggtcagaagcatctttgttgtattaggagaccttcattgtcctggttctgctatgatcttctgatgtgtaactttgggtcagtcatttaatttaacctatcctttatggtctcctccatctccgctagtaagggacattgttcagtggtgtgctagttggtgtttaacaaccaatttgagtaagcctcaattatagcatctgcctatgtccatggtgcaaatactcccaccagggttgatttcaaactgccaacacagtgtcactggatgcagaggtggaaagagatgtgcaccattggtccttacaaatggcgcaacccagttctcttctctgagagaacagctgtgggattttggcctaataatccactttaggggctgaattatccagtctgtctgttcacattaatcatgctaaccaactattttgagctctgtgaatgcgttcttatcctccaggggaaaactgttgtctgtcaagtgtgcattttcaagcacccagtttttgacttcaaagcccccttggcagacattactgtggtatcacctccctgtgtcccactcttgccaccccttctgaagccaccgtcagtgcccacatggactcctgcagtggttctatattgcaaacaacagcaactgactctcgttatcttagggagagaatgaatttgtggaaaggattacaacattcagaggaaagcagaaaccagactcagtatgagcagattccaagagaaaatccaagagctggccagaggtcccacctggggacagcctggttagaggaagagtgccattgctgagtgctggaagctggctccagcacagagggcatcaccacggccagaagccacctctccaactaccgtgaatggaaagaattctgtactgttttgcttcttggcatctcttgttccatatgaaaatctcaggcaagagcatctgatgggtcgccctttggtcatatgactgagctctagctgccacagggagggcagacagagtatcagccttttcagcttctgtcacagaagactggacccaaccttccatcaggaccccacagtaatgatttcctcagatacaggaaggagcttcagattgtgggcagccacacattggacgaatgcccccttgagtattcaataccctattccaaatgttttcccttaatctcaccatgaagaaatctctagtttttgtctatctcagcgagatttgcaaatgtttctacttcatattatttgcagaagaaataaacatttatgttcttttcaaaggaggacaggagatgataactcagattaaaatatggaaattaataagtaataagattaagaaaggcttaaagtcccaaggagattcagtagaattcagaattgacaggaaaagaaaaacacaggaaaaagcaggaagagacatgactggccctgaggaagtccattggtaggaccttgggttgctggtgtccccaacagtctcttccttttttgagacagggtctcaccgtgtcacccaggctggagtatagtggcacaatcacagctcagtgcagcattgacctcccagagctcaagcagtcctcctacctcaatctcctgagtagctggtactacatgtgtgtgctgccactcctggctgatttgtctcttctgatgccaaagctttacctaattatgtttcctttatgggcagaatgtttcccgcttgacatttctgtaggaaaaacagcaatagggatctgggagaatgctgggcaggccccttgctcagaccagcttccccatcatttcatcatcaaatgcatctccagattcctagagacctttgacagattgggccccagtccctgagtctgatgccactacagcatctaggaatcagctggctgatggctgagagcagttctgggagctggactccacctcccctctctgagtgtttctcaccctcatgttgggtcagcattgggaccagtgcccgtccccagagcctcccagcaagtcactcatcagagctggtcactcatcctagagtcctgcttcttcatgttcccggttactgccctagcagtgctgctaaagttattgataagaggccttgtagcttgccagccgtctaagctgccactggatctgagccttcttagacctccccagtcctgggtcactccctcttctctctgtggctctatccctcggtgccctgttggctgggaatgggcaggaccccaccatgagcagatgtagctgatgcattctgtagacagctaaggcttatggttggctggattgaggatgagaagtctgggaccaaaagagaagacacaagtaattgcacttctttatgcagcctctgccctcctgctcatgggggtcagaaagtttctaagagggagagttgggaaggaggaaggaggaggaatgggccaggtgggttctcgggggctgtggtctctattcatagtccaggctgttgtctggggggtgagacccaccacttgccaccacaggaacaaagctaagctcaagggtcctcatcacacttggtatccacacctgttttcccaagtcactgcccagagccctgctttcagacttggtgctatttcaggccacctgggagaggtaggtcttgaagatcacagctctctcaatgccctcaagcaattaagagccaccatctggcatgcagcccatcccagaggatgatttgcagatgagggctagtacatacagtgcctctcgcccccaggatgcccgctgcagaagtttttactgccatctgtctttacccataccaactcccccgctggtctggaaacagtctaaggatggaaattctgacccatgagtctttgaaactccagagcccagtgttcttcctgacaccttttagcattttttgaaatgttggttgaactattttgatcctttttttggcagagggggtcctcacttacctgcttccctccgcctccctaaagtcaggaagccagtagggataggggccttcaggctcacacctacagaagcttagagcccgcaggaccatccataacatggtagtggacagtcctgtcctcctgcaagccctgtgctgggcatgggtcacaccccctcccatcatggctgtgctgcctataaagccaggggttatagaatcagcccatctctcagtaccttccagctgtagcttttttattgtatacctgggccctgctgagattaggagtcccgtgaagtcattttcatcccagaactctcctccttcatgggcactttcatggagactctttttccctctgccattgggagcaatgactagattaaataggctcgtccctggaaggctcctaggccaggatccccttcccaccagcacactgaaagtggtgccatgaaaaaggggccaggcaggaacacggcagtgacaccagcctttgctgggtgccatgcacgtctctaaggcgtgggcttcagccactctgcatatggcctcagctaaccaaggatgctttctgtttgtcatattgctttataattttgtaaaaattcacaaatttataatatgtgagtatataatgtaaatctgatatttgagcatttagatttgagcaatatttcaaggtatgatgataatactctgaagggatttgttgctttgcaaaatctttcaatcctgttttgctttgtgtaactaacacatttcaaatttctcaatccacacaaatttggtactgcaccacatttacaggaatctaacagttcacaaggaagatccagggagatccagacagaatagacagggagacacagaaagaaggatctggttaatacaagcttgaaaatgaatcttcaagtcctgtcacgtgtttttctaatggagcaaaattcactcttactcttcttccctaaccctaaccctgtttttagaatgaattgtcaaggttttcatttatttgtcagtccaagaatagtttttgttgttgttgttttagagacagggtctctgtgtgttgcccagactggagtgcagtggcatgatcatagctcactacagtctctaccttctaggctcgaatgatccttccacctcagcctcccaagtagcttggactataggtgtgcgccaccacacacagttaattgtttaatttttagtagagatgaggtcttgctctgttgaccaagatggactataggtgtacaccaccacacccagttaatttttaaatttttagtagcgatgaggtcttgctatgttgaccaagatggactataggtgtgcaccaccacacccagttaattttttaatttttagtagagatgaggtcttgctatgttgaccaagatggtctcaaactcccaggctcaagcagtcctcccaccttggctcccaaagttctgggattataggcatgcaccatcatgcctagccttagtgttttaatttcaaagaacacaactgtatcctttctctgtcacctgcagtccctgacacttgtcaaacaagactgtgttttctagcccatccttcctccctcatgaatgcaaggcccacatctgagcctctgtgagaaccagttgttttgttgcccaccttgagcagtagttgtatataggtgggtgttcactagaaactggatgaggaatcccaatgccaatgtcatgggtatctcctaattttttgagataatgcctaatctgccctcaaggccaccatgttggtgcaaaggtgagaaactcatcatgcccttactgaaatcgagcagaggtgctggggtacatgagacacgcccccataaccacgccccataaccaaataattaattcttgttccagattattttctaagtctaaagttctaggaaagaagaaatgctgtctttccctgagggatcttccagtaagtaggcagtagcagcgtgacttgtgtggcttttgagagccatttctgctgatgtcttcagacaaaaagtgcaaagagaggaatgcaataggtcatgctgaggctctgggggaaatgcttaatgctcctcagcctagaaggctttgtgaatgaattttagaatggaaaatgcagtataaacataaagctcaggaaaggatggtaaccaagaaaaaccttaggaaatggtcttgtgatagcacattctaagcatagccatcaagtctgtatgcacaggtgaaggtacatattaaatggtttaccaatactccattacaagacatagtatatttcatgggttgttctttattagcagtgtttcagagcattctacaaaatcacagtgaatgtcaactgttgctgcatttctatcagtacctgcacttgcatccgtgataccatacctagagggtttgtgtttctgatttttaataaatcaatcgttagcataccccagaagaagaaatcaagggggcccaaggtatagtagcttctgtttggagattcactgtagtctttgttttccttagcaagttcagaagctaagcatagatatctccattagacatgcagagtgatctggtgcagtgacagaatacaagcttttcaatcaaacagggtggaggtcaaagcctggtttagccactaacaccacctatatgaccttgggcaagtaactaatccccttgcctcagtattgtcatctgcaaaatgggatggaaatagtccctaccttatggaattgtgggtatcggtcatagcatgattaaaaagtgcctgccatttggtaggcagcccacaagtaggatacattactatgatgtagaaccacagttcttgctttttatagcttacccacagtcaacttttaatatgtacctaatagagctaaaaagaccaagacaatttctccaatgttcgcctaacataagccaatcacattatttcttaatctcattctgttatggagaaaaattattacattctttatattttcttgagccagtggacaattaagtaagaatagggatagattatataagagctattccactatgtaatatggaagaacttgcccagaagtggaagtcaggtgcagggacatttgctgctattgtgccttgagacctcaaggaaacctaaactttctaggtttcaggctgggcatttgcagtatactgggtgtgggctgtatggttttgaggctgcttctagccaaaatgccgtgtttctgtttgctcacttggcaagctcaatcttctctcaacaatttgtttttttaagctgtctttacatcatagctcacagaatgacgagctggaagagacacagacaccacctagggtaacattctgattttacagataaggaaactgggactcagagaataaggctttcttcctccttatatcttatagctagttttttgctaagctaaaacaagaaccggggtgtcctgactcatagattggtgctctttccgttatactcccattttccttttcccacagatcagatatcacatttaagaactaaatatgaaaacatagcacagctgattttttttttttttgagaaagtctttactcttgtagcccaggctgcagtgctgtgttaatgatctcagctcactgcaacctccacctcctgggttcaagcgattctcctgcctcagcttctcgagtagctgggattacaggtgcccgctaccacacctggctaatttttgtaattttagcagaggcagggtttcaccatgatggccaggctggtctcgaactcctgacctcaggtgatctgcccacctcggcctcccaaagtgctgggattataggcatgagccaccgtgcctggcccagcgcagctgacttttgacacttgcaacctaatcattttattgaatgactacaaggtttctacacttctatctaatggtcttttaattgcccagagaaatagataactgttagaatttagggataaaagggtatggttgacatggtgtgtgagccctaaagggacttctcagggacatgatggttcatcttggagttttgcattttagaatctttgagaagctctggatttccactcacccacttactaggaccatacattatagcctcagaatctaacagttaatctacatcttccctgactttatactaccctgtggtcaaatatgtttattcctggtgaagtaaggagattatttcattttgaccaaagtcatcctgggaatctaataatcatatgcatgatcgcaagatgtacatagcatgcatgagtaaaccaagaaataacaaactaaatcaaactgctttgttagatggcatacatattacaagtcgacatggagaggaagtggtgtcctgttaactagtatcttctctgtgtgtctgtcctgtggttctggcttaggttaaagtctggggtttaccttcctcttcccctgctcagattgagccttctgtggaagccataagagcagagagagaaacctctgagtatttaattggcagctactttcaatggaaaagcatattcactgtgtaagaatgctgctatattggagttaattttcatgaaaagaatgtacagtaatcccccttctccatggctttgttttctgtgcttccagttacccacagtcaactacagtccaaaaatggtaagatattttgagagagagaaacagaagccacttttatcacagtatattgtcttaattgtactatttcgttattagttattgttaatctcttactgtgcctaatttataaattatccttcatcatagatatgtatatataggaaaaaatgtagtatatctaggattcagtactctccacagtttcagacatccactaggggttttgaaatgtatccacttcaaataagggggactactgtactttctgcagtaattttgaagaaaaatcagttgtggaactgatttttacaagactgctttcttcaaaaaagagaacagaaagcaatcaatttaagttgttttttttttccattgcagtgagaaatgtaaagcattcaactcaggtctcttaaaaattaagaaaaggaaccctaaaatattcaatattaaaatgatttttagttgtacattatatatttgtctcagattaagaccagcagatacacaagggaagggaggagtggaacaagaagcagaaaggtaggagagaaaaggctgagaaacaaacaaaccaaaacacagacagatacaaggagtgaaagaaagattagaaaaaccagaagagggttggaagacagaataatatttaggaacgaagagaaaagatgacaggactgtgtagcttttgcacttaagcacagcttctcattacttttgtcatcctttgtttgaagtcttactctccacctatgaactatatgttccataagcacgagaattgtgctggattttgcttactattgttttcccagtgcctaacagagacatagtaaacacaagcaaggattattaagtgaatggatgaacaaagaaacaaatgaaaaaagagagtgtagggaaagggagttctgtggctcaaatggcaccagctatggtccactgagagctgccattgtttcctcaaaagcaagaggccatggacttggctgatcctggcccctgagatgcttgcaatagtgtttctttggaggcaactttacaaatgctcacacactatctgtgagagttgcagtctactgttagaacaaggttttgcatctgtttcttttggaacctttttgcaggttgatgttttcaccatccctcacattcctggtaccttcttaccccaagcccagtctgtgatgctcccaaatccccctgccccaacaacccctctggaatccttgtgctgttatatgttgaaaaaatctctcccagaatgctgctttcttggctctcccaagaggagccctgtcttagtctgttttgtgttgctgtaacagaatacgtgagactgggtggtttataatgaacagaaatttattggctcacagttctggaggctgagaagtctgttttcaaggtgcccacgtctggtgagggccttcttgctgcatcatcataggatggaaagtgagagggtgagagagagcaagaaaggaccaaacttgcccttttgttacagcaccaatccccacccccatgaggtggaagcctcatagtctaatcacatcttaaaggtcgcacatcttaatactgttacaacgccaattaaatttaaaaattaaattgaattttggaggggacaagcattcaaaccatggtgacccccttctcctttagccccttggtggcagctgcctattttctcaccctgtctgtattaagagccctagaaaagggtcagcactctgggctcctcatcaccaagaaatcaacacacctcaaacctcccataaaaatgcacttttctaatccttcccatcctatcctttaatacctcctggtcacttttgttcattcatacagattttggcccttggccacccacagcctcctcatctaccccaactactgacttgcaggatgacttcaggagtttagtgcacaattcatctaaaagattagcctctgcaaattctgtgattttttttaaatggtggtaaaatatatataacacaaaacttaccattttaccattaaagtgtatagttttgtggcgtgaagcacattcacattgttctgcaaccatcactaatctatctccagaaatttctcatcttctccagctaatagtctgcatccattaaacactaacttcccaagttcagtgatatttacttttaccagacttaaggcactctcaccccaaaattttcatttcctgaagttcttctaccttcggaattttaaattttgttattctattttctgtccacaatctcctgtcttgccaacagactttgatgcagacagatctgagttgggatcccagctaatccagttactagcttcatttcttaatctattttgtgttgctgtgaaggaatacctgggactgggtaatttataaagaaaagaaagttatttaggtcatggttctgaaggctacacaagaagcgtggcaccagcatctgcttggtttctggtgagggcttttgtgctgcgtcaaaatatggcagagaaaggccaaaggggaagtgggcatgtgcaaaaagacaccaaaccaagcatcctggcttataacatcgcactctcatgggaactaatccactcccccgagaacccatccaggctcctaagagtgagaactcaccggacgtggtggctcacgcctgtaatcccagaactttgggaagccgaggcaggcggatcacttgaggtcaggagttcaagactagcctgaccaacatgaagaaaccccatctctactaaaaattcaaaatcagccgggcatggtggcgcacacctataatcccagctactcgggaggctgaggcgggagaatcacttgaatccagggggcggaggttgtggtgagctgagattgtgccattgcacttcagcctggacaacaacaagagtgaaactcagtcttaaaaacaaacaaacaaacaaaaaacaaaaacaaacaaacaaaaaagaatgatagctcacttactactgtgagaatggcaccaagccaattcctgagggatctgacccccgccccccccccccccccaccgccgtgacccaaacacctcccattcggtccacttccaacactggagatcaaatttcaacaggaggtttggagaacgcagacaaaccatatctaaaccatggcacctcactttcttcatttgtaaaattcagataatacgtaatataaatactggatagataacagaacctaagttcacagaattgttgaaaggaataagtgcttaaagagcatttagcacaggtctgttctcctccctccttcctaccagttcacacattaacatgcatcacatcaaccaccactctattgatcttcccagctcccttaaaccttgatcttcctgatgctcatcccagagagacacagcatgctgtgtcagtccagctttctgcctcatctgcacatccacttgggctgtgtgtgagcagctggcccagccacactaccgtgcaagcatttcatgggcccctgttaggtttcctctgctcttcccccacatgcctatttcagatctttcccttttgctctgtctccctacccagccactgtcttctctgtttctgtaaaccagagtccttaacactttaatgatattagaaccacacacattccctgaggtcctgatttggtaagaggtggtggggtgggaatctgcagttttaacaagcaaccaggggattttgatacacacagtgtgcagcccactctttgtggagggctgtcctgagccataagctccttgagagcagacacacagtcttatctgactttcacccctaaatacctaacaatagatgctgaaggattgactgaatgaatgaatctgtcactctgcactttagagtaagttactgttcacctttgaaatgctaattagctacagctgtttaaatgcagtttaaaactcttcaatatattttatctttagttctttatcatcccttttcactgccattgggggtagggaactataaagaacttgttattctctgatgcaacaacaacaaaaagccaacccaagggccaggtaagattgagcctgcagtctagagatacacaaattgggccttgccactgtcacttagggaagaacactccaatgactctcattctagggatcccacaggcagaggttgttgtagccatttcagtggacttctctggaatggaaagagtttcaagcatgatgctcactgctagggatgttgggagaaggtgatttagagaaataggtgagtagacagagacaaagactggcacaccccatcaatgctgcagaggcttcaaatcccagctttgccatttactagcttgtgacaagagtaatgaaacttagagcctcttgtttccttatctgtaaaatggggaccacatgatttaccttgcagagctttggggaggatggaaaaatgtcatataagtaatgcatagtgattctatgatgttagacaatcgagcagagtcttgaagaaagcatctgtcagtctgccacgattggaggaaaaacacacacacacacaaaacacctacatacacccaggctgcctacaaaaacagaagtggaaccagctattgccctgtggggaagtctaactctcacccattgcaataaaatctttccaaagggagcagacagagtaacctcaggccatgccctcccacttccctcttcctcaagtggagctctgagggaggcagagctggtggggagcctttacagaggaagtgggaggtaaagtagtgtgggtggctgaggctgaaacatttcttttaccactttcctataccatccccccacttctcttgtgtgccagggggaaagagaaacagtgcatgcctatgctgtacccacacacacttggatctgctcccccagcctccagaccccacctcatcattcaccatcattcactgaatgcctgcagccttcacggtgctttctaaatgtctcagccggaacctccctggaagcccgtataaagtttgcttcaatatttggggtcttcccccagcccgtgaagaccagtgtctaagccctacttcagcccctccctatgccaggttttctctctccaatttgagtgctaagagactttggtttaaatgttagtaataataaacagctatagacattctccccttccatacttattcccttgttcgcacacatttatttgctttcaggagaagaatttggattggtttcctcggatgcgagccatgtccctcgttagcaatgaaggcgacagtgagcaaaatgaaattcggagccttcaggagaagttggaatcgaccatgagtctggtcaaacagctgtcgggtcagctggcggagctcaaggagcaggtgggtgcattcagggagatggggctgggtgggataaagtcattcaccacttccggtgaggggagacagagggtccagggagccaggtcattatccacagagaattgcaaactccgagaaagaaacctcacgttgtactgtagaaccacatcccagcaaacggggacttctacttatcccatctccctgagcctcacacgacacttctccttctatggaagggggaaaggataaaatgccaaaatacaagcacctctttgcatttaaaaaaaaatcattttctgccatgatagtaattactaagcccatgggaaaggcaaatcctcattagtatctgccatttcaatgctataatgaacccctttatcatataaaattgttagtaaaaatatcaacagtaaccatggtagctattaaaatgactgtggtgatggtgacagctatgtgacaggcaagatctgttttctaaaatggctcctgcttcctaaccacacagaggggtttgctctttttctctgtttatggaaattcacttttaaaaaaatcccttttttgataaatatattctatatgatgctggacagtaggtagttggggaatattaactcaaaacggttgtggcccaccagcactgggtaagagtgagaaaatccgctgaacacacactctctcttttcccccagatgacagaacaaaggaagaataagcagagactgggcttcctcggatcaaacacaccccatgtgaatcatcacatgccaccacactgataccatggggggaagccgtgactagcctttcatcagtgtcctgcctgatcactgaataaagaactgagatggaggggagtgaacagtgcctattgttgaaaagttaaaaacaaccaagtgccaagatgttgagtgggttagctccgagaacaatttataactgtgttttcatggttgcgaagacctaacctcaaatgcatctgctagaaagcgtacatcacacattcgcaatgcatcaggaagaaaaggcttgcccaaaaggctggagagggcagggagcggcaggatggaaggagacacggggcagggagaactctcttctgctaaatcgataggagtcagttttgtcttaaatgctgactacagccactgacatggttggctggaatttctttcttttaattgtggcatataggtttgtgacacaagaagtcatactttggtggctaagttttactaaggaaaataactgaaaagattaaaagtgagagttgaaaagagaaatgataatgcttccaaactgtagctgtcacagggcaatttctttatttataacatgaagcacaatggatttacagctctaggaacttagtactttggagcttttgcctctcacactgacaacataacaggatgtgattgccttctctgggattcagacaggctctgtcaatgtggagcacaaaaggagattttcatataacttgttaaaaacatgttctaagtcatgtataggctaagattttaagaagatctgggggaataaaaagccaacagtaagccccaggaaagggttttttgagaccatatgtatgctattaaaatatattgagattaatacatgaaaatgcttaaaagtgataggaattattgagaaacttatgatggtggcattgccttttataaacatggagtgaaagccatttgactcaacgtttgctgtgcttaaagaattgcttcaggacccgagcgtttttatgtatgctgttcctgcagttaggaaaaaaaaatccaagaaatgtattgaatactcaagaaaatgccacatttcaattacatatttaaaactgtatctgtaagggcttttcaaaatgtagcaagataaaaatctcttattcaaattgtttttgtattaaatcatgcactcagaatttgtcgagggagagaataacctggtgtgttcaggttattcttagagactacacatttggaatagcagagcaaaatatggataatgaaagtgttgggaaaaaagtgatgtgacagggagtgaagacacttgataccagactctgggagatactctgcaagttgacctggcctctcccccacaggaacaaaacactgcctccagagtctttaaattctcagttatcaacgccaaggtttaaggtctagatagggtttgctatagggtttgctctgacaatttttaaagcttttggattgttctaacatagcttaagctattggttcctaaaaatcccaaatcaagatctatgtagaatataaaggaagcctgaaccaatccttccacatactgttaagatgtagacttggaacaaagctgttgggacccagagcaatgaatttttgaactgaagctactggtactccccagcaccacctcatactaagaattcctcactctgacatgacagtattttttctgaccaggagctgaaagaccctgacattcatgatccaaagatataagaaattttgatatgtctgcatgcagcacagaactttgaacctaggaggcagtcaataaatacatgagaaattcagctgtcattcagttactcttaattctttataaaactttaaatgataccacatatttgtttgtttaaaatggctttcccaaaatcaaagtagactaaagcagccatctttaaaatccaggatcatcaatgctattaacagtatcaggtaaaaagtacactttaaaatattttaatcaggcagagttttatggatagagaatagaagagaaaggtagtaaatattgaacatattccaatataggaacctatctctgttttagtacaaaatatttctgacatctgaactagaggtcaagagaataaattcatttgtatacatctgagcaacctgtctttcagatgataaagtatctagccttttctgacaccataatagttcattttgtagggaataagccattaggtgtatataattgctttctagaaatgacctaatgtccccaaccactgtgtagtggcagatcactgtttcacagcata

SEQ ID NO: 14721 - DNA, 13118 bp, Human
cccagaagcatgcctttgtcttcttgatctgtagatgccatttccagcttggagacctggggccttgacagtgttggattctctgtcacatctggtcttgggggctacttatctctgtcataagtcccctgccccaccctagggtcatatttatattaaggatcccttcctgctcctggatcagagagggccatcttcgcaggcctgggcagtcactgacattggcccacccaaccagttatcaattaatctccatagctctatctgaggatctggggttcagggcctgggagagggaaactgagacagacacagagatgaaggggagccaggcagacaagatggcagattcctgtacaaggtcagccaagagcagggcctgaaagagtgtctctattcaagatctggacagcagacattgtactagtggctgttcgactcctgctgagtacaggaccccgggtgggatcatttatctgtccttccatccacccctctgtttgtctttccaaaactgcctgctgaggactagccagagacaagccctctccctggcacaaggccacgtgctaagatgaatcagattgggccggctggagccagtgggtggaagacagaggacgcaccaggtggagggcacaacaacgaccagggctcgtgggtgggaaaatactgggccaaggcaggcactggggttgagtgcagggtggagggtctgagctcccagggggtgtactgaaggttatggggaggtcaggagaggagggacaaacagcaggctatggagggacaaagcagagtccctgaagaaaggaggaagcagtagacaaaataacagggagggtggaagtcagagcctcagacttagctccatggggaagccacctggtgtctgcctgtcttcaggcccattggttgatgccactccttctcactcccccttgggggatctggttccacctgggccaagggttcacattgccattcctgtccctgcatctaccccagggttcccggacccccacactcacagcacacccttgtacccagcaccaaggagaaatggtaaagaccccagtgtcaggccaggagtggtggctcactcctctaatcccaacactttgggaggccaaggcgggtggattacttgaggccagaagttcaagaccagcccaggcaacatggtgaaacccccatctctacaaaaaacacaaaaattagctggatgtggtggcacacacctgtaatcccagctacttggaaggctgaagcagaagaatcacttgaatcaaggaggtggaggttgcagtgagctgatatagcaccagcctgggtgacagagcaagactctgtctaaaaacaaacaagcaaacaaacaaacaaacaaacaaatcccacaaaacccccagtgtctggagtaagaaccccagctaatgaaccctttaccccctggctagatgaccttgggcaagtcacttcacttctctgggcctcactcccctcctctgtcagatagggctgatggaagcacccaaccttgtagggtaacagagagggttataccataggaaggacccaaagcttggtccagcgcctgcaacagcctctggcaaacagtggaagctccagttttggacacttgatggtcagtgtagtttgcagtttaaaggggactttccaaccccaaaagattcaggacccagagctcaggtctctggtggtggcatttgcaggtctggggcaagcctagggaagggacgccatgtgcggcacgggcatctagtgtcccagagtccgcacgggttgctgggggaaaaagagggatagtcgcccagccagggcaggggtgggagttggggggagagggttacttcctcctgccctgaatctccgctcggggttcaactggctcgccggcgggcgagggcggggcaggccggcctctctggccctgctggggggtggggggcgggtcccccgggaactgctcctcccgccagccgctgctttaagaggctgctccgcggtagcgagcggggccggagccgcagcccgaacgagcggaccgagccgaccgggcaggtgcacggctgcggggacggcagcggcatgaccggccaccacggctggggctacggccaggacgacggtaggcacagacctcccccaccgcctctggctcggacccccgacccaactgcactcgccccaaccctcttgcccagctggtttcccagaccggaaagctcccacactccaggctgggcgggacccctcttcccatcccggcccccgaacttggcccaagccttggtcccccgcgccagacgcaaagtccgcgctgcgccccgggtggccccgccgccagcaagcgacctggcggctgtgtcctgccgcctcctccgcgaagcccctgattgcccagcccgctcagacccaggcccagactctcactcactcgccccgggcgtgcgcagcgcgtgggggtggcccagggcagcggggggcgggcgccgcggagcgctgtgcgcgggtgtctgcggggagcgcgcacggcaagtgagcggggacctcgggggagcggggctccgcgtggcaagggcgcagtgtcccccggagagaatttccccgcagaagtggccgagctgccttctcggccggtacgtgagggaagggggcacttgggggcgcaagcatgtgtctgggtgtctacaccgagcagggtgtttgcgcacgtccgggtgtgagtcgtgggagcccgtggcccacaccagcctcctgggctgacgcggaagagagctccttcatcctgcctcagtttccttaggactcagagaaagggagaagaggcagaaggtgagagccagacggctggagtgtgggtctggggcagtcaattccctttggggccatttcttaccaagcaggggtgggggtgtggggtaaggggttccctatttccctggggagccagtgcaagacaggtggggtgcggagaagaaaaagtaatgatgggaggaacatcccccagccccactcctctgcggagaggcagtcactttgtgaggttgggtgggggaccacagtctgggaagccagaaagttgcagtagaccagagggagggtgctgtggagtctttggctccctctggggccccaagaacaaaggagcatattttggaagagaacccccagatctgggtatgcaagagctggaaagagacattcagaaaaagatgatatagacaagcagagagggagagacaggcagacatggggcagatggacaggacccatagggatcatcttctcccagcacctgctctgagccaccttttgggtgcttcccccagagccagagtcccctgcctccagctcttcttgctagtcatgcccaccagctctgagcacccagtgtcctgtgtagcctgctccatgggcctgctcccccaaagcagccaccccatcacccaggcagagctggattgtccagtcgaggaagggaaggacagaggacagaggtgccggcatgcagcagtgttcacagggcttcaaaaataacccagaggggccgggccacgattctgagtcatccattggggacacggctctgtcggcacctgctgctgttttctcaggaaaacttaagaagccaaaaagggggagaagcaccagccggcagtagctctaaaaataggctgcatctcaggatgttccccagggagatgctgagcctctcggctgcagatggatcctctgggaggcaggtggtgggcgcctgtgggtgtgtatgcaggtgtgtgtgtgtgtgtgtgtgtgtgtgtgcatgggcatgtgttttgctgtggtcctttatgcaaacttgggtctccaacagaggggtttgtgtgtgagagagcatatgcgtgtgtcagatgtagtctgcagggctgtgtgtgtgtttgtacacatgaatgttctgggcctggctgctctgtgtgcacaatggaagatcatagaaagattaatgtgttcataggaagatctctatggacttgcaggcacacacattgggagggcagctgggggcagtgcatgcacatgctgtatttatattagtacatatgcatgcacacatgtgtgagtggccctcagttccctcatctgtgaaatggggatcttgctggtttctatttcacaaggtggttgtgagaggcaaatacatgtcacagagtcaaagctaggttgatgtgagtttttgttgttatttatcacaaacaccaacaccaaattgcccaaggcacagaaagaggtgagatactgatggggtcaggtcagagacttcagatgtctggaggtctccctgttggggagacttattactctgagccaccccgagcctgtagctgttatgttcccttccatacagtacctctctgggcctcctatcagcactggaaggtgagttttagtgagaccatttcacagacaaagaaatggaggctgaaaggggaaatggcaaagctgggattggaactccaagctgtgcagctccaatgcaggggctcacctctgaaaggatgctgaagagaccattcccctatgggtgtcctcggcctgaagcccagagatcctggctggcctgagtccttgccctcctccccacctgcaggcccctcgcattggcacaagctgtatcccattgcccagggagatcgccaatcacccatcaatatcatctccagccaggctgtgtactctcccagcctgcaaccactggagctttcctatgaggcctgcatgtccctcagcatcaccaacaatggccactctgtccaggtagacttcaatgacagcgatgaccgaaccggtaagtggcccctgccaaagcctggcacctggcccctggccccttagggtcctaaccttgtgttgggcagtctcaggaagcatgctatggtgggtaagaaaggttcctcctctcaccagctgtgaagccttgggctgatcttcagtctccttatgtataaagtgagagcaataagacctaccctcttaggtcatagaggggaaaaatgaaaaaaccaagtaaggtcgatagatctggcacacagcagatgctcaggaaatgctaatttctttccttcccttccttcccttccttgtggtgctacagatcaggtttgttttcactctctgccccatcactgacctgccaagccctcctcgctgtgtgatctggccaagcctagcagggagagagaagggagctaaaatttacaagtgccaaaccccttgctaaagtcacaagccgctcatttattcttctcaataacccatctctcagatgggcaaatagaggcttgatgagctggggagggccagaagcagcctggtccagcctgaaggtctctctctctctctccagttcacctatgacttcaaggtccaaccatcttgggccagtaagaggccagtgggaattcgtggcagctccttccaaggcctctttgccctgggattagagtccagattctttcatgataaattcctagacaggagtgctgttcattgaagggattttcgtccttatgactgggccttatgactgggtagagtggtggaatggggcgaggaagaaacctactagagtttcttgtgtaaggaagtattaataactggttccttcctcctccttctcccctccccacaaatacaataaaagccctcaaaggaacttaagtttcaaatggaaaattaaaaggcaaagaggatgaaggaagccagacctttcatgagaagagtgatcttacttagttctgagttccctggtaggctaggaaaaaacagaaagaggattgattatagtttttgctgcaaaagaaagggagtctagcagatcctcaggagagagacaaagcatttatttcctggtactgaattctaagaaaagcctcttactcagagctttggggagggggcgtggggctctagctgaccctagatgatagtttggcaaggaacagttttcatatgactgtcccttctaacagccttcagagggcactgggggctcaactaagaaatcagtagctcaatgaaggccactggggtgggagaagacacagggggacatgcctttggattactgatctggggtgttgccttcaggcctggctggggctccctcccccacccagaatgcccaggccggagggcgcaggaagccagtgaaaagaggaatgagatggtggggctctgccactcacccactgtgggtcactccagaggtcagacgggttgatgccagcagagtgccaaacacacattgagtgccccgtgaatggcagcacattctgtgtgtgaactgggggaggaggctaaggggtccaaggtcaaggggtgttacggagggagctccctctctaggagcccacactatagggtcccaggtgaggcatgctttggagggtggcatctgcagacctatccaattgcttagcctgcaggctcagccgctcctgcttccagggatggggcagcctgattagggccccacccacagctactactcccagactcctagccagtgcccaggtcttgcctctttgataagaccgggcaagaaagagggacttctggactgtcctgtcctcctgcttaaggaggccacagggccaaagccctaccctggtcacccatcatggaagggaccagtggaactctgagcctggggtgttatctgatccaggagctcacattcaagcctagctggggctccctccacctccagatccctttcagctggaaattctatcagtcccaggaggcctcgtgcatggccccagctcactgggtgtcaaggcaagaaagttacaaagccagcacaagtggggccctcagaagaggccatttctgggggaggcggcactggaggcacctgggcctgtccaggaaggtagagaccctcaggagctaccctcctcttctggaaaagcacaaagtttaaagaagtttcaaggttctagggaggcagtgttgcctggtgattagtggcttgggctttggacataagagatactagttcataccctagttcagtgccttgctgtgtgaccttgagcaaatgcctcgtcatcactgtgcctcagcttctctctttgtagaatatggataataataagttctgtccctcatgggctactatgcagactaaacaaaatagtctcttcaacctagccctggatcagggtttcagacatggtaggcctaactgtcagtggtaatgggggtcctgggaggcagggtcccaccctccatgggaaatcgggcaggagcggggaggacagctagatagagagctgtcctctgtcagtcccagacccttctgccacctgccggctgtcaggatttctgccctggcccagctcaagggacaggggtctagggggcagtggggaccaacccaagcccagtcagcccagtgaattttccaaatgaaaaatgtatcccacactttggaaggctgaggtgggcagatcacctaaggttgggagttcgaggccagcctggccaacatggtgaaactccctttctactaaaaatacaaaaaattagccggatgtggtggcaggtgcctgtaatcccagctacttgggaggctgaggcaggagaaatgcttgaacctgggaggtagaggttgcagtgagctgagattgtgccaccactgtactccagcctcggtgacagagcgagactccatctcaaaaaaaaaaaaaaaaaaaggaaaaatgtatctcagctggcacagtggctcgtgcctgtaatcccagcattttgggaggccaaggcaggaggattgcttgagcccatgagttcaagaccagcctggccaacatagagagaccccatctctacaaaaaataaacaaattagctaggtgtggtgccacatgcctatagtcccagctactcgggggggccaagacaggaggatggcttgaggccaggaggttgaggctatcataagccatgtttgcaccatggcactccagcctgggcaacagagcgagaccctgactcaaaaaaaaaaatgtccctttcctgggctgctgccctggtcctggcactgggctgtcggtcctctcctactcattgccactcgccccacttctacccacagtggtgactgggggccccctggaagggccctaccgcctcaagcagtttcacttccactggggcaagaagcacgatgtgggttctgagcacacggtggacggcaagtccttccccagcgaggtacgggccctcctccacttgaatccctctgctacatgggaaggaacgcaggcctgggtagtcaggggcttgaggatgcctggggtcgggccttggagagggggaagaggagcacccggggcctttgggagagatattttctacccacccccagcacagggtcttccatctgaccctgtccactgctatccttcctggtctgtgcgtcgtggagttttctgaagggctacccagtcccactgcagccttgctgacagccctttaagggttgagcccagtattcaagactgtgcatgaactgatcttgcctggcctcatccttcccctcacctcttcatacactgagctgcatgtgacgaatcccctgtccacacctggctccttcataccaccaagctttgtctgtgctgttctctctgcctggaatgcctttccccaaggcttccctctgataaccctctgcttattctctggactcagctgtaggcaccacctcctcaaggaggtgtcacgctggatgttcatgatcgatttcacagctcgttccctgcaaggcagggcttgggccagattcctctttgggtcccccggagcccagaaaagaattgggcccagagttgggtggatgctacctgtgaccctctggggctcccctggaccccccagcatcctaatccttggaggcttgacagcttccccttcctgcaaagaggccaggggtctggtgggagtgaggggagcctggctcagagttcccattgcctctgggaggcacgaagcattggcctgttgttgccccatagctgcatctggttcactggaatgccaagaagtacagcacttttggggaggcggcctcagcacctgatggcctggctgtggttggtgtttttttggaggtgagtggtggtttgctggggcctggaggggcatgggaggcctggcactgcccctagttctagaacacagtgggctctgggctcacactgccctctccctgacagacaggagacgagcaccccagcatgaatcgtctgacagatgcgctctacatggtccggttcaaggtaaagtccctgcccctgacccgagcagcccgatggggagagaggaagaggctggctcacaagttgggcccttccagtccttcattctgggagtaaacccttgctgagaccaaggaggagggtcagcatcagcagggccctgcacctgattcctcatcggggtcagcagcccccttgggtgtccagcatgaagcccggctaggtataaaattgataagatgcttgtcacattaatggtggtctaataggcaatgtcattgagggcagctgaaggcaagggagggaagatcgtggccaaatacctccaggagccacagcttttacatacaagcaaacggatgagagggcccggctcaggctggaagatggcatctgggatcacagacatttgctcacaatttgcatcagtggacacagagaggcctaaatcctgctgatagaaatgggtggagaatgccgggcatggtggctcatgcctgtaatcccagcactttgggaggccgaggcaggcggatcacttgaggtcaggagttcaagaccagcctggctaacatggtgaaaccctgtctctactaaacatacaaaaattagccaggtatggtggtgcatgcctacaatctcagctacttgggaggctgagagaggagaattgcttgaacccaagaggcagaggttgcagtgagccgagatcgtgccactgcactccagcctgggtgacagagtgagactccacctcaaaaaaaaagaaaaagaaaaagaaagaaagaaagagagagagaggggaaggaaggaaggaaggaagggaaaggaaggaaggaaggaagaaagaaagaaagaaagaaaaagaaagaaaagaaaagaaaaaaaaaagaaaagaaaagaaaaaagaaaagaaaaaagaaagaaagagatgggtggagaagttgctggtttggtcccagtgggaggtctatgctgattcctgggttcctccaccttgttccagggcaccaaagcccagttcagctgcttcaaccccaagtgcctcctgcctgccagccggcactactggacctacccgggctctctgacgactcccccactcagtgagagtgtcacctggattgtgctccgggagcccatctgcatctctgaaaggcaggtgagtcctctcagaggaccagatggagggacatggcactcagggctcaccccaggcagtgtgactctccaactagcaccccacagcccgtgatcccaccttcaaggttcctccccattttttactaataaatgtatagattcttggttgggagttagcttgattgttaatcaccagaacctagacactggctgggagcggggatacctggatcctgggacccccacccccgctactgtgttggaatctgaatgctacatttgctgataagtcttagctagatgggcttggaactagaactaggtaaagcagagcccagaccctttagtgagtaaataaatgagggtcctgcagagaaaaatgagtggggaagagtagggacagaccctaagggaaggaggagggaggggtagagctggctgggcaggtatgccagatgatgcatctggggtcatagaggaccacagcacccccaatctgccctgagcattccttctgcttcctcaagatggggaagttccggagcctgctttttacctcggaggacgatgagaggatccacatggtgaacaacttccggccaccacagccactgaagggccgcgtggtaaaggcctccttccgggcctgagctgcccatctgcctagccggccactagggcaccatcttctcaagggcttccatgtcagcagacaccaaaccatctgaggcttcctccctggggggtgctggggaccctccttcagccagtttgctccttggtcaccctggaggcttctggatgggacccttgagtctggggcacccttcagctgccctggggacaggaaggacaggagctaagcagggtccaagcctggggctgcctctgctctccaagacccaaagaccctgggaacctcctctggtcttccccactggcagtggcagcagccccaccccgagcgcacactgtgatggaggagactgagctccctggggcgggcagctgacactaccagagagactcaagcaataattagaggtgggcagagctgccctctcggcattacctcttctgcaggctctgccatgcacgcacctcactgccaggccattaaaatcagcacccagcatgctggaggtgacgtggccttctccctccagccacctgctgccacgggcaggccctggctatagcttatacagtatctccccttgtccccacccagtcaccaaagccacctacatgacagtccatccctgttgaattaataaattaatgtatccatgcaacaaataccaattgagtgcttgtgctgtctctagtaccgtcctaggctttggggagcaatggtggtgagttaagcactatgtgttgggagggatatgagtggtgagcaggtgagggttacacaaagggcagggaaggggctatgggagcagatgagaggggaagaccatgtcactcagcaaagaaatgcaattctggtcaggcgtggtggctcacgcttacagtcccagcactttgggaggccaaagcaggtggatcacttgagctcaggagttcgagagcagcctggccaactgctgaaaccccgtctctactaaaattacaaaaattagctgggtgatagtggtgtgcacctgtaatcccagctgctcaggagcctgaggcaggagaatcgcttgaacccaggaggcagaggttgcagtgagctgaggtcgcaccactgtaccccaggctgggcgacagagcgaggccctctcaaacagaaagaaaggaagaaatgaaattccaaccagtattccaaatcagatagaagggaacagcatgtttgaggccaagggaagggcaagtgtgcaggctcagaggtgagagagagcccagtgtggttgtggggctcaaaaggctcaaaggggctagagccctgggggaaacctgggaccccctccccaggctgacggggagctaccaagggcttatagtagaggaggggcagggccaggcctgcaaatggggaacatccctgaggaatgcggatgggcaggcaggaatggtggcagggagcaaggggtggcctgtgtccaggcgggaggggacagggtggagggaggtgggagacagagggctggatgagagagatttaggaggtggtgcccaaaagacagtgtttggctgttcaggatagagaggagaccagggcatatccctgagcagaaagtggagccttcacttgctctgggaaccctacagggagctggccacattggacacgcagcattgtggggtcctggaaggaaaatctaagggggcatgtgccttcaggcccaggccctgcacacgcacaaccccaagagggggttttatttttatttttatttaattttacttatttatttatttatttatttatttatttatttatttatttatttttgagacggagtcttgctctgtagcccaggctgaagtgagtggcatgatctcagctcactgcaacctccgcctcccaggttcaagcaattctcctgcctcagcctcccgagtagctgggattacaggtgcgcaccaccatgcccggccaatttttgtatttttagtagagatggggtttcaccatgttggtcaagctggtctcgaattcctg

SEQ ID NO: 14722 - DNA, 32104 bp, Human
ctacaggtttcagaaggagcatagtcccacccgtgctttgattgtagacttccagcctccagaactgtgagacaataaatttctcttgttttaagtcacccagtttgtggttctttgttacgacattcctaggaaactgataccctgaggtatcattttacagacaacaccaacacaaaccttttcaaaatcatttacttcttcacgggcaatatgactagccttctaccaaatttgtgggtgtttcctttcatgaagtccataggtatgagaaactaagcagtgaactctcatctgctgccttttgaccttcctactttcccggagtgtattttattatcccttatattttacctgtccacttggagaaggaaatgtgacagcacaaacacatgatgagctgggaaagcctcacacctctgtttcccatcagtgtgttccatgggagctgggtaagggcaagggaaggtatgggaaggtgtactctcaccctagtccaggagaccatgcccagggcaaagtgcaattcatcatcactgcatcattaccatcaaactgtgccatctctctggtccccatcctaggggattgggggtggggatctgtgttcattttcaccttatttcaggcagttattaacctgaaggtgcctgtagggtctgcgagatagcagggaaggagtcttcgtctccctcacagatggtcaccttgtcttcagcaccaccacccccctcccaattgttctcatggggtaacctccttccttggcctcccatccccacaggacagccgttctcttcctgaaaggagggtcttttcaggaagtggaggactttaaattcctccttggatctatgttcacagtcttcagaacccagcctgtcccaactgtctctcaaaccttctcaaccactccctatccttcacctgaccaaacttactctagcacctacagcttgctatgccttctttgcttcctagagatggcacctgctgttccttatgcttaaaacacccttccagctgggcacagtggatcatgcctataatctcagcacattgggaggccaaggcgggcagatcgcttgagcccaggagtttgagaccagcctgggccatgacgaaaccccatctctacaaaaaatgtacaaaaattagccaggtgtggtggtgcatgcctgtagtcccagctacttgggaggctgaggtgagaggattgctgcctgggaggttgaagctgcagtgaattgagatcacaccaccgaactccagtctgagcaatagagagagaccctgtctcaaacaaaacaaaacactcctccatctccaaaccacatgaaacattcttggagagggggactggggaggttcttctgtgcacccctgagcaccctgcttccctctatctagaggaaggccacattgtctggtaagtgcttgtttgctgtccctcttccttcatgagagtaaactctccaagaacagagccctggacttgtctgcatctgcagcagggagcccctagctttgtgattcaaaataggcttgtgggcttttcatgagaggaagaaatgggtgaaaaataatgatcatcaaaatgaaagttattattcatgcaagatttggggggagtctggcctcctgtattcaaaatctcatttaaggtcaaaagacacttgggacccatttatccccactgcacaggtgagcacactgaggatttgagaggtaaagagtagatctcacagccagttaagtggtcgaaatacaagtatgcctgattccaatgccccagtcgcccccaattactgcatggacagagggcaaattggcaggctagcgggtctgcctttctggccgatggggaccaagagccccagacccgctcgggtaccagggccgcttaggccccggcgtaccggcgacgcgtgcgcagtgcagtgcggcgccccctgcaggcagcgcgcaggagacggtagcggcgaaggggcgctcagtgcgcctgcgcgcttgtggagctggtggcggcgctccgcaggggctcggctgttttccgcgcggcaggcgcggccatggcgcagctgggaaagctgctcaaggagcagaagtacgaccggcagctgaggtgagccgaggctcaccgagccgagggcgggccggcgggctttccagcattcgggccgggcctaagggcgcgggcggcgcggtcgggccttcctcaggccttcttccaggctgggccgggccgtgcggggcgcgggaagccggcgctcggagctcccgccctgggccaaaggtgctccgcgagggctgggaccccttcccccgccacgcggtgtgcagttcgggggacggggtccccagcgccagccgggtagctaaggcggctgccggccccgttgcgcccaggctcctcgttttccgaatggggaggcccggggcgcaccgcatcccggccgcgagggcggcacagagggttaggttttgttctcagccagcgctgtccaatggaaataaaatgctagtctcatgtgagccgcaaatgtaattataaattttctagtaaccacactaaaggtaaaatgaaacagatgaaattgatttttaaatacaatttaacccaatatgtccaaaacattactatttcaacacaatataaaaagttcttgagatattttacttaaatttttatttttatttttatttttgtttttgtagaaacgaggtttttgccacctttccccaagctggtcatgagtattttcctttttaaaactgtcttggaggaccggcacggtggctcacgcctgtaatcccagcactttgggaggccgaagcgggcggatcacctgaggtcaggagttcgagaccagcctgggcaacatggtgaaaccctgtttctatttaaaaattcagaaattagctgggcgtggtggtgcgcgcctgtaatcccagttactctggaggctgaggctggagaatcggttgaatccaggaggtgtaggtttcagggagccgagatcgtgccactgcactccagcctgggtgacagagcgagactccgtcaaaaaagcccccccaaaactatcgtataaatattgtattttacacttaccagcacatctcagttaacactagcctcattgcttgtgctcagtagtacatgtggctagcagctaccttaatggacagtgcaggcctaagccatcaggagggtccttgggtacttccccacccttgccttttctccttgcactacccattccttatttattgagcgtcttctgtgtcttgaggctgtggagataacaaagctgctcagctttcctccttcctggagcctctgagacaacagaagttatatgtccccaaggactggagcttctgtttgcgccaccagcctagtgctgtagtagaggctttaggcacttagttctgagagtacccttgaaagcaaccatttcctgtgctttacagttggagaaacagagtcttggagaagttaggtaatttgcccagagttccccatatctttgagccaggatgtaaactaaggctcttctggctttttcggaggtactcagttacatcctgcttccaagcttttcggagaagaaacagggtaacagtccttataaccaacttaggttttcttgtaaattcttggagttcttgtgtttctaatgcaggtataactgtacatgacagagctgagaagatagttgaggttactaagcaactctaacaaaagagggtttttgctgagggcattccatttaagtcccaaactttactttcatagtgagaactggttttgaagtgtcaaagggaagcagttagaagcaaaatgcagcagtcaataagcccctccttacttcacgttagttgggccagcaagatagtagagaggactgattcatttggcctattcttgaaacatgttacttagagacacaccaggattcttttttttttttttttcagggacaaggtctcactttgtgacccaggctagagtgcagtggctagagtgcagtggcaagaacactgctcactgcagcctcaacttcctgggctctaacgatcctcctgcctcagcctcttgagtagctgggactacaggcatgtgccaccatgcttagctaactgttttagagatgggggtttgcccaggctggtctcgtacctctgcactcaagtgatcctcctgcctcagcctcccaaagtgctaggattacaggcatgagccacagtgcctggcctcagtattctttttgttttatttttgaggtgggtctcagtatgttacccaggctggagtgcagtggctgttcgcaggtatgattattggcacaccacagccttgatctcctgggctggagtgatcctcctgcctcagtctcccaagcagctgggactacaggcacacacactatctcaccctgcttgagatgcaccagtatttttttttttttttttttgagacggagtctcactgtgttgcgcaggctggagtgcagtggcgcggtcttggctcactgcaatctccgcctcctgcgttcatgcgattctcatgcctcagcctccctagtagctgggattataggtgcgtgccactgtgcctggttaatttttgtatttttagtagagacggggtttcactatgttggccagcctggtctcaaactcctgacctcaggtgatctgcctgcctccgcctcccaaagtgctgggattacaggcgtgagccactgcgcccagccaagatgcaccagtattcttaaatttactctccaactatctaagcatccatcaaccatatatgtcaggtgtcttctacgtgccatactttgatggagaaaacaggcgtttacggtccatctggttcttctaggcgattcctccatacatttgacagctgtctgggcccttatggagcatacagtggagtggaaagatggatgctcagcaaacaaaaacaaatgaagccaggtacagtggcttgtgcctgtagtcccagcaactctagaggctgaggcgagagaaatgcttgaacccaggagttcaagaccagtctggataacatagtaagaccctgtatcaaaaacaaaaacaaaaaacaaggcagttgcttgacatgctctggaggacatactgactacataataaggggtaatctgctttaaatcaggtaacagggaaggcacattaatcactctattagaatgttcattgggtaatatactttaaagcactcctgtagaagttgatgtgaggcttttcagatgataattcagttttcttggtaaagcttttgcagaagtcacagtaataagccctatgtcgagatcttaaatgcatctaacttaacttaaatgcatctaatataattttttttttttttgagacggagtctcgctctgtcgcccaggctggagtgcagtggcgcaatctcggctcacttcaagctccgcctcctgggttcacgccattcttctgcctcagcctccgagtaggtgggactacaggcgcctgccaccacgcccagctaattttttgtattttttagtagagacagggtttcaccatgttagtcacgatggtctcgatctcctgacctcgtgatccgcctgccttggcctcccaaagtgttgggattacaggtgtgagccactgcacctggcacatctaacataatttaagaataaatgaaatagggctgggcacggtggctcacacctgtaatcccagcattttgggaggccaagtgagctgagatcatgccactacactccagcctgggtgacagagcaagactctgtctcaaaacaaaacaaagaataaatgaaatagaaaacagatgagggtttaaatccaaagacgctttttaaatgtttgtttgtttgttttgagacagagtgtcgctcttgtgcccaggctgataaggggctggaagaccaagtttctgtttctaatttgaccctctccctcttttcccctaaccattcaaggcatcaacctgagttctagattactgtataatcactatactaatatctgttcccgtcttacctgtattctgtggttatcatatcagtctatgcaaggaaagtttaaagatcaccattcaaataagaaagctgtattttcatgaaagttttaaaaacatcaaatttgtgtctgttttgtaggttgtggggtgatcatgggcaagaggctttagaatctgctcatgtttgcctaataaatgcaacagccacaggaactgaaattcttaaaaacttggtactaccaggtaacgtaggtttgtggttgtgttctaaatatacttctttaagtttatgacctagaactatgtattcctgactgactctgttttggctctcaggtattggttcgtttacaattattgatggaaatcaggtcagcggagaagatgctggaaacaagtatgttctattctcttcaaatatattcacgttaaggaaggcaaggcctgagtcttagcttcacctcctcagtcagggtgactcgactctcagtggaaatcatccttatgtttgggattatggtgaggaagtgagataatataggtaaagtgctagtacagcatctggcaaatagggcattaataaatgttacccatcattactgtctttattgttattaatacaaaggagtagtcgttattcctttattcatggaatatgggcacttcctaagctcttgtattgatccgtaggtgttagcatataattaacaataatgcctgttgtttgtgatgtcttttaggcttagtctaggggtatctctctttacagtgtcaacaaaaatgctgttttaaagatggcctgtatattattctttaaagattatatttagactttcagaacatgcccaaatttggatttaaagctcaccttttcagggacttgaagtctggtatctctcattgtgtttgtcagtaacaacaacagtgagtaaatataagggaaaccagcaattagttcatatttagttttgatgccttttctttggatcgtagtgccagtttctgccaggcacagcacagcttttttattgatatataccaagaagtcttgttatctttgcttacttggtgggttagagtagaaagtgataaaaataaggtttcttcttatggagccagtgagcttataccgaaaagtggcatcctgactctgatcagcagcctcatatctgggccttgagacatgtcaagggtatgtgtgggaggaagcctgaataaatctgttacagttacgtgcaaaaacaaatggttcaatacaccgagagtggtctgtggaacaccggttctagggaacgataagagctgttaaatgggccaatgggttccatagtgaaattagtttgggaaatggatcaaatgaagtaaaaatttctttaccataagattttagtatcacatgtattatgtgtattatgaatttccaagagggaaatatagtatatggtgtttcccaaactttttttttttttttttgagacggagtctttctctgtcgcccaggctggagtgccgtggtgcaatctcggctcactgcaagctctgcctcccaggttcacgccattctcctacctcagccttccgagtagctgggactacaggcgcccgccaccacgcccggctaattttttgtatttttaatagagacggggtttcactgtattagccaggatggtctcgatctcctgacttcgtgatccgcccacctcggcctcccaaagtgctgggattacaggcatgagccaccacacccgccggtgtttcccaaacgtttttagccaaggaacccttttctctcagaggatcttgtgaaattcacatgctgtggtacacaatttgggaaagaaacattgatttattagcctatctttctttataagttccatctgattttcttcctccaggaaggccattacagtctgtaatcacaatatagtttgttttatactgtgaatgaaatatgcatgctattacaaacaacttttcctttatagtcagtaagctttacttttttttcctttattctgttcactttagtttcttccttcaaagaagcagtatcggcaaggtaaacaattagagaatatagttggatgtgagcatctaatgatgcccctgtgttttgattgcttgaaaagctttgactttaaaaacgtgtattatttctctgagaaaaaagttaactaatttttgtaatcttgtaaatcttcatatgtttggtagtttaagaacttagaggtgtactgtctgtgtttatacattgcatcctgtattaaagctaaatcttgagtaatgttaatattcattctggttaacaaattttttttttttgagacggagtctcgctctgtcccccaggctggagtgcagtggcgcgatctcgactcactgcaagctccacctcccaggttcacgccgttctcctccctcagtcttccgagtagctgagactacaggcgcccaccaccacgcctggctaattttttgtatttttagtagagatgggatttcaccgtgttagccaggatggtctcgatctcctgaccttgtgatccacccgcttcagcctcccaaagtgctgagattacaggcatgagccaccacgcccagcctaaaaaatcttacaaaaccatgttagtcaacttagtgaaatgacttttagcttagtgattaaccactcttgtacaggattatagatgtgggtggttagagtgagtctgaacttgatccaggatatccctgcctgctacccagagttttttggtcatttgcctaatcaaaaaagtagagtacaagtaatgtcatttgagaactctggatgatgatggttttgctctgttttaagtaatattctgttgagtcttaaacactaggagaagcagaattggctgggagcagtggctcacgcctgtaatctcagcactttgggaggtcaaggcaggaggattgcttgagaccaggagttcaagaccagcctgggcaacatgtcaagaccctgtctctacaaaatatttttttaaaaaattagctgggcatggtagcacatgcctgtagtcccacctacttgggaggctgaggcaggaagattgcttaagcctaggagttcaaggctgcagtgagctatgatcaggccactatgctacaaactgggcaacagagcaaaagcctgtctctaaaaagaaaaaagaagggaaacagagttgtcatacttatgcatgaaatttggatagttttacagtatgtttgcctgttccataaattgggggattatattgtgaccaagttttttctaattcaagttaaatgctttgtttttaaaaagaaccgagctgaagctgccatggaattcttacaagaattaaatagcgatgtctctggaagttttgtggaagaggtatatatgtacacacattattatgtctgtgctgaaatacaattttttaaataattcaaagccccagaaatttagaattttgaatctttgtgtcatttatgattagttgaattggaattgttgcctcatttgttgtaaaatagcttaactgtctctgccatgtttaatatgattgtgaaattggttttttttgtttgtttttttctttgctgtcctgtttagagtccagaaaaccttctagacaatgatccctcatttttctgtaggtttactgttgtagttgcaactcagcttcctgaaaggtaaatttttatgttaatatgtttttattttaatcttattagatttgcattgttttattttctttgcacagtctatgatgatatggttttaaaaattgttaaattctatagaaactttaaatatgaaactttttttttttttttttttttgagcttgagctcaaattcctgagctcaagcaatgcaccctcctcggcctcccaaagtgttgggattacaggtgtgagccaacgtgcctggtcaagagtttcagatttatggctgggcacggtggctcatgcctgtaatcccagcactttgggaggccgaggcaggtggatcacgaggtcaggagattgagaccatcctggccaacatggtgaaatcccatctctactaaaaatacaaaaattagctgggcgtggtggctcacgcctatagtcccagctactcgggaagctgagacaagagaatcgcttgaatcagggaggtggaggttgcagtgagccaaagatcgtgccactacactccagcccttgtgacagagttagactctgtctcaaaaaaaaaaaataaataaataaataaataaataaaagaaattcttagaaatcttccagcattgaaaagatgaggaagagaaaaatactgaaacttttttttttattattattctttagacagagtcttgctctgttgctcaggctggagtgcagtggcacaatcttagctcactgcaacctctgcctcctgggttcaggtaactctcgtgcctcagtctcccaaatagctgggattataggcatgtgccaccgtgcccggctaatttttgtatttgtagtagagacggggtttcaccatgttggccaggctgatctcaaactcctggccccaagtcatctgcctgcctcagccacccaaagtcctgggattacagttgtggagccaccaagcctaaccttagatgtgaaacttttggaatatatttagagcagttaaaccgaacattgtttttttgttgttgttgtttttgttctttgtttgttttagtgattaaaaactagttagaattgattattgaaggctgggtgcagtgactcatgcctgtaattccagcagaaccaggctgagacaggttcagatcacttgagcacaggagtttaagaccacctgggcaacatggcaaaaccttgtgtctacaaaaactacaaaatttagccagatggtgtgcctgcttgtggtcccagctactcaggaggctgggatgggagaatcacttgagcctgggaggtcgaggctgcagtgagccatgatcatgccactgcactccagcctgggcaacagagaattggttattggaattgttaggggtgtatttgtgggttttatattttttctctatcatggaaatgtttagaattatctttctttaacgtttctccttaatatgacagactaaagtttcacatccctcttgtccaaagatgtactttctttgagactgcagcctgtggaaatgcttgcttttcagtgtgttcttgacctgcttatgtaaatgcagttatgtacctttgcatctattatttagtaagaaagttgctgtaagacattttcatgttttgcatgttttcatgtttggcatatttccatttgcttatgttcatattttgctttttttttttaaacagcacttcactacgcttagcagatgtcctctggaattcccagattcctcttttgatctgtaggacatatggactagttggttatatgaggatcattataaaagaacatccaggtaaaattgttgagcatatgggcttactattggttgctttagctataattttagaaacttgacaatttagaaagtcagttttaaattacaaagtaaatttgtagcagcacatctctagttgcagattcaaagtggcaatcagattcaataggctgcaatctactctttatgtagcattatagaaggatacaaagcatgatataccacaggcacagcttcttcatcttattaggagatccagcaactatgcaagtacccagcttcttttgccccctaacccacattgggcatgtatggctgtggagagctaaggaatgtggatcactctgacccatgaagttacaccacctttccccactccagtcttttttttgttttttaagacagagtttcgctcttgttgcccaggctggagtacaatggcacaatcttggctcactgcaacctccacctcccgggttcaactgattctcctgcctcagcctcccaagtatctgggattacaggcacccgccaccatgcccagctaatttttttttttttttttttgagacggagtctctctcttttgctcaggctggactgcagtggcgcgatcttggctcactgctacctccacctcccgggttcacgccattctcctgcctcagcctcccgagtagctgggactacaggcgcccgccaccgtgcctggctaattttttgtatttttagtagagatggggtttcaccatgttagccaggatggtctcaatctcctgacctcgtgatctgcccgccttggcctcccaaagtgctgggattacaggcgtgagccaccgcacccggccgcccagctaattttttgcatttttagtagagacaggatttcaccatgttggccaggctggtctcgaactcctgacctcaggtgatccacccgccttggcctcccaaggtgctgggattacaggtgtgagccactgcaccaggtccgtccaatcttttatttcattctcatgcaggctttaggttctctcaattcaggtgcaatttcacacaacaaagacatttacataactactgttcccaaggaaactgttgtaagagaccaaagtcgtttataggcagacctccatcagctgagggtttatataagccctttacttataaaattttaatcttagatgatcataaaattttcatccagtattcaaaacagtgctctttattgactcaagaaaacatttttactatgagccaagcactctgctaatgtggtgatagccattggcattggtagcatcactgaggagtaatatctgtgtgggcagttagggagtgcttgtcaggataagctctggctgctggtggtgagccatttaagagttgaaagtggtgtcaactgatgggagggaacaaaagagttgaaagtgggagagtgaccatgtaaacattttattttaaatgggtcactttgaagttgagtggaaagtaaatggatttaaaggggcaaagattggaggcagtgattgctgttagaaatttccagtggcctaagtaagagagagtgtgttctttttcctaatttagggaagagaagaagagagggtagataataatgaaggttcagcattactagttgtgtgcctgcctttataagaattatttcatttactctttccaaaacctttataaggtacagattgagtatccttaatccaaaaatccaaaatcagaaatgctccaaaatgcaaaactttttgagaactgacataatattcaaaggaaacactcattggaacatttcttacttcagatttttgggttagagagctcatctaatatgtatttgcaaatataccaaaaactcaacaaaatccaaaacacttatggtcccaagcattttggataagagagatatacaatctgtagatactttaatatctgctttttatagatgatgctgaggcaatgagagattaaattatttgcctaaggtcacatagttagcaagtgacagaactgggcctacctctaagcactcactgaaattatacactctcctgtcctctctcatgtggagagcagtgtacagagtgagattaggaagtggggagttactgatgttggggccaaggaagcaagaagtgaaggatgcccatcaggtttctggagaagaagtctaggtagatggtgatgctgtctattgaagaccacaagaggaggaaggataggttgttagttgctatctgtacctagggtttgtcaatgttgagcttttccagttagaacaaattgtgttctaaaggaatcttggttttacttttactaaaactttatagttgacttaagatttctgcattttactatatgtaaatcgtaccttaataaaacagtgaaaaaacctgtgggccctgtgtccatttaaaaattaaagatttcctaagtttctataattcaatgtattgtcatcagtattgccaaagaattaagtttatcttttgagctgggcacggtggctcacacctgtaatgcaaggactttgggaggccgaggcaggaggagcccttgaatccaggagtttgagactagcctgggtgacatagtgagaccctatccctacaaaaaaattagctgggcacagtgacacgagactgtagtcccaccttctcaggaggctgaggtgggaggatcccttcagcccaggagtttcagcagtgagctgtgattgtgccactgtacttcagcctgggtaatacagcaagaccccatctctctcttttttttttttaagtgttaaatttatccttttgaattctttgtttcacagtaatagaatctcatccagataatgcattagaggatctacgactagataagccatttcctgaactgagagaacattttcagtcctatgatttggatcatatggaaaaaaaggttggtagtgtgtgtgaccttacatttacagatagacttaaaacatttttttaacctaaggtttttgaattacactaaagtgagaaaatcctataaacttccatattcctgtcatcccgattacccaataacagtattttaccttgttttcaacatattaatttttctccaaaattaaaaaacttttttactgaagaaaagtacatatactgaacatctgtgtaatcactacccaggtcaagaaattggacattaacctattccaggtggggagatggggatggttaatgggtaccaaaaaaaaattagaaagaataaataagatttactccttgaaagcacaacaaggtgactatagttagtaataacaactcagttatacattttaaaataattaaaagagtttaattggattatttgtaacataaaggataaacgcttgaggggataaatgctatacagataccccattctccatgatgtgcttatttcacattgcatgcctgtatcaaagcatgtaccccataaatatatacacctaagtacccacaaaaattgaaagtaaaaaattttaaaacaaaaaacagaaataaaaaaattccaagaagttctctttatggactttttctaaacaaatagaaataatgacataacactataaggcgtatatgtattttttcccacttccatattaattaacatgcagttgcttatttggttcatcagaaaacagaaaagatcctcctttcttacttaggattggtgtctgaaattgagatttgagctgtgtttttgggtggcagtctctgagactgttttgctggtataatggggacaatcatagtatatatgtgacatactaggtatctgcctctagaaaaatttgtaaagcagtttttattaactcagttcattttcgtctattcactactctgcatatattaggagatcataaatattgttgaatttgttgaaaacgagatggtacagtgaagaattcataatactgatattttcttttatttgtctctcatttttaggaccacagtcatactccatggattgtgatcatagctaaatatttagcacagtggtatagtgaagtatgtccttttttaaaaaaaatttcatatgcaactgtattttcagtttcttacaaaggatttccttgatggggaatgggagattaattttttttccttatggagttgtatggtagggcaaatggatgcttttaaatttaaatctagcagttcctcttttgatcctgataattttaattaaaatgaaattcaataaatgtcattatgaaactggcagggggaatgaatgtagataaatggtcacagtgtctgttttctatcaagtgagcctctgatttcacagagaaatatatttgttgatgaaatcttatgtagagaatgggggacactttagactttcaatttctgtattttgaattttaataactagatttttaaaatttttaaccaatttagacaaatggacgaatacctaaaacgtataaagaaaaagaggacttcagagatttgattagacaaggtaatatgggatatgattaaatactgtataaagcttgaaaagcaaattgctagaggcaggtacttattggatttctgttaacacctttgtcagatgatagcatcatgagcttttattttccttctggagaagttaagaagccacgccttgtatagttttaaggactaatgataagccgtatttcttcttaagatttaatattctgcaggatctgacaaggttatttttataatgggggaacagaagagtgaaaagaaaagggctgtttgctaacaatttcccattacaataggaattctaaaaaatgaaaatggggctccagaagatgaagagaattttgaagaagctattaaaaatgtgaacacagcactaaatacaactcaggtaatgaaagagttgctgagggattcacatgaacaagatgttttctagagtccttggctattaaatggttgactataatgatttaagttaatattttctaaatgtatagttagaaataaatacagggccgggcatgctggctcatcccagcactttgggaggctgaggcgggtggatcacctgaggtcaggagttcgagaccagcctggccaacatagtgaaaccgcgtctctactaaaaatacaaaaattagctgggcatggtgaacatacctgtaatcccagctattcgggaggctgaggcaggagaatcacttgaacccaggaggcagaggttatagtgagccaagattacaccactgcactccagcctgggcaacagagtaagactccgcctcagatgcctttggttttgttatggcttagttgttgaggtctgaccattgaagtttttggggagctttggaataacacctggtagtttaagttagaattttcttgtaacttaaaacagcaaatatgctgcctttcaagttaggaaggcacgtaagatattattaccaactttttagagacaacaaggcagtgttgctgagtgattaaaagtgtgctggctggggccaggcgcggtggctcacacctgtaatcccaacacttttgggaggccgaggagggcagatcacatgaagtcaggagtccaagacgagcctggccaacatggtgaaaccccatctctattaaaaatacaaaaaattagctgggcatggtggtgggcacctgtaatcccagctgcttgggaggctgaggcaggagaaccgcttgaacctgggaggtggagattgcagtgagctgagatctcatcagtgtactccagcctgggcaacaagagcgagactctgtctcaaaaaaaaaaaaaaaagtgtttgctggccaggtgtggtggctcacacctgtaatcccaacactttgggaggccagggcagaaagattgcttgagcccagttcaagaccagcctggacaacgtagggagatcttgtctctacaaaaaatttaaaaattagatgggtgtggtggcatgcacctgtagtctcagctactctggagcctaaggtagtgggaggatcgcttgagcctgggaggttgaggctgcagtgagccatgattgtgccactgcactgcagcctgggcaatgatatgagaccctgtgtccaaaaaataaatgtgctttgtgaatcacttttctggggtgatgaacattttctgttttaattggggttatggttaaaaatatgtatatatagttatcaaaatgcattgaattggacatttgaaatctctgtatttcactgaatataaaaccacagttgaaaagaaaagattctaatagttggggggcagtaagctaaataaacagataaaaatgcaccaggtgctgtgaacaaaattacagcagaacaaagggtcagagagcatgctggggacaagggaatccggggttgagagacaattgtacatagggagccagggagactttccaaaagacatttaagcagaagcctgagtgaagtgacacgcagaggtctggtggaagagcttttcagttggagggagcacatgtgcaaaggcccagaagtgggatgaagcttgacttttgttcaagcatcagtaagcaagtcagtgtgattggagtgaagtgtaaaagggggaaaagtggtaggaaggatttgagtttggagaggcagaaagggccagatcataaaggccttgcaggctatttaagcatttcagtcagggaagtggattgagctgctttgtattctaaaagaccattctggctttcatgaggagaacacaattgaggggactgggagtggaagcagagagagcagttaggaggtcccactgagacatttcttttttccacccatcagtagaatccaagcctatgatttgtgtgtgtgtgtgtgtgtatttttttttttttttttgagacagggtctcacattggtgcccagggtagaatgcagtgacacaatcactgctcactgcagccttgacctcctgggctcaagtgatccccccacctcagcctcccaagtagctgggaccacaggcacgtgccaccacgcgcagctaatttacttttatgttttctatagacggggtcttcctgttttgttcaggttggtctcaaactcctgggctcaaatgaccctctcaccttggcctcctgaatgctgggattatagatatgagccattgtgctcagctttatactcttgattaacgtatgaagatcttgctagcaataaaattactttatggttttagtttttttcagagtggttgtctcaacggtcactaattagggtgcaagggtttcagatttttgacaagatggaaaatcatgatatactgcgagtctataatctgttttgtcttcagatgtaactatataaaataatttactggggccccttctttaccccatttatggtataagagaataggtattaaatggtagcaacagtgggccggagaggtctttcttccattctttccccatcaaatcttcatatggtactgattctaaataaaattataaaccaatcagaagtttgtatttgattacaatttgagaattcaaagaacatatctgaagaaatagcactgaaaataaagatgggcgaattcttaatactgtgtaagtaaatgtttcatgttcctttgttagatcccaagcagtattgaagatatatttaatgatgatcgctgcataaatatcaccaaacaggtaacaacaacaaaagtaaaaacattgctgctaaaactttgggtcaaagtaaaacgccacttaatgttaattttttcttattcttttagactccatcattttggattttagctcgtgccttaaaggaatttgtggccaaagagggtcaaggaaatttacctgttcgaggcacaattcctgatatgattgcagattcaggcaaatatataaaactgcaaaacgtgtatgtcactgttttcaaactatgtaatagaaaaagtctgattatattagagataaacattttatcatcctgtcagaaatcaaatgaaagtttattacaacctcattgcttataaataaactaggccagctgcagtggctcatgcctgtaatcccaacactttgggaggccaaggtgggagaattgcttgagtccaggagtttgagaccatcgtgggcaacatagtgagacttccatctctacaaattgaaaaattaggtgggcatggtagtgttcgcctttaatctcaactactcaggaggctgaggcagaaggatctcttgagctcaggagtttgaggctgcagtgagccatgatcatgccacttcacttcagcctgggtgacagagcaagaccctgtttcaaataaataagtaaaaataagctgaagaacttagaccaggctgggcgcagtggctcacacctgtaatcccagcgctttgggaggccgaggcaggcggatcacgaggtcaggagattgagaccatcctgactaacacggtgaaaccctgtctctactaaaaatacaaaaaaattagccgggcgtggtggcaggcgcctgtagtcccagctacccgggaggctgaggcaggagaatagcgtgaacccgggaggcggagcttgcagtgagcggagatcgcaccactgcactccagcctgggcgacagagtgagactctgtctcaaaaaaaaaaaaaaagaacttaggccgggcgtggtggctcacgcctgtaatcccaccacttcgggaggccgagacgggtggatcacaaggtcagaagatcaagaccatcctggccaacatggtgaaaccctgtctctactaaaaaaatacaaaaaattagccaggtgtggtggtgcgcacctgtagtcccagctattcgggaggctgaggcaggggaatcgcttgaacccaggagacggaggttgcagtgagccaagatcgtgccactgcactccagcctggagacagagcaagagtccgtctcaaaaaaaaaaaaaaaaaaaaaaagaacttagggggcaattcttgttaagctcaaagcaaaattgaatgggaaatacagaattaccacatacgcctaggaggcagagttttttttcatacttcatgataaacttaatatttgatcccttaactctgtgctatgaactatatgtattaagtaatttaacacacacacaaggttcacaacgaccttatgagagagagagagactgttaccggccccattttacacatgaagaaactaaggtattgaaaaggttacttatacaaggtcagatagctggtaaatggcagaaccaagatttgaaccccaggaaacccagtaccagagcctgtatgcttagctatggccctatactaccttgtatttgtaacttaaaaccatgaaggtttgatgaattttttatcttaatgtttcataagttatagtctatgactatagctagacatcttgctatccaggtatcactagcctgaacccagatagactatcacagggatgggtctcaatgaatatgaccctcgtatagttagggcatggtgcaaagaatccaggtctgctggctcggtttctttggggtccaagtaatgtcacacagagatgatctctcttccccagacagatttcactctttatcatgtcaccattgaacgaatcttggtttgttgtcctagcctaagagttcaactacttaaaacttggggaaggtcaattgaggatagaaagaagtatgaccttacatgggaggtagtcagcctgaacactgatgatttttagagggtgaaaggtaaatagacgtaaagaaaacttttatggccggatgcagtggctcacacctgtattcccagcactttgggaggccaaagcgggtggtgaaatgtgccacaagggatgttcacagttgttttaaatggttgaaattttacgttttccatggtctgtctcagtggtatagatacagataataattgggtaagggtttttttttcctctcataataaatacagagtattttaaaacaatcagaggtagagcatgtttatctatggcaatgctaaaaaggtatgaaggtcagttaattgaaaattgtcattaatacagtattttcagtttctaaatcacttgaacccaggagttcaagaccagcctgggcaacatggtgaaactccgtctctacaaaaaagacaaaaattagtcgggcatggtagcgtgtgcctgaattcccagctacttgggaagctgaggtgggaggatcagttgagcgtgggaagttgaggctgcagtgagccaggactgcgccactgtactccagcctgggtggcagagcgagatcctgtctcaaaaaacaaagaagttttacattggagatgaacagttttaatgtatttaactttccttggacttgacttccaggagataagtcatgttcttcagtaatgtattttttcaggtcctctgtcacagaagccgaaatcatagatccctctaggggagcagtttttaagttgggtgctgttagagggaccctgggttttagtgggcactgagagtccgtcactaacactggaaagattcccagctactcatggtgctgttgatagcatttccctggcattttcacatttcatacattgtcagacctgtgttttttcatgaaaaggaaagaaaatttttgttcatggtaacaatttaaattttgctaatttaaaaatttgttagtaattgctttttattcttttttagttaccgtgaaaaagcaaagaaagatgctgccgctgtgggtaatcatgttgccaaattgctgcagtccattggccaggtaagctactgggcacactgtgcccatacaggcctcagcacgtaactccagccagaaagggtttagagacagagggtgtggcactgcctctgtgcttctttagagggagctgtcatttccctgcctaatgggatagcttgtgataaggaaacaagatatttttaaagtgctctcccagctcttggagaaagccttcccatctcacagtgattggctttgtgccgcaccctttgttaatcttctcttttaaactggaacagaatctgtatttatctctttacaggcaccagagtccatttcagagaaagaattaaaattactctgtaagtccccttgaattaatttccttattttgcttgatagaaatgtgccacagggaatgttcccaggtattttgaatggttgaaattttaagttttccatggcctcagtgatatagatatagataattattgggtaaggttttttttttcctctcataatacaatacatggcgagtattttaagactgaatcagaggtagaacatgtttatctgtggcaatgctaaaaaggcttgacggtcagttaattgaaaattgccattaatacaggattttcagtttttaaattttaagtaatttaggaagtttttttgtctgaagactttgggtgtgaagtcttgagtcacatgtacattgacaatattggtttaaatactcattttgatctgtgttaaatgactgtaatggagttaagaattttgccatctagtttcggagtggttaggttcgtaggagtcttctcagtaactcctcagtaggccaaaagcattttcttttatttaagagtcagtttcaaaatacccaatctgttgtgcatgccatctgaagatttctccctgtagctactgctcctacgtcctgtggaagtttatattttgcatgctccccatccttaaaatagatttatccaagctttccattttatgacttctccacaatgtctgtttaggctcggttttaatgttttctgccactactaatcttgcaccttgtttgttctattagactaatcttgaattagcgtttgttgtattagattatataatactagatcacaagtttgatgctgggtatttgaacatttattattctgttctactttggggcgtttttgaaaatttcaataatacaaagcttaaagtcattacatatatcaagagtacaattcataaacctctctcctttaggactacttatccataataatgatgaaaactattatttttagagccatatcaggcattgtgctagagatgcactttatacagatgtcacatttaatctgtagaacaattctcaaaggtaaacagtatcatccccattttacacttgaaaactgaggttcagagaggccatcaccttacttgcttctgaactggttgtagtgccagggatataaatttaaggtgattcatgttctagtgctttctctgctattagaaccaaggagaaaacatttcttcacattctcatgtctgagaagggtatacacataattctctgttcttaaagtcacctgtgattcataatattcaccagtcacagtcattacttccagaatatctttcctctgttcaggcagcaattctgcatttcttcgagtggtaagatgtcgatccttagctgaagaatatggtttggatacaattaacaaggatgaaattagtaagtataatagccttctgattctgggttaattttaattaatttaaaagatataaatattttgtgtataatagtgttgagtatatggtgatgatattaaagataacgtaaacatattctaattttattctaagcttatctaggtaattataatttatatattatatgaaacttaatgtatgcataaagtcatatttaggtcactgagtccattgtgtgatatgtatgagttaaagtcagtatgttactacttcagtagagattgtgtgactccagttaatagtcctgaaactcaagtatatagtaaattcagcccttcattgtttgttacattgcaaattaaccaaattaaactgaaattttttttcctttcagtttctagcatggacaatccagataatgaaatagtgttgtacttaatgttacgggctgttgatagatttcataaacaacagggtagatatccaggtaagaatagcaattgaattaccagatataataagatcttcaataaaacatttaaattgaaagtgttctcagggtatttataatagtgttgcttgaatttcacattgtaaacagattacaccccaaacgttccccagtgaagaaccaccttttgttttttaagtttaactatttgcaaaatagtgttcgattctaaactattacagggggatgttggttgaatatgtatagaagaaaacttttttctgtcattttccatagtttgttactaagactcacactgagtttaatttagtggaataggaaagccacaagaaatatgctggccaggcatagtacggtggctcacgtctgtaatgccagcactttgggagactgattcaggcagattgcttgagcccaggagttggagaccagcgtgggcaacatggtggaaccccatctctactgaagatacaaaaaattagccagacatggtggtgtgcacttgtagactcagctactcgggaggatcacctgagcctgggaagttggggctacagtgagttgtgattgtgccactaaactccagcctgggtgactgtggtgagactgtctcaaaaaaaaaaaaaagtatgctactaatttctgaactcaataactctgaagatgtaggaatttctttgtttagttatctactttttatcttcagcaaatgtagtcattggagaattggcataatctcaaagatctgaggttgctcagaatatttttctttgggatgataattttaattgtgcaggattattgcatagcaacacattctaggggtatcataaaacctgctgctccatctgatacagtgtgtctccagagtttatagtctttttttttttttcttttgagacggagtctcgctctgtcgcccaggctggagtgcagtggcgtgatctcagctcactgcaacctccgcctcctgggtttaagcagttttcctgcctcagcctcccgagtagctgggactataggcgcccgccacctcgcccagctaatttttgtatttttagtagaaacagggtttctccgtgttggccaggctggtctcgaactcctgacctcaagtgatcctcctgtgttggcctcccaaagtgcagggattacacgcatgagccactgcgctgcccagagtttatagtcctaacaagcaagcttactagaagaaaaaaaaagaataaacaccaaatatgtattgctttatttgtattatttgattagtatttatttcagttatctgttgcataacaaaccacttcaaaacttagtggtttaaaacaataaatagtgtcgtgattttgtgggttgcctggtctcaggcagttctccttggggaggcatgcagttgcttgagcctgggggtggagtcattctgaaggcttgactgactgagttagacatgcaagaagacatttttactcatgtaactagcaccttagtcagaacagtgggaatagctggcggctggtcaggtatctcttcacgtggctagcttggacttccttttggcatgtcagttggcttctgcagttaacattccaaaaaacccaagtggaaggtacagggctttttatgacctagctttggaagtcatacagcatcacttatgagctaagtaacttaatctctctgtgctttagttttctcttctataaatggagataactatacatacttcataggactgttttgaggattcaatcaattaatatagatataaggtccttagaacagtgtccagcatctattaatgctcaataaatgtgacctattattggccaggcatggtggctcacacctgtaatcccagcactttgggaggccaaggcgggtggatcacttgaggccaggagttcgagaccagcctagccaacactgaaactaaaaatagaaaaaattagctgtgtgtggtggcgcactcctgtagtctcagtttcttgggaggctgaggcatgagaatcatttgaacccggcaggcagaggttgcggtgagccgagactgcaccactgcactccagcctaggtaacagcaagactctctctcaaaagaaaaaaaaaaagttacctattattaatagctttatgtcctcagtgtcatttatcatttagtcttttagaattggagaataacttttataaagggtataagtaggacattactttctcattcattaagttcttctatcaaataattattaagcactatgtgccagatgcttttctagacagtgaatatgatgcaattaataaagatttaattaaattcaaatttttactaggttttagttggtctctgattataggtttgtgatatgtgcaaatattggtctcatactttgttatttttgttcttcagtttcatacatattttgactagaacatctgaaactagattaaataaaggagttggccattaattttgaatcacatttattttaatgaaaactaacttttatttttaggagtatctaactatcaagttgaagaagatataggaaagttgaagtcttgtctcactggcttccttcaggaatatggtttatctgtaatggtgaaagatgattatgtccacgaattgtgagtattttttagggtatctaggagatgattccacacctgtcataaggctaatcaaaattcatgtctctgtggtctcctttagttgccgatatggagctgctgagccacataccattgctgcattcttggggggtgagttccatatatgagaagactcacctgttgttacatagtacagttactattttaatacaaagttttgtcgtctagctattttaattagggaggtcagtgaagcaggatgttatatttctttcttttttttttttttgagacgcagtctcactgttttgcccaggttggagtgtattgatgccatcatagctcgctgcaacctcaaactcctgggctcaagtgatctctcgcctccgcctcctgaatagctgggactacaggcatgtgccagtaagcctggctaatttttcaattttttgtagagacagggtcccactatgttgctcaggttaggatatttattcagttgcccctatactggtctccctgccttccatctctcccactgccatccaacttaaactccttaagagtcattaatccttctaaagcatagctctgattgtgtccttttactaaccctctgccccaccaatatacataacactctacaacagtcctccaagcaagtccaaggactttggcttgacgttaaaaaaccctgtgttttggttccactcggcctttccagccttggttttatcatattacttgctttccccccaggatgccctttgatttcctgctcctagatctttgctcctctgtgcctatttgccttaaaaatatgtttttctgcatgtccaaaacctatatgttcttcaagacccaactcaaaaatgacatgtctttcataaaagctccctttacttccctccctcactctacttcccccttgtcttagtcagtttgggctgctgtaacagaatatcatagacttataaacaataaaaatttgtcacagagttctggaggctagaagtctgggatcagggtgccagcatggtcaggtctggtgagcgcccatttcctggttcataggcagctctctcttctgtgttctcacatggtgaaaaaaaaaatggcaagagaagtctctggggtctcttcttagggcactaatcctattcatgaaggttctacgctcttgacctaatcacctaccaaaggccctatcctcatacaattacactgggggttaggatttcaacatatgaatttgagggggaaacgaaccattcagtccataacacccctcaaaaaaaattactgtcctgtgatctcctgtagactgagctattagcttgtggcattttccttctagatgttgaatgttttaaaggcagatttaggtctaattaatatttgaagtgttcaaaatgtaaatgcatcatacagacctaagaaaactattttctaagcaaatccaaattaaagcctgattcagaataatttattttaaactaaaaccaagtagtctcttgtgccaaagtagcaaaattttctgccaattcacagaaaagggcaaattattatttattcagatgcagtccagaatctaagaagaggtacagccagatggatggactggatgacttaactatagcagaaaaaagtataaattgaaggttttctttgtttttttttttttgttttttacttctgtgcattctgtaatcattttgcacagtgccattatatcccttcacttccttcaggttttattcaaatgctgtcttctctgcgatgccatccctgactctcctatttaaaatacaaaccccttctcttgtatttatatctcccttatttgctttttctccttagcacctatggtcagttgacatactacacattctatttatttgtaaataaattctctctctcttgctgctaaaaagtagcatgagggtaagtggatcttcttgtcttttttccttactgtatccctactgcctagaacagtatttggtgcacagtagtctcaaattctatccagtcggctgagcgcggtggctaatgcttgtaaggcctccgctttgggaggctgaggtgggcggatcacttgaggtcaggagttcaaaaccatcctggccaacatggtgaaactccatctctactaaaaatacaaaaaaattatccaggtgtggtggcaggcatctgtaatcccagctacttgggaggctgaggcaagagaatcacttgaacttgggaggaggaggttgcagtgagccgagatcacgccactgcactccagcctgggtgacagagtgagactctagtctaaaaaaaaaaaaaaattctatccagtccatgaatatttgggaaagaggaatcttcaggttatagaagatgcacaagtttttttcttagtagtttttttgttttgagtaaatatagcggtctggcgatatttaatatagatccttcctaaattacaaatgcattcagaacaaatatacctttctccttttttattataaaacagatacaaggtaaaattcaaatgcagcagtagggtgtcctttgagaatcttttatgcctgtgtgtatcctttaaagtttggtcaaccacactactgtttagatttcctttaataacaaaaagaattataggcttttatgttgatatgactcagtaagctaactgcatctgttttgggtcactttaaaacacctttgcttttgaaaaggaaaagtttctttacagaattgagtatgtaactcttgaagtttactctttcaaagatttgcttttctcctttttcctttcaggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaataatgtagtcttgttctttgtggggaggggaaaggagacagtcattttcctagaaaatgaatcctatccatttctcactgagcatcaatattggcttgctatttcaaagttacttgtcatagattatccttgtgttttattagagataattaaaaattttttttcttaccatcttcaataatgaatttaagccatgtgcagatgttagctatggacattttaggaccatcatcatttgttaaaatgaatagaatttaaaaagatatttctggatatgtagttttcccagaaaacaagaccatccccttgtatgtagtattatcttaattaacttgagttttggctgcctaacctacttcttgaaattttatggggtcattctactcatattatatatactcttaaatttaatcacatgggactaatagcattcaccagcatattagagggcaaaaaaaaaaaggaagtagtagatgcaaacagagtggaaatccagaatccagaagtgggggcagttcccggttttgggcttgatgtattaatacttagggctgaggaacgtggtccgtggtgcatgactcttagtagctaaggcccctaatctgctgcaactgtctctgaggccagcgtctcttaagtgagaacctgttagatttgctagggtacctcacagggacttggttttccagacgctaatgtgtcagccattctttggctgttcttcactgtatcggggaccttcccctcgccttcatcgcctagcagtcccatgggctgcattttacggcagaggcggcaagggacaggccttggccccactctgatcctttggtccaggcgcggagaagtcctcctggactgaactccggaagccccctggtgaggtggaggcctggctgcccctgtggggctgtggtgacgattagcgaggtgcccaacaaaagggagaacacacagcacagatgccaggtggaggggaggttggggcttcgccgtcctgtgcttcgcggccaccgtcccatagccaggcctcgtcaaccgcgtgcacagtcccctaattttggggctaatgctcgtctgaggtaaaaaccctaaaaaccgggggcggtgagatttctctttcaaattgtagctttttaaaaaatcttgcggccgggacaccgaccaccccattgcccttggcaacctagggcacccgcggaagcgtaagacaccttgcaggggcggcggggctgccggccggaagtcccgcccacggacgtgagcctggtcggctgggcgggaaaccctgtcgtgcgtcgtggcaggtgagcggtgatgaagaaagggcggaagctcccgcttgagggtagacgccacggcctccgctcccgcgcgttgttgtcctgccttaccgcgcttggaaactctgtatgttggcgcctgtgtaaggcgggttgggccggccaggatgtcttaccgccccgtcaggcccttagcccacgtgagaagggtcgagttggggggacggggcctttatgagcaggtgccaggccccggctgtagtccccacagcccttggcgggaagagacagtcatcacgtgatgcaccatttagagacgtgtaaagcctggcagtattcccccctatttcacttctgactccccaggcgcctccccaggtgactttgatgtgtggagagggtgggacccaccggtgaggtcgtttcccagggccagggccgggccgcatgtcacacagcacctgagcggggagggcctgctgagggtgctgatggctcacgagtggcccgcgcggctaaccagtgtcctgctcccacgcaggacttgcgagccctggtcagagaggagcctggaggggccacctaagctctgcacaaggaattcatccaactctgtaggtgagcgggccgcaggctgaatgggcaggaagccgggcggggtgagcgcccccgccttggaaaggttacgtgtctgttacctgtggaacctgggaggaggccctgagg

SEQ ID NO: 14723 - DNA, 8534 bp, Human
tctgagtactgttcaatgtgttaatggaaatgtatacttcagagcaatcttatctcagccttttggtaaaatgtgtctcaatctgggttgaactgaaatttctcatctccaagtctagaaataatgcaaagggtaagaagtttgctcttcttagcagcgtcccattataacatggttaaaaactagtaaatgatcaggttgaagtcattttgttgtcgtttaatgactgatcttggaaacacccactttcacaaggatcttcaaggtcacagatagtttgcctgaaattgaccaggcttcaaaggtgcttctgtgttcttccttccttccactcctccacgcaagaaaaatgtagacaattatccaaggtcaaaatagcaaactggggccaggcgtggtggctcacgcctgtaatcccagcactttgggaggccaaggcgggtggatcccgaggtcaggagttcgagaccagcctggccaagatggtgaaatcccgtctctactaaaaatacaaaaattagctggacacggtggcgggtgcctgtaaacctaggtacttgggaggctgaggcaggagaatcgcctgaagccaggaggttgtggttgcagtgagccaagaccacaccactgtattctctagcctgggtgacagagcaagactccgtctcaaaaaaaaaaaaaagacaaaaagcaaactgggcaggcagccagaccatgcacatggagctgtaccaaagtgttccccagcctaacttgaccaataaattccataaatgtctctaagcgttttctcatactcaaggtaagacttcaaaatgtggggcaggtcaaacttcacatgctcagaaaatgaaactttgtcttctataacaaatagtcatagattaaaaaaaacttgccaattcaagggagcaatttcatcagatgtaaaaagtctgttaaataaatgttcagtcaatttaagtgcagattcattatcagggtacttctctcttaagccacttccctttctctctgctccctgcccctctcctcccatgaaaccctagcctacaatgggtaggatttccgaattaggtatctttttctgtttgttctgcttcctactgccctttaagcgtttccttgaaatcagcatttcaaactttggggctgagcagctgaaaagtgtttcaaatgatcacattgtgccatctggtggaaatacagccttttccaggcagaggcaagtaagagaattcctctggctcttatatttttggttctctttctatatttggcttaaccacaaggaaagtctgataaattttacaaaaccaaaagccagctgaggccaacctccctcctttcggttctatcagtttagtattttttccaaaagaaatctttccatttgccctgtaatgtttttaaataataataaagaaaagaccaaacttatattctgtcttatgaacatgtggaaaatgcatgtgttgtccttaaatctatctttttttcttaaataaattggtgttttaactaaaaaacaagcctgccacagctggttgagaggccaagccaggaggacctcttgagccgggagttcgattttgcagtgtgccacgatcacaactgtgaagagccactgcactctagcctgggcaacataacgaaaataattttgtatagtaattcataaatggcattttcttctgaaatagtatgccagagtacttaactatgccatcggaaactgctgcatgggattaggactgcctaatgtttttatcggcttttagaggatactaatctcataggctttcattgatacaaagtttatatcttacttcacattatttctagatttatcaatgaataatgcacaatatgttaccatttgagaatgacttgaagacttacatatcttactagttatatttcccatgctaagttgagggattgctggagtggctatttttaatactttttttttttttttttgtgcttcttttcctcatctcagattagaatcccccactcggagtctaagcatggatgccccaaggggtgtgcatattcaagctcacgctgggaaaattgaggcgctttctcaaatggatattctttttcatagtagtgatggaatggtgagttcattcacagatcagcctcctactgtatgtcctgatgatattcctgagtaccatgtctgtaaagctatcagtattaaatttctagtagtttgtaggaaaacattgtgaaggtcatagagtagcaaatgtacaaggaaagcaaaagacaatttagcattgaaagaagggccaagaaagtctaaaattattctgtattagatccagacagctttctttaactggcatttatgctatcaagtgatttagtgacttgttattttcaagtcggaaaaaaaaaacactacagacgttcacagtttacagagaatgtccattttgccatttcctagggatggctgtcactaggagtcacccactaacaaccactgtcacctttcactgcccagagtgctgcgtttaagctgcatttccagtttaaatgaaaatgaaagatgaaaaataagagtgtttttttcaaagtcaactacaataaagataaaatctgggacttcaagtctagaaatacagttgtccccctttattgacaggggatttgttccaagacccctactggaagcctaaaaccacagagagtacagaaccctgtatacactatctgttttcctgtgcatacacacctctgctaaagtttaacttataaataaggctcagtgagagattaagaacaataactcacaataaaatgaagtgattatgacaatatgctagcatcaatgctcttgtgctttggagccattattaattaaaattaacggtgacttgaacacaagtaccacaataacttaacagtggatctcaccgtggagacggctcctcagtgactcacgggctgggagcgtagacagctggagatgctggacacagggatgattcatgtcctgggctggacggctcaagattccatcacgctagtcagaaaggggtgccatttaaaatgtataaattatttctggaattttccatttaatattatccagaccaaagttgacagcagataactaaaatcaaaactaaaaccaaagaaagtgaaacagcaggcagcaggggaggagctgctaaaacctcactgacacaagccaaagtcacaatgaggcttacagcacacagtgctcaatactgatattggaaccctgtttgttagaaaaaaaaaaaggaaaaagctcaatttcggtcaaccagaaaatcagacatgttagggatgttcctaaatggtctagaagaaaaccaaggatttggtttataagctcattccaattgtatgatgccatatttatagatttgtgcaaacaactgatctcatcttcttggcctaaccccagatattttcatatgtatgaatgtgctcaaaataagccactgctgcaagaattgtcttgtacatagctctgtcttaccaagagtgagtgcagtgagtgacgtgggttgtgttcactcatgccaccattgcctgacagaccctgtggaatccaatagggatggcaccacgtccaaaaggctgaagaagagacccagagccatggaacaggacatagggtttattgaggacttaacagacagggcggtccagtagcagcgagctggactggaaaactgctcccatttttaaaaagcatgcaggttatacagcattttcacttagcaacaacttccatttaacccaaaacaaagggcctcgatcccccatatggcctgtgttgcaagggatgggccaggcgctccgatgtccttcacagatgtggactgaatctcagggttggccactcccagactccttagctcagaaggctgaacacacattcttcttggatcatagagtcattctcagggattgcctgagttattgcagtcaggtgcatctccatacaccgggtgaatgtgctgggataaacatccatggacgctgttagtacaacaagaaggcacatgggtttccaagctcctccccagcccaggccctatcatcgcacctgcggcgatgcacagaccgccccccacccacccacctcccccccgccccccgccaacaggtgtaacgtggtgccgcgggcagaggattcacctggaagtcaggaagcctgagtcctagtgctagatcaaattccctcattacctgtttgaattcaggactcttatccggccctctctaggcctgtctcagcaaatagggaatataatatttgcttaattatgtcatagggttttgagacactactgtaggaatatgggtgccaacattttgaaactacattactgtgatattaataggaacgtgtagtaaaggtgtaggtggatatggtgccatcatcaagccagctgcgagaacagcaccagagtgtgtgggcaggacccatcagatgacagcctgctagtggaacacaggtcttcaggggaagccactgcaggtcataacctatgaagttgtgatgtcaggagcagagaaatgcagaaataaaaatcaagaatgaggcgttagataataacctaaagattctacttgaaaaacatattaacagctatttgacttctttgaccgtgactgcaccagaccatgcacggcacagagctgcctgcaatgctgtggggtcgtgtgatcaagcctcacctggcaggtgcacaccggcgaatgcgtgcagcagacagcaggttgttaatagattggaaggcaaggataagagccacataacataaaggaaggagctctccttggcaaggacagaattatgcctacccacattcagtttaattccttgtaacaagtgagtgccctggagtgggcaacgtttggctgctggatgtgacgatttttatttccttatcaaaaagatttccaagcctcaatctacggctctttgtttgcacttcagtttaactaaattatcatatgaccagaatatccagtagttttcatttcattttaattggcttagtctgcgtgtctactgcttttcagcatctaataggaggctgtgcagtttcaaataatatttaaaaattagggaaatggttgccagctaataggatgaatttaattgcctctcataggaaaacaaaatcaggaataaaatcaggataaacttcatcattcatgggtaaaaattattaagatgaatctattctaatggattgtactttatcctaatggggaggagaggatttacataaagtcaaagtgagtcacaagataaatgtgaatcgggagaattctaatatgtttgacaaataattctgaaaggcgttttgagaagcatagcatcacaaaactgaaaagcaacccagtttattgaaacaaaaacaaactgtaaaggtgaaacatgttttcacaatggggccacatttctcagctgcactcaaacaatgacaaaccggaaaagcgcctccctccaatgtggaaggaattgtgaagtcccagcctgcatgtaaaatagaactgggctttaaaagaatcggataattacgaaatgagttacataaagtcaggtgcctattttgttttctatgaggagaagaaactaattggaaatcttgtgagaatggggatttgctgttgaccagggtggcccttccttaactcttcgtctctcatcttctcccaaccagcttgtgcttgatgctgaaactgtgtgcttacccaagctggtgcaggggacgtggggtccctctggcagctcacagagcctctacgaaatctgtgtgtgtccagatgggaagctgtacctgtctgtggccggtgtgagcaccacgtgccaggagcacagccacatctgcctctgagctgcctgcgtcctctcggtgagctgtgcagtgccggccccagatcctcacacccagggagcagctgcacatcgtgaaagactgaggcagcgtggatgggaagtaaacgcttccagaggaactcagaaaaaattatgtgccagtgaaagtgtttggacaaaaactacatgatctcaaaatgcacgtggatgtgagacacaaaagttgacaaaatggaaaagcaatgtgtttttccactggattaattttcaccggaacaattgcgaattctctctgcctcgcctccccctatctcgtccgtgtgggcacacactgagtgttgagttgccgtgtggagttaatgtatgacgctccactgtggatatctaatgccctgttgagagtagccttgctcagtactaaaatgccccaaagttctatacagcatttcctttatagcattcaaacctcacatcctcccttcagtttaatgcaagtaagtcaggtttcacaagaaaattttcaagttttgaagggaatttgaggttgatctggttttcaagatgtagttaaaggaataaatcactcaaaattaaactttctgtatatagtcaataagcaataaaaacctcatttttcagagttcacagtttaagagtgtcttttttaatcctcacaaatctttgaggtagctattatttttccccaagttactggtgacaaaggctcaggtagaacaagtcacaaggtcacatggtaactactgaaattaaaccaaaatgtaaccctaaatttacatagctcttttcactttgaaaaagtttcatgtgctgtctccaaaacacccgtctatgtgataattgtacagcacttatttgacaaacaaagaaactgaagcccaaagaggttttgtctctaccaagatcaaagggctagtctgtggtacttgcctccacatgatagacacaagtctggacgtaacttcatagaaacaagacactcagagcttgtgaacatgtttagtgccaattggctgtgtaaggtgctatagaaatcaaataggacacactgaacctctgaagacaggttcgttttgtgtaggccacccactcactttgtaaaatgccctctatcacaaaaagtggtgcatttgtttttgttttacttattataagaagaatcttcaaataggtgtagggagaccaacagcactgcaactttctaatgatatgacatattaataactatcaatataagttcaaattcattttccatagtctcagaatcaagagaaagtacaaaagtgaactctattcctaatgcttagtaagatgttcatttaacagcatagcctgctcataacaactccctgatgtttaaatggccagaatgcataaacacttgaaattgcaaaataaaaatacagtgctttccaagcagttaagagcaaactcaactcagtgtaattcacatttcacaggcagttgggtgcttttacttataaattgatatttacctttttccatttggttgagtcctgagtaaactgctttcttactgtgacattcctattgtcatagtaaatggttcccggtattttgttccctgtttgtgcgaaatatgtcttcaagcccagctgataaaacacgggatcactagatcactaaacatttataaactagcttggttctcatattatgtgtccaaaaatttgtgtgtagatgataaagtgaggtaaataaaaatagtcaagtagaaagtgtggagaacagaaccttttgaataaaaggtttaaattctatttttttatccttagctatatggaataatgttgaaagaagttgttacagataaatgcattctccacaataaggaatttatccttcattagaatcaaagcttttagatgagctgtattctaaaatgcattacatatatctgtcttattaaacatataaattttcattgaaggcatacagtcatggttataaacgtacatcacagggtatatagactgatactcctatagactattgagtgttgctacattagggatctaaaaatagcactcatttatttcccagtttatgaactgacaagtagatacagtcaaaaagatgaagatcaaaatctactactattatgctttaataataaagatagtggtccaggtgcggtggctcacgcctgtaatcccagcactttggcaggccgaggcaggcagatcacgagctcagcagatcgagaccatcctggctaacacggtgaaaccccatctctattaaaaatacaaaaaattagctgggcgtggtggcgggtgcctgtagtcccagctactcaggaggctgaggcaggagatttgcttgaacccgggaggtggaggttgcaatgagctgagattgtgccactgcactccagcctgggcaacagagtgagactccatctcaaaaaaataaataaataaaataaaaaataatgataaagatagctggtttgcagcaaaatggacttcctaataacttcacagctgaataaaacacaaaccactctggtcacaggcagaactaaaggctcccaacttctataactgctacatgaggaggatggacagatgccttctctgaaagcagtcaaattcacattagaaga

SEQ ID NO: 14724 - DNA, 250352 bp, Human
  misc_feature (1)...(250352): n = A,T,C or G
aatcatgttaaatatttatattttagtatgaaagaccctcaatagttatgttaaaaaaaataactattacccaggtaatatttctgtccagaaatttgagaaacagaattatttgtaattatctacacatttaagaaaattgaactccttatgaaatataactttaggaattactggagattcatttgaggtctggttggttatcatgaccttaggaatttacttaacctctctaaatcccggtttgcttctctgaaaaatgataaaaatgttttcctcacagggtatatgtgagaattacggagctcatgtatataaatagtttttcatagttcctggtattaaaaactcaatatattttaaaaatgatgctgatggtaatgatatgctatttgtcaagtaatcacatgtatttttacccagaattaaaaaaaaaaaacaacttttcccctatcccttaggttacatatgttgctatgttcactgttttccttttatagttaaaataagctgtaacgcatcgtttcccatttttttttttgccagctacatttcttatctctattgataataactataccacctatgtctctgctttttcatgcttgagggatctctggatcaatcaacgtgcatgatggcctgaaaaagcccaatttatgggcaataaagtgaatcatcttattatcaggaacgaatatatgtttcctttattgactgctgactatgtagagcataccaacaaaattgccattcatctatccattcaacaatatttattagctattccgcactgggcaatgctctaggcttggggatagaacagtgaacaaacaaaatccttagcctaatggatattacctggaagtgtgccaggaagaataaactcacttgtgaattacaacaataagtggtttattcaggtcaaaatcttgttttgtctcctgggaatttcactgaattgcatcatgtaggaggcaaactataccccaagaattaagagcaattgtgaataaatgataaaccacagagtttacatttacctcctaatacatttaactcctaatatatatatatacatatattacgaggtaaatgtaagctgtaactttatgcatatattgtaagtagtaactatacatatatacttatatactgtatacatatatagtaagtagtaactatacatatatacatatatagttactacttaaatttatatatgtgtatgtatatatatatgtatatatacagtacacacacatactgttactaccgggtgtaaaattgaataggatatagtgtcttccctcacagagctgccaattatgttggaggatgtaataaatacaaagtctgtttcttcatcttcggtttaacaaatgactgatgtgaggaaaaaagttgtaggaatatgttcacatagtcacccaaatggagcatcctactctgtcaccatttcaggattaagactagacagtcttttgtgttacaaattgggacatcagtgctctgggaaacagtgatgtccacgattctaaatcccttggtattactatttcattgattaaactacacttctgatattttagactaaaatgttttggcttatcgcagtctaggaaacctgtcttgggtatataaaacagatagttgatgcacgattagggaaaaataaggcaacctatgaaaatggccttatggattaaaagaagtgagctcctatatggtcagtggaatccaggaaaaatttaatggaaaaagcgccacctaagcttagctttaaaacacagagtatcttcaggtagaaaaggctataggagaatgtgcccaaatggagtttggctggagacaaagaataaagactagaaagaacaattaccctaggccagacatggtgttggacggggcaagatgtttactacttaaagccatagaacactgtttgctggacacaatgagtggaatatagaacaatgcaactattttaacactttacccctcttagtggtttattagttaattttttcctgaaaaaaaaaatgcgtatactactttttctgcacttttctatatcagatcttgatttaaaactttaccactcttggtgatttattattagtttttttaatccgaagaaaacatgtgtatactcctttttctgcatttttctatatcagatcttgattggctcaccaccattacacacacacacatctcttttctcccatcctcccagcgttatagaatcatttgttgtaaaatcagtattcagtatttacataattatgactgactttacatgactactattattcacagttgaggtataccgtgtatacagtgtagtttttaaatttttatttttctcagcgttcaaaattatatgttctgttttcttaattttgaaaaatatgcattcactaatttatccccacactctttggaaaatgaaagctctctaggctgtattcaaatacaccaggtactctatcaattttcattttttaaactattctacctgagctctccatctttagccatttcctgttgacttcatactgttctccccttccactctccctctttaatatattaccgttttagaaactttatggctaccctgtaagtaataaaaatgtctttccccactcaacaacagacagtacctttcaagtttccactttataaggacataacccccattccatttacttcccccgccctccttcaacattcccacttgtattttccggctgtatttttaaaacatggtaaataacatttgcactccactttgtaaccataattaagtatgcccttaaacaataaaaaccataaacaacatttgtattttacgattatttaaatgttattcactgaacagccaagctttgtgctactatgggatttcgttttctgcggttccaagtcttgatccacgtcctgccacaggatcactgaagtagagcccattttcttacactctcgccattagttcaaaagcttgcagcattttatgtctggtacttggaggatgattttcctgtacagttttgcgtttttttcaccgaaaatttctgattattattgttttctcttgtgggatgaaatatgtaccttctatatcacagccttaataccttcagcttcttattcattcaaatcttgcttacaatccagtccgaggattcccggtttactgattttctttttcctgcaaattttagccttctgttttgttttgaaataatgcatcctctgcgctttgtcacattctgaaattcgtcaggtgttttaggatgcacactttcttagatcttttcgagggtcttaactgcagttctgtttccggaatggcgtattttctttctaggaattgtaggctcccggccgccccctgaggagctccgctagcagctaagagggcagccacgaagagcgcctgagcactctcgcgagactgtggggctcgccattggctgctccgccgcgccgcaacggaccctgggagtcggccatcatgctggccccggaggccgttatcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggtgggtgtcgcggcggggcttgaggctctgacggccaaggaggacggagccgccgcgggggccatgagccaggtgtcgccggccgcccagcgtctgtagcgagggttgccgcagggcccgcggacctcctagcgacggctgggaccggcaggacggtaagcaaagcggctcccgggctcacacccaagcttgccgctgccgccgctcggtgcagtgcggcgcgtagccccgggcgccgctggcgctccgccccttcctgtctgcttctcactgtggcatttaccatttagagctcaactgatggtaggtggctctggaataggatgtgttatatagcatgtacgaacatccatgcagatagttccactttaaaatgaaaaaatctaagcgagatgtaacttgccgtagggcacaaaatttgtaagggccaaagctagattaaaactttagtttgtctgctgtgttatgtgggatgttaggaatcttacccttttgatttcataatattaatattagggcaagatgattcctacgccaataaaagcacaaggtctctgtattcataatataccatagacataaaaaggatcacaatcttagtctttggatttttctatttattaggaatatttaaattgcaagtgacaggaatgataaacattcaagcaaaaaactagtggacacacacgcgtatatacataaggacatacatacaaaattatattcccagccatgtaaacccttaaaaagttcagattagctgtggaagcttcagccatttctgcatggagatgcatctgtgaaacctgtggctaggctccaagagctggaatactactctgtacttccaaactctttttttgttgttgtttttgagacgggagtctcgctctgtcgcccaggctggagtgcagtggcgcgatctcggctcactgcaagctccgcctcccgggttcacgccattctcctgcctcagcctcccgagtagctgggactacaggcgcccgccaccatgcccggctaattttttgtattttttggtagagatggggtttcaccgtgttagccaggatggtctcgatctcctgacctcgtgatctgcccgcgtcagcctcccaaagtgctgggattacaggcgtgagccacagcgcccggcctgtacttccaaactcttaataccattagagtaacagcacagtgaatctctaatagccacaatacttttgttatttaaatgatgcacatttcattaccttcacttatctcccattttaactagaaagcactgtattttttaatcgcacacaccgtcttcattcatggattattcaaatgtgtgatttctgatcatgaccttaaggttacagtcttgttctgaaaagcattgttgagataccacacatcgcaccgtgcactgcatgtctagcagctattcagagcacaagtacggtaccctagagtacctctgtttctatatagtctactgattatatgactggtagaaataacgtgccactgagaaatttgtaaaaattaattttgtgctcccagctagtattcttttgctactttgctgctccagtaccactccagcgaggtagcacttagaggaattacttatgacaacttctaaaatactggtatagagactgaagagcgatgtaaaataaatgatcaattctgagaactgggagaagatatatagtttcagttcacacatataatttactccctttgaaaactgaaagactaatacacagagccattcagagtcacaggagtcattacgttcctggatttttcatttccaaatatgtaaagctatgtggactcattctgtcttctattcctcttttgtgccaccctttacgccctacttgctccgtttctgggtaactccatgaaaaccttatcttccaccctgagaccgtggggaaaatagcagccacccactgataacatggccagattgagggcctattccaatgggacgggaataggcaaagaacagtcacaaagctccaaatcctactccttaatgctctagagctgaagaaagatttccttctttccacctgagagtgggataggagcaataatttaggtggttgtagattttatctgccccttgatgtttagatttgaatgcctaatccacactgcttttgctgcgggtgatattaggagaattcatgattagagtattcatgattggaaatggcttgattgtacaaattagaaaattcatgattggaaatggcttgattttacagattaactgcattgactggcttgggcattggaagcttcctttaactgacttttcatcaggttagccagctccagaatttaacagctgtgtttaatactgcttaatatttttatacttatgttcacaccacaccattaacttgtgctaatgccaaactagaaaaaaagtacgtttccttttggacactgatcagtactcaaccctttggtttgctatctgcctgataatttttggaggtgggggtggttcacaatagctaatttttctcagccatttttcctttggataaagtgtagaattaattatgtgaatattatgattctgatggagtccttggtttattaacattcaattgggaaataaatgattttggagtcgtaatctttcttattttctttttatcatgtactgtttttcagcttttatagcagatttgattcactttatggtaaacagcctgctgggcatggtgcttttgcagatagtaggagccttctgcctttctgatcactctgattctgattcttgggaagagcaagctgagtcagacctcactgataatgctgtggaagattagattcttgatatgatgggaaaccttggctccttgaaagccttgacgaaaacttttttgtattaggaaaaaataaaatcaagtagaagcccacataaaaactctttaatttttcttttctctttctttctttcttttttcttttcttttcttttcctttctttctttcttttctttcttttctttcttttctttcctttctttcttttcttttcctttctttctttctttctttctttctttctttctttctttctttctttcttttctttcgttttttgccatggctttaatatgtacatatagtttgacgtcattgtaattcttaccagaacatactcagagctaaatatatactcttatttccatatttcaagaaacttttctttttctcccctcaaacctctcttttagacaatgaaacacacttaataattgtcagattattaagatctattgtattcttcattacaaggccagatttcataggtgcataaaaaatcacctatacatgaatctattttttaattgagacatttgtaaaccatgcatgtggaagaatatgatatagcatgcatttatgcatgcattttgaaaaccagcttgagaattttacttccttttagttagcagtagaccaaaagagaatgttgcttctgctctaacaaagagagtaaactaggtaggctacaaagtcataatttattttgagcttgttagaactgaagttacaaggtgagcaggtaaactgaattttagcactttgggaggccgaggtgggtggatcccgaggtcaggagatctgggccatcctggctaacatggtgaaaccccgtctctctactaaaaatacaaaaaattagctgggtgtggtggcaggcgcctgtagtcccacctactcgggaggctgaggcaggagaatggtgtgaacccaggaggcggagcttgcagtgagccgagatggggccactgcactccagcctgggtgacagagcgagactccatatcaaaaaaaaaaaaaaaaattacaagcctttccaaataggagacatgaatttatttcatctgtggcagaactccagaagagttctctggcatttcagtaggtaacaagaaaatggctgaaattttaacaaattcttacaaaggttgagtgtagtttaatgtgacagtttagaatacctgggagccccagacacaggagtggtctgtaattgccagcttttccccttgggcttctaccgaatgcttactggaaaggttgaggacagacaggaaacctaggaaagttcctttatggtacacggtataggaggcagaataatggctttcccaaagatgtctatgacttaatctttggaactagttaatatgttacattatatggcatggagattttgcaaatgtgattattggtatgcaccttgagatgggagattatcccatattatttaggtgggttcagtctaatcatatgagcccttaaaaacagattatttcttaactagggttagagagatgcaacacttctgactttgaagatgaaggaggccccaaaccaaggtctgcaggtagtttctagaagctgggaatggcaaggaaatggattccttcctagagcctccagaaagcaatgcagccttgctgacaccttgattttagcttagtaagacaaataccagacttctgatctgtagaactgttaagataattttgtagtatttaagccactaaatttatgataatttgttttagcagcagtgcaaatctaaaacaaatgggaacaaaatcttcttaagttttaaagtggagtaatagaaactggagaagcccatttacactggaccctgcatgagtaaaaggtggttgttggccagtgctaggggacaggcaagaaaactacacatgttctggatctttattatgcaaaatctgcctgctgctgagtgaggggcagggaatacactgtaacctggaccctactctgatattgggcaatagctgattggcacaaggagtggggtaagaaacctgcctgcactcctaggtctgtattaatacatattagaagtctgttgtcacaggggaagtccaggaaactcacttgctctgggctgcatgctggctaaacagaaaggatctgccagtgaaggaaggcagaaaacccaccaatcctggactctgcatgaacaccaggaaaaacccatttgctgcaggaagggggcagttaacctgatgatatcaagaccctccactgatacaagacattgattgactgacactcaaggaggggcaggaagattgcctgacttggactcccatgctgacactgggtgaaagccatctgttgctactggaggagggggagaaaaccggctttcagccaggatccttcactgattttaggcagtttttcttgttgtgggagtggtaggagcattaaaaaagtcccacgtctgaggcaaaggtacgtagacaggggcagttgctagagaagaacaaagagctcccattgccccaccatgaacttttctctgattaacaagcaatgccactatactgggagagggacacaagtgtagaaagagccttctctatagtgcatgtgtggactcttgaagctgagcacaaacactgagaatccctttggcactccagtcttccccaaaacacaagttactggcattccaccactggagccatttgaatctaaatacagataaactacagattggattgatacaatttcacacacttagtagtctgacagaataagaaggcagcccatttttgaggggtaatatttatctcaggatttatctcaggatttactgtaaatatgtatacacacatacaaaaacccaggcattgttaagagaaaataatggcccagaggttgaaattatcagacagaacctttaaaaataattatgattaatgtgttaaaattctagtggaaaagataaataacatgctcaggaaattttagcagagagatagaaactatataagaagctcaaatgaaaatgctagaaatgaaaagcagtattggaggtgaaagattcctttggcaatttatcaacagactggagatggcagaggcagaatcagtaatattgaaggcagattactatatattattcaaacagaaaaatgaaagagagggagaaaaggagagaagagatggaggaaaaaattgggaagactggcaatactaatttgtgaggatagggggcaactagaatcctcatacattactggtggagatgcaaagtggcaaagcctctttggttgagtttgatagtttcttatgaagtaaaaaataccatgaaacccagcaattcttaagagaaatgagaacatacccgtaaaattgaatactactcagcaacaaaaaagaataaatcacttttacatgcaacaacagatgactctaaacattctaccaagtgaaagaaaggttcaaacatgataccattttctcttctacaaagagaaaaatatagtgacagaaaacagatcagtgatagccaaaggcctgaggtagaatgcactgcaaaggggtctaggaatgtcaaggatgtttttgggggtgatggaaatgttctatatcttgattgtggtagttaatctgtataatttgccaaaagtaaactgtataattaaaatggtttttcatataatttataaaaattatatttcagtaaagctgatttacaaaaagaagcattttttttttgagaagcctcagaccacattaggtagaaaacaagacattttagatgttctgagttagaagaagtttaatcagggagttagacactatacaaacattagaaggctttgggggaagtgagactaattctggagggttactttcaggaatccagaattgtaggggttgtacatgaaggcaataacatttgtgtcagctacttgcatcctctatgcaggctactgtattagtcagggatctccaaataaacagatccaacagaatcataattatgagccaattttcataataaacatgtgtaaaaagggattcattatagggattggctcaattgattatggaggctgagaagtcccatgatacaaccagtggtgtagtcttgaggccaaaggcctgagaatcaggggctctgatgtccaagggcaggaggagatggatgtctccactcaagaagagagtatatttgcccttcctccagctttttgttctattagggccctcatcagattggttgatgcctacctacattggtgagggcagatctttactcggtctacagattccaatgctcatctcttctagaaacacctttacagaggcacccagaaataatgttttaccagttatacgggtattctttaacccagtcaagttgatatgtaaaattaaccatcacagctactgatgatatcaggtgcctctggcctcaaagtgggtgattcctaggagtatatttgtagctatccaacccttatgcttgtagtctgtagatacctaagtgccagtctagattgctgcccaagaaataatagctttacctcaaagtgtctttttttaagggggaatttaattgaccatggggtctgggaaatgttattccagcttcttttttatgtccctgtggcaaaggtgagagcttagaaacttggggatggtatatggtagagtaaaaaatctgatacacacattgtatctagatgcttagctttgaatctgcttctgcagactttgtaatgattctctgatacactttaataaatgtcttttgtgcttaaactaccagaatagattttaaaaataagttcatgttgatatttccaattcagattttatattcttacttctttttttctcatgctgaaaatcttggtccgtaaccacacaacattcacataattaattgtgtgcatcagcgcatataatagtttcaaactaacagtactcagattagattattctaacagcttaattattaaaacactttcagatttatcttagcatatatccttctggagataaaaaaactatgttgtaggatcatttgaaacaattcctcttttagttaaatcatccatcagacaggttcatttgtttttatttttatttttcaggattaatattcctttattttaatttttagtgattatttaataaatgttcatggtaccaggggtaaaacttcaaaacaaaatgtattcagagaagcctagcttctttcctgtcatatgctctgtgtttcctttcctataggtaaccaattttttttccttttttaattgcttttaaaaatttaagatatggaaggggccatgctaatattctctgtaattgttccaactttagtatatgtgctgctgaagtgaacactatacgtaaccattttttaaagtcagcttttgacaataccattcttaaacaatatagaacatactacacacattgttctgcatttttccttttaaaataatttaataattaggtatcacttcatagtactatatagcaatctttctcatttctttttacagctgaatagtgttccatgtatcccttctctctgcaattattgattgactcaggctaaagaagtcttcgcaaatattaacacatttttccatggttgcccagggggtattcttcattacaagtgtgcatgtgtatttatgtgtgtgtttggggtgaggctgtatttgttggggacatagagttttcacacatcacttctcaagctccagtggcaagaactcagacactgggtcacacccaactgcatgggatcctgggaaatgtagtctcatgtgtgctcaggaagaggagaacaaggattttggtcagcaacacagtacctgccacagacttcatgcctatttttaaatcaccatatgtacccttcttcccacatatagaacacacttatgctcctttcctggggatgcattaaagtcttatgttatatcagcttaaagttcagggcttctgagtgatagacagttctgtttaccacttccaaatgtagtccctcgtggtctgggaataaatgaaaacaaaaaacacaagatatatatatcttcacttcaaagtataaagtggatgattaggggcaggctgactggcaacaataaactcctcccatttagaaagaaaacaggaggaatacaatggtagattggccatagcagtgacaaaccttccttgataggctatgtggagtcgcctgccctggatttacagggaagttcctgattagtccctgtgtctggactctgggagaaactcccttatccatcattttctgaggatcctggctttaccctctggatgttcttcattattatcctccttggctgcatctgaaaaggatgatgagaagggtaccttcctggagaaggtacgtatttcaagtcttttcaataatgcaagtttggaagccagagagtcattttaatatcacatatttaattaaatcactcataatttatttgacaaatgcaatatcctcagcaacatataaagtttttaatctacttgcttctggtcagttccatcttaccctacaaaaatttccaaaatggttgtccttacacaaatgtttcatgtctgtataaataagaaaatagataaacatttttcccttacttatcccaggcctctttctttcactttggtggcagttatcttgaaggcattcgaaacaatggtctctatgtttaattgaaaagtcttaatgggcctcttaatttttttttcagtctcacttattgctgtttgataccccaaacctgtgagattttatacccctctgaaaccttagatttctgaactctctcttgctcttaattcttatttgcaaaccagtcaattcttttcctttctcatcttctcataatatcttgctaaaatattttggagaacaaccctggcacaccgttttgactttcatcaaccacttcccctagggccagagactcattaaacatggccttcttctaagttattgcatataatgtttttaaaaagtttgcttatacaccacatgtgccatcgtgttgccagtctccaagatctgttccttcactatccaaatcctctaaacaaattctcccactttcagttccaatttctgtgttagactgggtagacaaactgcatcacaaatagctccaaaatgtaaaacgtttcgaacaatatgatttaattttgttcttttaatggtactgatatgtctgagtaaccttccctatgtagttattcactaaaataggctgatcacttggtgacctttaacacagcttccaagattgccttggggtcaccttattccaggcagccaggagcagaaaaggtgcatggaggaggatgcatggcaaatttttatgggacgggcctggaaatagtgcacataatttccactcacattacattgttcagcttttagtcacattgcatctgtaagagaggcttggaaatatagtctatatgcttagaaaaaagagtagaacatgaaatttaggacatggaagttggagagtgcattttgcttaaaatagccatacaaatgtgaaacaaaaaagttcctgcctatagatgcatggtatagcttgtttatgtcacttttgtagtttgaaagtgcccttaaacctgtcttgaatattagttcttttcttctttttcataaattctaaagaattccagggccaggcgtggtggctcacacctgtaatcccagcacttttggaggctgaggcaggaggatcacgaggtcaggagtttgagaccagcctgcctggccaatatggtgaaaccccgtctctactgaaaatacaaaaatcagctgggcgtggtggtgctcgcctatagtcccagctactcgggaggctgaggcagaaggatcgcttgaacctgggaggcggaggttgcagtgagctgagattgtgccactgcagtacagcctgtgtgatggagtctcactctgtctcaaacaaacaaacaaacaaacaaacaaaaattccagttcaaactgaatgtccctaacctcagagaactatagtcaattcttcactgaagcatttgtatcttcctcgtctttaattctggtatattttgtttattctgtttagctcctgtaacattgcatacaaattatttatattaatagttttaggacttgggtgaaattcttgaactatgaataattttaggaacttatttctataaatcatattgcatcaacaaaaatgcttggtatgtagaaggatgttactgaatgagagacaaataattactgaaataaatgttatttctaacaatttctattcaaaatttaagatatttgtattcaagtggtatggctcaggggagatgaaaatgcaaattagtgaaaaatgatctctcatttttgcatgtttacatactcgacttcgcttctttagtcattaccatgaatggaaaattgtggctgatgctgaagataaatagacatcattagtgtttgttctagaaattatatagtagctgactgaaagtggtaagaaaggtattcatgaagctttgtatctcttaacaatttggtttagtaccggagttacaatataaatagaacaaactatttttttcatgaagatctctgaacatatatctgaatttggctatgccttctgaaattgtgatgaaaacatagatagaaagcatcataaatgcatgcccatctgcaactgtttgactataaagctgtcagtgaagtagaatatcggaaatattttcatagaaatgttcgttggaattaatattttctttctggtggtggcaacaagaggacttgtcttaggaatgctgggaaacgggctcattggactggtaaactgcattgagtgggccaagagttggaaggtctcatcagctgatttcatcctcaccagcttggctatagtcagaatcattcgactgtatttaatactatttgattcatttataatggtattgtcccctcatctatataccatccgtaaactagtaaaactgtttactattctttgggcattaattaatcagttaagtatctagtttgccacctgcctaagcattttctacttgcttaagatagccaatttctcccacttatttttttgcctggctgaagtggagaatgaacagagtggttcttgtgcttttcctgcggtctttgttcttatcgtttgtttacctttttatgtccaatgccattagtgagttgtgaaaaaaacatgactttgcactcagatacaagtaaaatagtctatcttcaaggccttaggcttctcagcttgacatacgttattccctttcttctgactctgacctctttgctccttttatttatatccttagtgagacacaccaagaatttgcagctcaactctctgggctcaagggactccagcacagaggcccataaaagggccatgaaaatggtgatagccttcctcctcctttttattattaactttatttccactttaataggagattggatcttccttgaggtagagaattatcaggtcatgatgtttattatgatgattttacttgcctttccctcaggccactcatttattataattttgggaaacaacaagctaagacagagctccttgagactactgtggcatcttaaattctctctgaaaaaagcaaaacctttaacttcatagacaaaatttaactttctgcatctatgaaagaaataatagaagacctcataagttaattttatatttaacaatttcttttttggagtccttttaagtgttgttaaataattctgaaattttccttaaaatattcactaaccatattttctcaaagttgccggacataatgtctgattcaaggaaatgtctctactataataatgcctgctagtaacaatagagtatgtgagacttggagaaaaagataaacatttataatggaatataaataaatgcacatatgatatacaaggcaatatgaataaatatatataaaatcacagaaaaaagtgtaatgtaattttttgaacaaaaaattataaatacagtagggaaaaaattataaaatgttaagtataattaagtaagtttgttaaagcataatatatatcagtgtaatgcttggatatgtttgtggatgtgtagtgctactttgactactgtaataaaataacccagatgtaatcacagtagctgggaatgtaatgaagcagttaagagaattttgcttgcaaatgatgttactaaaatatgaaatgaagatcatgtattattttaatagaggaaatggatatgtccatatgaaagaaaaaaaacccagcactgttgtttgaggtaacttttaccataattttaaaaatggaataaagggaaaaaatagctggtaaatcatgggaagtatgttggttttatattagtcttcatgaagtagtaggtgaaaatattcttccaggttaagccctgatgcagagaatggtgtaagaatgataaggccatagggaagaattgttgttttctccagacaaaatgaactcttccattcaggaaattagagtgaggtcacatctatcacatttatcaggtagggttctctcatttagctattaatatcatcatcaccaccaccaccactatcatcatcatatatttcatttaactatttgttttttaaatgtttacatgcacgatttggagaatgtctaggtaatttcctaaagattattattgtgggtaagttgcattattaaagagcaaagcttatgtgaaacttaatacatttagagttagaagttgagtgtatttttacttaaaatgcattgcttgaacaaatgatttataaataatcttaaactcatcagaggctaactaccagaaatatttagtttttagtgtaaatagcatttgtataataagagagataaagtcaataaaccattttataattaaactcttatttcaaaagagaggctttaaaagtcaatgaaccaaacagaaataagccctcacatcttcaatatcatactctcttgatgatggacttgtaagacacaaagccccatgtctaacagtgtaaggagagtaaaaggactacttaaatattaagccatgttataagatggtgttgctgtgattgatgtattatcttttatttatggtaatggcattttgagatcaagttctgctccttgaattttcatgtaataagagtctgtggtgaagatgcagcaacagagaagctgctacttgcatcaaatttatttttagttcttttcaacttggttaagaatgattagactcacgcttttattctattcttgaccaaagtgtgggtaatcccagcactttgggaggctgcggcaggcagatcacgaggtcaggagatcgagaccatcctggctaacatggtgaaaccccatctctactaaaaatacaaaaaaattagccgggcatggtggcaggtgcctatagacccagctactcgggaggctgaggcaggagactggtgtgaacccgggaggcagagcttgcagtgagccaagatcgcgccactgcactccagcctgggtgacagagcaagcctgcgtctaaaaaaaaaaaaaaaaattggtgttttctttgaccaaagtgtgggtaaaagaagagaattattggtattttcttgtcaagtttactaaaagtttttaaaaaatctttaagaatttggtattatgagtattttatttatccatagaaataacttacagaaatagagtgaaagtttctttctaccaccaaaataatgactgaaaaaattaatattaagaattcaatatttaacaatcaattagatttaacaatcagttagaaatggtagaataaagaattagtgaattggaagataactacacagagtgaagcataattagacaaagagatggaaaaatacaggctaaaggggaagagcattgaggctacagtcagaaaggcttaacatacttttggagttctggaagattagaagagagaatgtagggaagaagtaatgttgctgagacctttccaaaaataataaaatgtatcaatccatacattcgagaaaccaacaaacctcagacaagataactgaaaacaaattaacatataaatgctacaggaaaccaaagaccaatagaaaatttgaaaagtagcctgagaaaaaagatagattatgttgaaaggatcaactgtttgaatgacaagtgattttcagcagaaagcatggaagctagaattcaatgtaatatattttcagtgtgtttcaaaggagtagcagacatttcataaacagaaattcaaaaggatacattttcagatagaaaaaagttactgaaaatacaaagttgaagatgcaagaaggaatgaaaataaaggcaatggcaaatgtgcgtaactaaaaggactattgactgtatagaacaataatatcttgtgttaaaagaggtaatgaataaaatgtatgccaataacatatagactggggtgaaggtgaaaagattaaatttagtttaattattatttaaccttttcattgtctgtgaagagagtctgagtatcaaattcaatgcatatactctagctatatatccaagagaagtgcattaaatgacatgtaaaataatgcccatggtagtattatttgtaattgttctaaaaagaaacagctcaaatacctataaattaaggaaggattaataattatagcaaattcatataatggaacaatatagagaaattgaaagcaatgaaccacatgtacatgcaacaaagtggatacattttatcaacataatgcttaaaaaaagaagtcataaacaagaagaaaatatattaaggttgtatttataaagagttcaaaaatgaggcaaactcaaatcaatttctgcaataaacgaatcatcttgaaaattgtatttacaacttcacaacttcctgtgttaaagtcaggaaattttctttctatatgtcacataaaattctagttttgatttttaacaactgacctaattggtttctaatgttctagaaaagacttataatcatttttccaggtttctgtaccttctctggttctctggttttcaagtgagaaaagctacacctaagcacccccatgaattatactggaaagttttccacctctcttttttgagcagagatttaggaaagttggcatttggatccaagtgacccaagctttagggcagaatgaaaattgcaaatcagtgcaagttactttttctcctatttgcatgtaatcaaagttgaatccagcccttcaatcaaaattacagatcgagtgttactgcctgggattggcagaactgtttgataggaacgaaaatgtttttatgttaatataaaatttgtgcccacatgtatgaaggatttttctattaaaactctacaattaagcggaagatgtgacacactgcaagaaatatggcaccatgaaactaactacaactgtatactattggggctcagaaaatgatactgaaaatatatcgctctttgacatgctggactaaacaggaagcctcaaattctctgtctgaagttttcccttctgtctgtgtctctgatcctctttcctgaagcaccagagggaattctctctggaatttccttatctgattaagaaaatttctttccagaagaaatgcaatttttaaaagactccttgtctaggaatctcatcaaatgaccaggataagatactggatcagataaccactggataagatacttggagttgtcaacatgcctagacagacttttcagttgttcttttgaaggcagctccaagagattccctgggtgactttatctgcataataagacaacctttgttcacagtgaagttctggccctaaccttccctccacctcccgtagagctcagaggaaatttgtcctaggccattgctctttagattatgcatttcctctggaaatcatttattcttacatcccttgctttcctctccccaattaagagtatacttaagagtcaattgtctggcccctgctttgggtctcatacttggtatatggctgtcatttatatatgcacattaataaaaacttgtgttttctcttatttatctattgtcagtttattttcaatgaaccctcagagcagatgaaaactttctcttggcttcttacaatacttgattctcttttaatgtatttcagttgaattggagtatatgctactgatgggagaattaaaagaattattgataaaaaacattttggaattgtttgattgtatccgtaaactgccaaagttggctgatgtatcataagatttatttgagtgactttattctaacaaatttgtctccagtattgagtatgttgaatactatatactatttttcaaaactcaaaaatattttatactatttttaaatattacttctttatttcaatattaaagtagaaaaaacattccactattttgctctggacacaaaccacttgtttcgctctcttgtttgccatttttttgggggtaatatctgttagtgagctcataatatttatcataattcacattatatgtattatattgttatatctacccattcataagatccatttctactcatatatctcaggtgtgtgttggtataaaattcacaaaatcttacaagtcttttggtctgaattttactttgtcctgtgtcacattttgtatcttgtcatttggggcctgctgggaattgagtgttatcatatatttaaacataagaggaggcagggatatatatagaggggtatcagcattcctctgtaagccaaacagctcaaggtaactcattacaggtttttaaggcaagggaaggaagactaaccttctcagcgaggggaggaagagtgcatctcctggcaacggtgcaccagcagaatttaggggttcaagatcctccagattctttgggatctgccattacaggcccaccccagtttttaagttcctatttcttttttagcaaatttcctgactttaacacaggaagttgtgaagttgtaaatacaattttcaagatgatttatttattgcagaaattgatttgagtttgcttttcagaaattttagtacttctgctataggagataaggacttttttgaagacagtcgtaggaatgttatgttagtttacataatccgaagctagtaattcagagccttaagttcataatttttctttctccaagttttctagcacacttataagtcagcaacgaaccctattctacttatgttcactaaaatgttctatggcagcctcactcaatgtcttgccttctataggaacttgattataagttattttgtaagtgatcatctatggacaataatttaaataactgttgtgtcaccgcatgccagggattgccagtgtctcctttaccgttggaaacagggtcatgaatacccttaaatctaattatatgagacaactaataccagacaactcctacctagacttggaatttgattctgtcatgatcaacagtctcattctgagtctcaggcagaaggggcagctgtacttgaagtgtagctgtggctattctcatggtgatcatcaaaatacaagaaggcccagacaaactgataatgcatttttaagatctctgctcatatacattctgctaatattctaaagcaattcacagacaagtacaacattaatgggcatggaaattatactttgcccacagtgggagagcacagcaaagttacatgcaaaggctgtgagtaatactattaaagggaataaataattggggctaaaaatccaatctactgtcatctcccaagctgaactttcttaaccatagatgtcaataaacataaaagtggagaatagttaaaactaaaatatagtacagataagtgataaaacaaaaataaattgatcttgagagaagagaaattttcttctataaaaatattaaaacagttttgtgataaaaataaaaaattctaatgtgcaattttctaaaaagtatagattatcaaaattttcttgtaaagaaatactcttgcatatgtcaaaaataatgaaagaaattttcttgtattatactatctcacaaattatcttttccaaaagagttgtaggttatatttaaaattttatttataataaacatcacacaccggggcctgttgtggggtggggggaggggggagggggaagggatagcattaggagatatacctaatgctaaatgacgagttaatgggtgctgcacaccaacatggcacatgtatacatatgtaacaaacctgtacgttgtgcacatgtaccctaaaacttaaagtataataataattaaaaaaagaagaaagaaaatggaaaaagaaaaataaagaaaaacattaagttatttaaaaatctaaacacccgactgtaaaaataatacctatgtattattgctatattataaaattttagatctggctaccatcatgaaaaaaaaatatgacataccaaagaaatgctgattccagaaatgtgaagatggtttaacccatggtaatatattatgataatcaactcactaatagatttaagagggaaataatatgtttataaaatagttgtggacacactctttaaataaatttagtacccaattataatagaaaatttaaccaactaaagaaagactttctttccctaatataatttgtcccctaaacaactacaggcaatcttgtaacaaatgcttatcatattatgagttccacagaaaagaggcttgaagtaatcttgtatcctagtaatttatttgagcctgcattaccatggaagcaggaatggaagtaaaggatgagttaggcaaaaaaaggaagagagaaaatacaagacatatttagctggctgtcacttcataatcacagttgatttcttcgtatgtgtttaaaaggagtctgtgaaatttctgtctctatccaagggaagaaataaaaagaatgtatatattggctctcatctttcattggtcagagttttcagggtgtcccctctgtgtatttctcaactatattttctagcctctctaaccagcccctggtgtagcaagatcccgagagagcagcaacagcacttatggcataagcagggcacattgaaaaaaaaaaaagcaaggatgaccagcagtctgtttttggccagcagcctgcaacttcgtgtgcatttgtgtggatgttgacagactcttgcaggttctcacacttcagctgctgcaggtaaatcccaagacaggaaaagagaggtgggtagtatcaggcttaatgactgaggggaaatgcagtcaggctgcactcatctccttggagcagcttcaagcagggtccagccagcccagcaagaggcagagtatcagaatgatatgactccagtttcaaaggcctgtcacagctcagtgagactcctcaaaagagaaaccacctctctgacatctttaagaacacagttggcaaaaaacaaaacaaaccaatgaaacctatagaaagtgtttctgggcaatatataatggagtctggtatagaggatcaatacaaaaatattttcactgatatcttttttcattattattatactttaagttttagggtacatgtgcacaatgtgcaggtaagttacatatgtatacatgagccatgctggtgtgctgcacccattaactcgtcatttagcattaggtatatctcctaatgctatcccttccccttcccccgaccccacaacagtccccagaatgtgatgttccccttcctgtgtccatgtgttctcattgttcaattcccacctatgagtgagaacatgcagtgtttggttttttgtccttgccatagtttactgagaatgatgatttccaatttcatccatgtccctacagaggacatgaactcatcattttttatggctgcatagtattccatggtgtatatgtgccacattttcttaatccagtctatcattgttggacatttggattggttccaagtctttgctattgtgaatagtgctgcaataaacatacgtgtgcatgtgtctttatagcagcatgatttataatcctttgggtttatacccagtaatgggatggctgggtcaaatggtatttctagctctagatccctgaggaatcgccacactgacttccacaatggttgaactagtttacagtcccaccaacagtgtaaaagtgttcctatttctccacatcctctccagcacctgttgtttcctgactttttagtgattgccattctaactggtgtgagatggtatctcactgtggttttgatttgcatttctctgatggccagtgatgatgagcattttttcttgtgttttttggatgcataaatgtcttcttttgagaagtgtctgttcatatccttcacccacttgttgatggggttgtctgtttttttcttgtaaatttgtttgagttcattgtagattctggatattagccctttgtcagatgagtaggttgcgaaaattttctcccattctgtaggttgcctgttcactctgatggtagtttcttttgctgtgcagaagctctttagtttaatgagatcccatttgtcaattttgtcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagttcagatagttgtagatatgcagcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgaaagcaagagcaaacacattcaaaagctagcagaaggcaagaaataactaaaatcagagcagaactgaaggaaatagagacacaaagaacctttcaaaaaattaatgaatccaggagctggttttttgaaaggatcaacaaaattgatagactgctagcaagactaataaagaaaaaaagagagaagaatcaaatagacacaataaaaaataataaaggggatatcaccaccgatcccacagaaatacaaactaccatcagagagtactacaaacacctctacgcaaataaactagaaaatctagaagaaatggataaattccttgacacatacactctcccaagactaaaccaggaagaagttgagtctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagctgggcagagacgcaaccaaaaaagagaattttagaccaatatccttgatgaacattgatgcaaaaatcctcaataaaatactggcaaaccgaatccagcagcacatcaaaaagcttatccaccatgatcaagtgggcttcatccatgggatgcaaggctggttcaatatatgcaaatcaataaatgtaatccagcatataaacagaaccaaagacaaaaaccacatgattatctcaatagatgcagaaaaggcctttgacaaaattcaacaaccttcacgctaaaaactctcaataaattaggtattgatgggacgtatctcaaaataataggagctatctatgacaaacccacagccaatatcatactgaatgggcaaaaactggaagcattccctttgaaaactggcacaagacagggatgccctctctcaccactcctattcaacatagtgttggaagttgtgaccagggcaatgaggcaggagaaggaaataaacggtattcagttaggaaaagaggaagtcaaattgtccctgtttgcagacgacatgattgtatatctagaaaatcccattgtctcagcccaaagtctccttaagctgataagcaacttcagcaaagtctcaggatacaaaatcaatgtacaaaaatcacaagcattcttatacaccaataacagactaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaacaatgactttcttcacagaattggaaaactactttaaagttcactgatatcttaaataaggcaaaaatgctctttaacatctgtagaactcaacattgttctagcacttttagctaatgtaataggacaagcaatataaactcatctaggaactggaatgagatagacaaatttacaatataatgatgtgatgatgtcactgcttaaatgaacactcctaaagaatcaacaggtactattagcataagaaaagataacaaggttcttcatataacatcgatttaccaaaaaacagtgtatctattgccaacagtaaattacaatatgtaaatttaaaaaattctttggccaggtgtcatggctcatgtctgtaatcccagcatgttgggaggcccaggcaggtggattccttgagtccaggggctcaagaccagcctgggaaacctggtgaaaccgtgtctctactaaaaatacaaaaattagcggtgtgtggtggcacacacctgtagtcacagctactcagtaagctgaggtgggaggatctgatcttgggaggctgatgctgcagtgagccgagatcgcgccactgcactccagcctgggcaactggagtgagacattgtttcaaaaacaatacatgaagagatgtatcatgttcatagataaactgagtattataaaatataatttctttctagattaatatagtcaatgcaagttgtggcaaagtcttattaaagttttgcggaaattgtgaaaaatgacttgaaaaatacatatagaaaattaacagttcggagataggcaagaaaacttggaaaaagaagaaggtaagttctttactgggtatcaagatttattatagtgtaattatgaaaattgaaagaattttggcacagaaggatgcaatagacaacaaaagggaatagtaaggcagaatatatttaggtaatttactttttgtgcacatgtaatttgtcttacaataagattatcattagaaattagtagataagatgtgttttttgcagtaaattgtttggataatggacttttcataaggaggaaaatcaatgtgtaacttgtatcacaaaaaatagtccaaaaggactaagatctaaacattaagaacaaaatttaaagctaagaaaaatgtaaattattttataaattcagggtaggtgaggattttatctgaaagatacaaaaaccacaaaacataaaggaaaagtttgataagttttaaattccttggaaagatctgttaattaatccagctaagttagctgtctgactctagtctaattatacatctaggcatttgataatgaatacagaaagagtattaaaactaggaatatatggatgaaattaaaaatactcattttacctaataaaaaaatcatgttcttagatgacattctcattgttgtgatgacatcaattcttgccaaattcaggtatacatgtaagatgttaaggcaaatattgccattttttttctcatttagagtagtttattatgctaagggcctgggaaacactttagattcagtaaaaaaactacctagaagaataaagcagaatgaatactagaaaaagactgaaagaaaaaaaatgtgtaaagacgcacagaatgaggaacatctgttggtaaaatatattataaaaatactaaaaaggtatccagatagtaaaaagctcagaaacatgaaaaatctctttcactactggtagaagcatatagtaggatatagtcaaagcgaatttagcataaaaatacatacactttatatctatgtatctatgtacacatactttttgatatgcatgtataactacatatttctgaaacgtttctaaaaataatcataaaatgattacagatatgcaaaaacagttatagagctatgtatagtttgttaacattaagataaaagccttaacattttttatgcttaaaaacattataatgcttcattatagcagaatacacatttgtcattaaaagagatatagagcagaatttctcagagttcagcagaatattcatagttgttacaaaaaaatgttcttaatttttaaatattttaggcaatgctggcttaagcgactttaacctttttgtttgtttttaaatcataagctttctgtatactctgttagtatgtaaaaggaagtgctctatgtggagtttcccaaatttccttttctgtgaaatccttttctgttttagaaaataccttttaattctaacattttcaggaatttaatttgagaaattctaatattgagggattatgtatcagtgaggaacaatttcattttttagaacatgtagactgggtatggtggctcacacctgtaatcctagcactttgggaggccaaggaggatagattatttgaggtcaggagtttcagaccatcctagccaacatggtgaaatcccatctctactaaaaatacaaaaattagccatgcatggtgttatgtatctgtaatcccagacactcaggaggctgaggcagggagaatcacttgaacctgagaggcagaggttgcagtgacccgagatcgcgccactgtattccaacctgggcaatggggcgagactccgtttcaaagaaaaccaaaaacaaaaaacaaaacaaaaaaagtataggcacatgtgtaggtttggatggaacaataaacactgcagagattcaggggattgtggcagatggatgtgaggcaggactagattgcagctctagacagaccagcatgtggatgcttgtattgtgaattttagctacaaatccactgcaagaacaaaccagtaatcccaagaggacccacagatcctctgaaggaagcagagtgctcctgcaggacccaggagacacccaaatacagtgacttccccaactgcaggagtaggaaagggagaccctcctcttctgaacacacaccaccactggagaactgaaggtctgtttgcaggagaagtttctggctttaccttgagctgagttaagttagagagctgagtgaaatgcaggggtagaggaagcagggcagaaggccctgggagctcactgggtccccaaacagccgattcctgcctggcaccatagtactccatcaggagggtggccagaggagcagggggtaaaaccccccaggcagaagaaatctctagctgaactttataacaatttgaactggtcaagaagcctcctggccagaactcgggggaggatgtgaatcgggcatgcagacttcacaggctggggaagaactaaagcccttttctctcatggctgggaggcagatagccttgggcaagttttcaagcccattttgccctctgcctggaaatagaatcggtgctgtcggctgggaggggcatggtgggagtgagaccagcccttcagtttgcatggttgctgggtgagacctgtgactgttgcctttcccccactttcctgacaacctgcaagactcagcagaggcagccataatcctcctaggtacccaactccagtgacctgggaatctcatccccatcccccacagcagccacagcaagacccacaggagagtctgagctcagacatacctagccctgcccccacctgatggtccttccctatccaccctggtagtggaagacaaagggtatataattctgggagatctagggccacacccactgccagtccctcaccacactactacagctgatgctttctggaaagcaccacctcctggtaggaggccaaccagcacaaaaatagagcattaaaccaccaaagctaaggacccccgtggagtccattgcaccctccatcacctcaactggaacatgcactggtgtccaaggctgagagtcccataaattgttcacatcacaggactctgtgcagacaactcccagtaccagcctggagccagtagacttgctaataagttgtcatctccatctattacagtatttgctctaatcatatttgacttatatacctgggagctccagtgttgagtgcatatatatttacaattgttatatcctttccatatgttgaccttctttgtcacttcatagtttttgtcttgaaatctattttgtctaatattagtatagctattcctctttttttggcttccattgccatggagtgtctttttccatccctttattttctatctgtgcatgtctgtataggcgaattgtgtttcttataggcaactgattagctagactatgccttttgattggagagtttagtccatttacattcaatgttattattggtagtaaggacttacttctgccattttgttatctgttttctggttatgttgtggtctgctcttctttctttccttcctatctttctttagtgaaggttattttctctggtgatatgatatagtttcttgctttttatttttttgtgtgtatccattgtattatgttttttgatttgcgattactatgaggcttgcaaatactatcttgtaacccattatttcaagctgatagcaacttagcactgtttgcataagcaaacaaacaagcacaaacactaaacaaatgaagactctacaccttaacaccatcttctcagtttttaactttttgtgtcactatttatatatcattgtgctgtctatatcttcaaaggttgcgggaactattttttttttgtcagttcatgatttaatttttgtactttagcgaggtttacacaccacatttacagtgttatactagtctgtgtttttctgtctccttactattaccagtgagttttatagctttaggtgattacatattgctcattaatgcccttttctttctgattgaagtaatccctttaacatttcttataggacagatctggtgtttatgaaatccctcagcttttgttggtttggaaaagtctttctctttcatgtttgaagaatattttctccagtaacactattctgggctaaaagttttttccttcagcacttctaatatgtcatgccactgtctcctggcctttttccactgagaagtctgctgccagatgtagtggagctccattgtacattatttgtttcttttcttttgctgctttagaatcctttctttatccttgaccttagggaaattgattattaaattccttgaggtagtcttcttcaattttacctggcattgtttgttgagaaaaacgattaattcctttcgaattgcaatagtacctttttttgaaagcaattgaccatgaatgttggtgttagtttctggactctcagttgtgtttcattgttctttttgtctactgtaatgtgagttctatagaatcctgattagggcagctttgaagtaagctttgaaatcagaaagtataatcctccaaatttcttattttttaacaatttctttttgtgatcttgtcacttggcatttccagatatattttaggagtggttttccaatttctgtgaaaaaagtcttctgggatttggtagggattgcactgaatatatataagttgacttttcacctataaagactctccttgtgctgaatttcagttcagctggtcatcgttgcttgtacaactctgtgatgaattgaaaatataattttggccttttgtttcttttatcctagttgttggagacggatgtcatgcctttcttaaccttgtgtgttctgctcaaaaatggaggttctcagccaggtgtggttgttcatgcctgtatccaagcactttgggaggccaagatgaggggaccacttgagcacatgagttgaagaccagactgggcaacatagggagactctttgtctctataaaaaaataaaaaaaaattatctggatgttttggtgcatgcctgtagtcccagctactccagaaggtgaggtgggaggaccacttgggcccaaaagtttgagactgcagtgagctgtaatcaagccactgcactccagcctgggtgacagagcaagaccctgtctccctccctccacccaaaacaaggaagttctcactggtatcttttatgtatcaagtaacacatgatcatatgaaaaattaataatccttgattcctgcctgtaccagaaggtaaaattgaaagcagttatacaaatagtatattaactcctcagaaagactatccaaagagaatattattatcatctgtattttacagatgattataccaaggcagagagtagttgtaaaatgaggtctgtctggagcatacctatatgaagcagaaaatctggtttcctgtcttggcagtctgactccaaaatcctctcttagaaacaattatactgtaaaaatgaaaaataaataaaatccaagattggagactgattttaacatctattcatcttaaaccattaagtaatcaaaaataaattaagcagaggaaaacaaaaccaaatattcatatagaaagaagtctagactcttcaatggaaaacgtgtttttcaagtgacccacaatagttacacaattgctgagcattttaattaaacaataaatatttaagtattaactagactcaagagaataacttagtgaaaggcccaagcatgagtggtaagtttgataaatattgaaaatgggtcaaaaagcccaaatgggaaaatagggctatttccacctggatgatctccctaaaattaattttccattttggaaattataggacaataattcctcctattcatgaggggtgagtatgtgtgtatgtgtgtgagtgtgtttgtattaatgagcttgttaacaataagttatacaagtattacttagtagcaaccaggttttaaggactattggcctttttgaggttcctaagaaaaccttgaatgcttttggtaggaaaagttgggattcactctacatattactggcattgaaaaaaaataaatctactttggtgatgatcctagctatcctcaagctccattcaccaggctatacaaccaatgtgtcatatatgtattgggttgtaaaatatctctaacaactgaagttgctgaaaacaaattatggagaggtgaaacaaggaaaaaattgcagaacaattaaaaaactcttccttggcatgctagtatatgagaattcagctttcacttcaacatcaatatggaaaattttaccttacagcaaggatgttgtgtttgaataggagttaatttgagctgttttggaaattatcatgttttccataaagacagcattgatttcatccattagcatattgagatgatttcctgtttgacgttggtcacagaatttaaaaggaacaagaacattactgcacattcaggaatcagttacacatagaagttaaggtcaggaccttaaagggaatcttgaccagtgatattaggcctactttttaaaacattcagacatgataaatttactaccattcattttttcaataacagcaatgatatatttatttttcccatggacacctacattaagcttgttgtctatttttatatttcaacatttttgtctttgagtccttttaggagttgttaaacaatcctgaaatttcccttacagtgctgttaacaattatattttttcaaagtcctttggcataatgattgattaaaggaaatatctccagtataattacacttgcttataagaaaagagtatttgaaacttgaagaaaaaaaggttagacaaatttataatgaaatataaataaatatgtataatatataaggcattattaataaatgtatatgaaataactatcatagaatgaaatttattgaagtaaaaatacattctaaattagaataggaaagaacttggaaactattgtttaataatatgttatataaatacaaaactgtaaatattactcttacgttacttattttggaaaggatatgaaacaatgggaattttcatattctactcctaggatgataaatctgtaccatcattttggctgagtatggcattatctgattaagatgaaggatcacatcctaaacccagtatttacactcttatccgaatacatatacatgcacatgcgtatcactgagtttcagtagctaaagttgagaagtacttggaatgtctgtcagtcctccaaatggataaacaaattatggcatacttatacaatggaatactatacagtgatcaaaattaacaaagaagactgacatgtttacaacaggataatacaacaaaggaaatgaacaaatttgagctacatagataataatactcacagatgtgaaaggaattatcaagatggaaaaatacatttagaatgatcttttacataaagtttggaaaaaaaatttttaatacattgtaatttgttacattggtgatgaaactctacagtgaaatatatgaatgatcatcataacaattgggataatcaggagggaggaaataaaagggaaataccaacaagaagacgtatattgggagtatctggattgctggcaaattctattttctgaccaaggtttggtaacatcaatgttaatgttataattttttcttactgtttttaggttttattactctctgtatgttatattccccaataaaaaaatgttaaaaaagcaaaaacataagtacatttctacgtataaattcagggtgatacagcatattctcatagataccattgtaattagagtttttgctgaataaaggagaatagagcattatggtactaagaaatacaagttaaaatttaaaactttttttattttgagacagggtcttgctctgttgtccaggctggagtgcacaagtgcaatcgcggctcaatgcaacctctgccacccgggctgaagtgattctctcagttcagcctccagagtagctaggacaacaggcgtgcaccaccacgccctgctaattttttctatttttggtagagatgggattttgccatgttgcccaagctggtcttgaactcctgtgctcaggcaatccaccgcctcagcctcctaaaatggtgggattacagttatgagccaccacacctggcccaaaagttttcttaaattaattaaaaaagaagataagcaagaactgtaaatccaccttcttaatgctaatatgaatttgaaacatcaaaatttgaatatttatgattgctagacacctttattcttatttccaatttaattattcataattcacatttcagtgtcagaaagtcatgaatttccaataaactatagtaagatgggtattacatatatagacctattatgccaaaatgtgtctctaaatgaaatatgtatattcatattgttagcattctaatttcacaatactattcatgtgtacacctgcattttgggttaaatattttgttactatatattttttggttctgcattagagaagaaaaatcataggcaaatttgttaaggtgtaaaacatatttagtatgatctttgagtatgtttgtgcatatataatgctactttgactgctatagtaagataacagatttagtcaccatagctaagaatgtgaaaaagcatttacaagaatttggcttgctaatgatgctattaaaagatgaaataaaattgatatgctgtatattgcatagagtatttgtctattttcatattgaaaactgcacaaaaaaacccaaaatagaatcctaattgttggagatcacttttgctatgaatttttaaagtgtaataaaataaaaaaagcaaataaatcattgaaaatacattggttttacattattcttgatgaaataccacgtgagggtatttgcctaggcctgatgctgagaataatataagaatcatgaggccatgaagaagaataatattgttctctcattaccttgaagtctagtacttaaaaaacaagactgaaatcacatttatcaaatagcattctcccttttacctgccatcatcattatcattatctatatccacatctatctcattaaatgatttatttttgaaatatttaaacacataatttggaaaataagtaattttaaaaagatcataattattggaaagttacaggagtaaacagcaaagtttaagtcaagctcaatacacttagatttagaaattaagtgtagtttattttacaatacattgcttaagcaaataattatttatggatgagcttaaactaatcctcttttcactatgatcactatggaaacaatttagattttaatggaactaaacctccctagtaagaaagacaaagcaaatagcacattttatgagcaagcttatatttctaaagagagagttttaggaccagattgtcaaacagaggtaagacctcagatcttctgtcacacttgagtgagtgatgatggagtttgaaggttatagttctataaccaaaactatattcacggatagggattaaatggtggaattccttagaagcaccagattcagttttgtttccatgggaataaaagttcttcaatgtttgataaacttgtaagtactgttttactctttgatcttttaaagattgttataaatgaagaagccttgatttctgcttataaaaacagtaaaatttaaatcgtggaatagattggtggagctgtggttgagatactatattttattaattgtaatgacattttgagatctagtgctgctcactgaatttccctataaggtgagtttgtggtgatgacccagcaacagacaagctactatccaaaaaaagctactcacatcaaatcaatttccggtttcttccaagttgcaggagaatgcctagaccatgattttaatctcttctgtgacctttgtattacaaaaagaagaaaattgtgaccattttcatgtcaggtatacgaaaaatttataaaaactcctttttaaagaacttgtgagtagcttcactatgcctggctaacattttcatttattgtagagggagtttcggtgtattgcacaggctggtcttgaactcctgggtgctcctgccccagccttacaaaatgttgggattatgggtgtgagccaccctgcctggccaataaagagacttattgaaaatattaagttgaatatgcaagaaggaatacaaattaatgaaagtggtaaatatgtgcataattgtaaatgaatgtttactgtataaaataataatgtcttgagggtgattatataattgataagacatatgcaaatggcaaaaaatagactggaggtaaaggtgacaggagtaaatttacttgaagtagtttttgaacttttctatgtctatgaggagattttgaacaatgaccctgtaattttacccaaaggtatatatacagaggaattgcatcaaatgatatatgaaagaattctctagtagaattattcataacttcaaaaaagaagctgaccaaatgtacattaaggatgggtgaatcattacattaattccatgcaacggaacaatatagagaagtgaaaaaaaaccacatgtacttgcaactatgtgactaaatttcagaaacataatgttgagtccaagaagccacaaacaacaagaacatgtaggaatgcacctacacagagttcaaagcaggccagaccaagctatggagtttagggttgcatacctagttggtaaagtatgaagaaaattaaggaaataatcaatataaattatggatattgcttatctcaggagatgtgaagaagggtttagggggttggaaagtggcatggaggtggacctaggctgttttcagtgttccttgtcttgctccacataatggttacttgaatgtttatgatacactgcggtatttcccatttttgttttggttcatttctaagtgtgcattataattttaacataaaaagttttaattaggagaaacgtctcatagaaattattattactcgtctcattatatactgaggggaaaaataaactattggtatacattcttatacaactctaagagagttgaagtaagaactttatttagttgcaacatgaggaaatttgagatgattttatttgccaccccagatttttccaaaggatttcttctagccttaattatccacctcacatgaacaaatctttgccattccccatctattttttcttttggctcctgaattcctgacacaacaaggttgtacacatttcccacactcttggtttagcagagttcttttatcagttatgtttttctgcaagagaaacccttcaaaactacattggatagctctggtgacttgagatgggccaaattctgcatcttggaggtcgttagagtttggccaatttagtctggatcaggtggggggcaatctgccttcattagtttctgattctccttctgggaacagtgtactagccaggtgatattctcatagtaaatggaaagaggaagaacacccagtatggaagccatctcaaatttctatgcaaagtgtattaattttttgttcatcaaagtaagttaaatgattgaacttcaagttcaggggaaaggtagtcagtcttcgtgtgatgggaggatactgcaagattatatatcaaagggtctggtactcaggaatacttataaaattgctgaacattttaattaaataataaatatttaaatattagacttgagagaaactttaccaaaggcctaagaattagagatatgtttgataaataaacattattcatgggctgaaaaccttgagtgggaaaataggactaatttcacctggacaacctcctggaaactgattttttattttggaaattatgagaaaataattcgttccattcataagtggtgtgcacatgtgtgtgtttgtgtgtgtatttatgagcttgtgaataatgaagttacacaaaagtattagcagcaaccagatcttatggagtattggcctgcctgtggttctcaagtaaatcttagatgcttttgataaaagcagtttggattctgtgtatttaaatctggcatttaaaaaagtccgtattggtgatgatcttagttatgatcaagctccctttaagattttagacatttactatacgatctacatatcaggttataaaacttcccaagcaactgaagtcgctaaagacaaatgatggagaggttacacaaggaaaaattgcaaacactggaagtgaacatgtccttgtttgcatactagcaaatgagaattcaggtttcatgtcaatttcagtatgaataattccagcctataacaagaacagatggtgaatgagtcagttaatttgaattgttttgaaaataagaatgttttccataaagagagcattgaacttatccattagcatgccatggtgatttctgacttgacactggtcacagcaattaaaagtaaaaagaatgtcacagcacatacacaaatcaggtgcatatagaatttaaggtcaggatattcaagcaatcacaaccagtgatattacaccagcattttaaaaatttctttttgtctgttcagacatgataacttttctgcccatcattttttccattctaatagtggttatatttgttattggaaattttgctaatggcttcatagcattggtaaattccattgagtgggtcaagagacaaaagatctcctttgttgaccaaattctcactgctctggcggtctccagagttggtttgctctgggtgttattactacattggtatgcaactcagttgaatccagctttttatagtgtagaagtaagaattactgcttataatgtctgggcagtaaccaaccatttcagcagctggcttgctactagcctcagcatgttttatttgctcaggattgccaatttctccaaccttatttttcttcgcataaagaggagagttaagagtgttgttctggtgatactgttggggcctttgctatttttggtttgtcatctttttgtgataaacatggatgagactgtatggacaaaagaatatgaaggaaacgtgacttggaagatcaaattgaggagtgcaatgtaccattcaaatatgactctaaccatgctagcaaactttgtacccctcactctgaccctgatatcttttctgctgttaatctgttctctgtgtaaacatctcaagaagatgcagctccatggcaaaggatctcaagatcccagcaccaaggtccacataaaagctttgcaaactgtgacctcctttcttctgttatgtgccatttactttctgtccatgatcatatcagtttgtaatttggggaggctggaaaagcaacctgtcttcatgttctgccaagctattatattcagctatccttcaacccacccattcatcctgattttgggaaacaagaagctaaagcagatttttctttcagttttgcggcatgtgaggtactgggtgaaagacagaagccttcgtctccatagattcacaagaggggcattgtgtgtcttctagcagaaaacaaactggtggtgtatgaaacattttatatttcttactgggttttctgtaatatatgtatatgaataatttccaaatgtatacctagaaaagtcttttacctaaagttagtctagaaaagtatatatatatagatgtgtgtgtgtgtgtgtgttgtgtgtatgaaaaactgaagaacattgacaataacatgctttttattgttttttcacaaaaactgccaaattatagaaaatatgacaaaaattcctcaattatgaagccatgtttatttcatacatgtattttatatttcatttgtagaatttatatctatttataattattaagaactaacagcttatctcaggaaaaatattgctcttttctattgttatttgaatgacacaaatataccacagtgtgcttacaatctgttgttttaacctataactttttgataataaggtcgttcaattcttaatcactaatgaggatgtatcttcagggttttattccattatgaattcctattttatgtttagtaaaaagcaatcagaattattgttacaaaacaatgaacacaataaaatttgagtgacaagtatatgtagagtaaatttcatgtatgtgtaccataaacagtactgaggaatattagatttaatacaagtatgtgaatagcttagaaaaaaatctctgctataagagggatgaaaaatcatgatcatgatcttgattgctattatcagcttccatatgcagttagaaaagtcatttcttccagcttttcaattaaagaaaaactttttttgaaattgagctctgatgtaaattattttagtattttttctaaagcacttctaagcccctgaattgctaattatatccttatcttccatttttaaaattctttctaaacttcagataagagaactccagtcttccgttttctaaaaaaaaatctgtcaatgtgaaaatagtataaaaattatggaaaataattcagtgaaactttttttaagtgttaaaatagtatctatgaaatctatgtattaattatgggatttgtcctagtgtaattttgttgtcaatgattaaatggaattgtcttgacatattcattaataggaagttctattataagaaggaaatgtacagtcttgtttacagctaaattctacatgactgtattaattcttggtgttatgaaattttaacaatgttgttcagaccttaagataaatcatccccacacctgattcatgtattttttagaatcatgtatcttcctcagtacaatgtaagaaccataaaagaagagatcgtgtctgtcaggctttctgttgactcccaggacctagaacccagcacaaggaatagatggtcaaaaatgatattttaatgaacaaataaatgggtggataaaatgggtaagctgatgtggtaaaccaatgaaaaggaaactcatcacaaaatctgcagttgcatgagttcccctgttctggtctcaggttaagattacaggcttatccaagcagaatccttcctcagaggaaaagtttggctattccacaattttaggggaaatatcacaataatatagtcttgatgcagctgtatcaggtgtctgaattggagacaaggtagaacatcaaaattagatgccactattacaatattttaaaaaagcatataaaagactttggtctatttgcgtatgtatttttttctattgtgaattatatatttgtattatgatattttctagttgattatcatataaaaatggcatttcatttcaaaaaattgagttagtaaccagctactttactaaaatgtttttaacgtaatacctgatattaaagtgatgacatttatatggaaggccaattcaagacaaaaatggcagggacatgtggaaattgagacaagaacggatgtgaaacaatgtgtggtgatgtctggtatgactctgctggcagccacttcacagtgaggtgagagagacagcatggtggtcatcagatgcatgcacttgactcccagaacttttccagaagggctacaaagggaaacgacagctggcattagtccatggaagagagagagaggagggagaatgtatctgctcagctgttgttagtcttctgtttccccttggccagggtttccctgagttagaactaccatctctgttgttctgtcttacatcatccagtcccttggtggtggtcatgaaagtcagacctcatgcccacagtgtggtgatgcattcaagtcccaaatggaaggatgatctggatcaggcaaggtgctgaccaggggaacaggagatagtgaagggaatctgagaaagcacatgtttgtgtccaataccaccactccttgtgccactgagacgtgctcataccctccagtcatggctggctttatgagcatatgacttgcacagttgtacagggttttgtgcttataggggcttgtgcttagagtgactctatgcttggattaatgttctgcacttgctgtttggcttttcagacagagtatacttcagcattccctctgctgaagagggaatggtcttacactggtcttacactgattccatagggatttgctctcccctctcctacaggcttgtcagagacatgcacagagtcctataatgcccactatgcatgcctctagcagctttgaattccgctggatcatctggcacagtggccagagcagcttggaccagagcctatatcttctgtagagccctctttagttctgggctccatttgagaccagtagcctttagaaacatcgttcgtgagtcagagcaatattctcaaatgtggaatatgttgtctccaaaatcccagtaggcccccaaaacatagtgtctcttttgtagtgataggaaatatacagagagagcaaaatgccgtttactgtaaaaaagattgtctcagcatgtggactagggacaccaaaaaccttaaaacgtcacctatgttgtcggtccctgaatcttctctgatttatctattttcttctggtattttacttctgctcaatgttataatattttactatactgaagaaacttgccatttcctgattattgtaccaactaatatattattattggtattattttgagacacggtctctttctgtccctgaggctggaatgcagtggcaggatcacagctcattgcagcctcaaccttctgggcacaagtgattctcccacttcggcattgctggcagctgggactgcaggggcacaacaccatgcctggctaattttggtattttttgtagggctgggatgtcaccgtgttacccaggctggtctcaaactcctgggctcaagtgatctgcctgtgtcggcctcctaaagtgctgggattacagtcatatgccacagggcccggtctgtaatattatcaatacattaaactggcaggatgttttaaaaaatgtaaattaaactgagaacagaagtgacatagccctgacatacaacagtgaagcagtgctattattcttacaaggcaaattgttttgattttccctcataatgggtgtagattaagaaccattcaccaaatcactagccccacaaaaagtaccagaagctctgctctgctcggtgaagatagcacatcctggaaagcatttgtgagtgttgatttaagtttatggtagtctgcattcattcgataacccatctggttttggtagaggccagataggttaagtgaatcgggttatagaaaagactaccatcccctgtaactttcaggtgttttgtcatgacagtgaccagttccattccttagggaatgcggttattatattttatatattttgttgccagtagaggagaatttcagaggctttcccttggtcctgctataataatgttccttactctacagttcacgaagaatgtgagagtcctgccagctgccatacgtatccatttcaattcaggaacaggtaataactacaaactgattagatccaccttgggatggacatgagccgaagctctaggtagcatctgaccttcaaaactcccactgcgggctggatgtgatggcttatgcctgtagtcctagtactttgggaggccaaggtgtgaagatcctttgagagcaggagttccctgtgcatcatatggaaactccgtctctacaaaaaattttaaaaattacctggcatggtggtacatgcctatagttccaaatacttgagaagctgaggcaggaggattgcttgagcccaggagttccaggctgcagtgggctatgattgtgccactgtactccagcttgggtaacagagggagatgctgtctcagaacaaaaaaaaaggtggaagttctcactggtgtcaaatatcaagaaaaacatgatcaaatcaataagtaacaatctttggttcctgcttatagcaaacaggtaaaattgaaagtagttacagaaatagtatattaactcctaacaaaactaaccaatgaaagttttattatcatctcctttttgttgttattttgagacggagtctcgctctgtctctcaggctagagtgcagtggcgtgatctcgactaactgtaacctctgccttctgggttcaaatgattctcctgctgcagtcaccgagtggctcggattataggtgcgtgccaccaccacctggctaatttttatatttttagtggagacagggtttcaccatgttggccatgctggatttgcactcctgacctcaggtgatccacctgccttggcctcccaaagtgctgggattacagccatgagccactgcgcccgctttttataggtgattatactgaggcaggagtagttggaaaatggagtctcagagcatagctataccaagcagggaatatgatttcctgacctggcgtctgactccaagatcccctcttagaaacagttatgctataaaaactgaaaagaaacaaaatccaggattggagactgattttaacatctattcatcataaatcaataagtaatcaaaaataaatagagaaaagtaaaagtgaatattcatacacagagaagtgtaaattcttctatggaaaacatgtttttttagtgcccaaggaatagttatacaattgttgaggtttttctttttctttttcttttttttttttttgagactgagtctcgctctgtcgcccaggctagagtgcagtggcgccatctcggctcactgcaagctccgcctcctgggttcacaccattctctggcctcagcctccccgagtagctgggactacaggcgcctgccaccatgcccggctaactttggttttgtatttttagtagagacggggtttcaccgtgttagccaggatggtctcgatctcctgacctcgtgatcagcccgcctcggcctcccaaaatgctgggattacaggcgtgagccaccgtgtccggccaaaatagttgagtattttaattaaataactaatatttaagtattctcaagagaataacttagttaaaggcctaagccttagagattaagtttgataaacattgaaaatgggctgaaaagcccgagtaagaaaattaattttcattttagaagttataggacagtaatttttccaaaccatgaggggtgtgtatgtgtgtgtgtgtgaatgtgtttgtgttaatgagcttgttaacaataagttgtacaaaattattagttagcagtaaccagttttcaaggaatattggccttcctgggcttcccaagaaaaccttggacacttttggtagaaaagttgggattcactctccataaatctggcattgaaaaaatgattcaacagtggtcatgattctagttttgaccaagctacatataacagtgtaggcatccaatgtatgatttatgtattaggttggaaaatttccctaacaactcacattgctgaacgcaaattatggagacactaaacaaggaaaaaattgcaaaatgatgattaagtgtatgacttgatttgcatgctagcaaatgagaattcagctttcacatcaacatcagtatgaaaaattttatcttataacaagcatatagtatttgaataggagttaatttgagctgttttggaaattatcctgttttccattaagacagccttgaactcattcaatagcattccccggtgctttcctgtttgacattagccagagaatttaaaaggaacaagaacgttattgcacagtcagaaatcaggagcacatagaaattaaggtcaggaccttaaagggaaacttgtccattggtattaggcctgccttaaaaaatgcggacatggtatgtttactactcatcattattttccataacagtaatggtagaattcgtattttcccatgggcaccttcattaggcttatagactattttgatatttcaacatattattttctttgagtccttttaatgagttgttaaacaatgctaaaatttgccttacagtatactgttaactaatcatattttcccaaagtcatttgacataatgtttggttaaaggaaatatgtctagtacagttacactctaggattgtaatcctagaattgtaaatcagtgcaattactttgagtatggcattatctgattaagatgatggatcacatctgaagacccactattgcactcttatcagaatacatatacacacacatgcatatcactgagttttaattgctaaagttgacaagtctctcaaatgtccatgggtgataaaatggataaataaattattgcatagtcatacaatagaatactatacagcaatcaaaatgaaccaactagagagacgtttataaagaatgttaataaaaaggaaaatgaacaaatttgcactacatagatacgagagatattaagatggaaacatgattccgtataattacatttatataaagtttacaaaactatatttttaatgaactgcaatttattacattgttgtcgaaattctaaagtgagacccaagagtgattattgtaacaactggcacagtagggacggaggaaacaaaagggaaatgatatcaacaagaaggtgtatatggggagtgtctggattgctggtaaattctacttcatgaccaagatgtggtaacatgacccttaatgctataatttttttctatactgtaccttcaggctttattaatttatatatatgttatgtttcatagtaatgaaaatattttaaaagcagaatcatataataaatgaatgaatataaaataggctgaaaaaacattcttgtagacaccatggtaattagaatttttgctgaataaagaagaatagagcattatgatagtaagaaatccaagataaaattttaaactttaaattaattttaaaaaggaagagataaacaggaagtctacctccacactcttaatgttattcttattttgaaacatcagattttgcacatctgtattttgctagacacctttttttcttatttccaatttagatatttatgatcacaacatttcaaagtggcagaaattagtgaatttccaatatagtaatatcgatattaaatatacaggacaattttctaaatttatccctaaatgaaataataatacacatatttttaccattcaaagattataataccatgcatgtgtacacatgtgtgaggaaaaatattttgatactacaaattttttgaatattacaggagaattagtagaaagataattttgttaaggcataaaacatatgtagtataactacttggactgctataataaaatcacccagattttgtgacagtagctgagaatgtaaataagcagtagagagaatttaacttgttaatgatgctattaaaagatgaaatgaagcttattcactctataattgcaaagagtatttgtgtaagttcataggaaagtggaacaaaattaaacagccaacaagagagtattctttgctggaggtcaattttactgtaatttttagaatgtggtaaaagaaaaaaaatagcaagtaaatcattggaaatgtgtcggttttgtattattcttgacgaaatattatgtgagggtatttgtctaggcctgatgctgagaataatacaagaattgtgccgggcatggtggctcatgcctgtaatcccagcactctgggagaccgaggctggtggatcacctgaggtcaggatttccagactggcctggccaatatagtgaaaacccatctcttctaaaaatacaaaaattagctgggcgtgatggcgggcacctgtaatcccagctacttgggaggctgaggcaggataatcaattgaaccagggaggcagaggctgcagtgagccaatattgcgccattgcactgcagcctgggtgacaagagtgaaactccatgtcaaaaaaaaaaatcgtaaatccatgagaaagaataatagtgttctcccactacccttaactctagtacattgaaaagaagacccaaatcacatttatcaaataacattctcccttttagctgacattatcatcattattataatcatctacatttacatctatcttattatatgatttatttttgaaatatttacatacataatttggacaccgtttacataagttctaagagatatcattgtgggaaatttacgttagtaaacagcaaagttcaagtcaagttgaatacatttagatttagaaagttaagtgtagtgcagtttaaaatacattgctgaagaaaacaattatagatgatattaaactaatccaaggaacactataaaaagattttgattttagtataaataaaattgcttaataagaaaaataaataaaccatttcatgatcaagctcttatttctaaagagaggattttagggctaaacaaatcaaataagccctcccccacatcttctctatttcatgtaggtaatgatggagttcaaaggcacagagccccatttctacaacataagcaaagtgaaaattaattcatggaatacaatgacatagctgtggttgatgaactatattttatctattgcaatgatattttgaaatgcagtgctactcattgagtttccttgtgaggagattgtgtggcgaggacccagcaagacaagctactatcccaaaaaagctacttatatgaacttcatttccggtttctttcaaattgaaggtaaattccaagatgaagcttttattctattctctgaccaaagtgttgggaaaagaaggaatttgttaccattttcatttctaacatactaaaacagaaaacaaaaaaccccaaaatcaaaaacacttttaaaaagaacatgccgttaagattagtttgttcagtttccctgtagaaaataatttatggaaagataataaaagattattctgaacactaaaacaagaaaactaaaaaatgaattatcaatattgagaatccaatagacagagttaaccagttagatggagtagaagagataattagtgaattggaagatagctacaaagaatgaagcactgagagaaagatggaaaatataagactagagggtaacaaattcatgctacagttggaatatgtaacatacttctggagttctgtaagattagaggagagaaaatagagcaagagaaaatacaaagttgtactgaaaatacaaagttgaacatgcaagaagcaataaaattaatgacaatgaaaaataagtgtgtaattctaaataaatgttgcctgtagaaaacaatagtgtcttgttggattaattgtataattgataagatatatgcaaatagcaataaggagactggagacaaagtgacaggaataaatttagtcaaactgttttgggcttttctatgtctgtgagtagaatttgaatatcataatccaggaccgtataaatctacacccagatatatatacacaaaggaattgtagcaaatgatatgtgaaagaatgttcattgtagcattattaataatagctcaaaaataagctgcccaaatatatatcaaataaagatggataaataattacagtaaaatcataaaatggaaaaatatacagaagtgaaaataaatgaatcacatgtacatgcaaccatgtgattaaatttcagatacataatgttgagtccaggaagccatgaataaggacatataggattgcacctatacacagttcaaagcagaccaaacgaagctattgagtttagggttgcatgctttgttcgtaaagtacaaagaaaataaaaaaagatcattataaattatggatgtacttatcataagaggtgtgaagaaaggtgtaggggattggaaagtggcattgaggtaaacctagcctcttagcaatgttccatgtctcgccctacataatggttacatgagtgtttatgatacattgctatgttttccatttttgttttggcccatttctaagtgtgtagtctagttataaaaattattaattaggagaaattttccatgaaaattattattaccctgctcattatatactgaagggaaaaatccactatttgtatacattcatgtataactctaagagattttaagaagaaactttctgattttagttgcaacttttggaaatttgacatgatgtttcctgccaaccccagatttttcaacaggtttttcttttaggtttaattattgacttcatatgacaaaactttgacattctccaactatttttcccttgtatcctgaattcctgacacaacaagtgtggacatatttcccacacttttggtttagcagaatacctatgtcacttatgtttttctgcaagagaaaatcctccaaaactacattagatatttgtatctcatatgtctttggatttcatttttctaagctgggtttgatggatggctgtggtgattggagatgggccacgtactgcatcttgaagatagagtttggatgatttaggctagatcaggcagtggcattctgactccattagtttctcattcttcttctgggaacagtgtaatagccagatgatgtccttatggtaaatggaaaagagcaagaaactccaatgtggaagccatcttaaatctctgtgtaaagtctactaatttcctgttcattgaagcaagttacaggagtgcacacgcatatatatatgtgtgtatatgtgtgcatgtgtatgaataacaacactgaccataaattatgaagccgagtacatttcacatatatatgtatgtttattatatgatagtttattgtatgatatttcatttgaagaattatctctatttataattaagaacatatagcttttatcagcaaattattgctgttttccattgtaatttgtaccacatgtatgaacttaactatcattgtttgaacatctaattttttggatggtaaagacattcaactctaaatcaatgaggagaatgtatctttggggtaggttttatttcattatgaattcttattttatgttgttgttagataatgatgcacacaattaaatttgagtgacaaacatatgtagagtaaattttgtatatatataccaaaaacagtactaaagaatactagatttataccagtatgtgaatagcttagaaaaaaaattcgtttgtataataggaatgaagaaacataatcatgatcatttcagtgctgttataattttttatgtgtagttagaaaagagatttcttccactttttaattaaagaaagccttttttgaagttgacatctgatgtcaagtatttccatttaatttgcttagccacctctgagcccctgaatttccaattatctcctttgtctcccattcctaatattcctcaaaaaaattcaaatattccttctcttaaaaaaaactcaatgtaaagagggtatagaaactatggatcataactgaatgaaacattctgcaaatattacaaattatctgtctaatcaatatattgatgataggaaacgtattaatgatatgttttattgggggtgggcagtgagctgaggatcctcaggcatctctatttttattttgtttctctacgtagtttctccagcatttggctctaggtgccaagggcacatgtgacaagaaggtgccagctttataaaccttgtaacttcttctgtgtcagttctgagacatacaatttactaaaacacatcatgaaggcctgttttgaagagaaggggaataagactgcatctgttcatatgaggtatgtcgaagcacttggatatgttttcaaaccaccaatcttgatgatttagaaatgtgctcccttttccaatttcatcctgataaaaatgtatgatctctggacgttgccaatattcccctccattccatcatgagccgttctctgtaattcagaatctgtggactaagctgtaaaactaatgactgtcaatctattctacatgaaatagtgggccaaagaaaaaggaaaacatgataagcagtaaaaatatatacacaacattttttgcttacactaatgatcaaataacacccataggaccaaacctcccacagatactttctataaattctggataaaatatttaaaaaaaaaacagccatctgaaggcaatggagaatgaacaaaataggccgatactgaaaagcagttgacacttggaagaaggaaatagcaaggagtgagtttcctgattttatagctggccctagtgtgcaccaggcagaggactaaaacgtcagtaaaaaagctgtagagttactgggttgaagtaacagaggactgagtttagggtaacatgagccgcaggaggtcaggagaaaatctgagaaaggagaagtccagaaaaggggagccccagcttctgactataaactatccaaagctttgtctggtccctacaccacacatgtataggcagacttcatgaagcccagctaaaataataaaattgatttcagttatcatcaagcacagtgaggacagaaatagcaacaaaacacattactttaggcaaagatactcttttcttgaaaacccaaactacattccattacctttcataacagtcatattccttgtccattcttgtttctaccatggttctaactcctacttttattcattacattaatcaaagtaattctctttcaaagaggaaactggaagttatgtaattgaggactattaaaaataagtattttggcagatgtgcaaaattctcaagcacatatattacaactttctatagtcatatacatcctttttacacttgcttgaattggcatacaaaactcccatgtttgttaatgtaatccaaacaaatagccagtccataaaatataaaagttacatttagttatttatttatataacccgtgattggtgaccacatttcagtattccatcttaactagtaattatccaaagattttcatgaagtcactgaatctaatattagtctaaggtcttgaactaggaatcttggaaattaaatttaagacaataggctacagaaaataattactgtcaatatgtggaatttttcataatttgtattcagtttgtttgaaaacataattttacattttttggtattttaacattatgtgggcatattagtttaccttatcagtaaacaggtatgggaagtttaggaatttcttttttttaaatgtatttttaagttttgtggatatatagtaggtctatattgagtacacgggatgtgttgatacaggcatgcaaagagtaataatcacataagaatggggtagccatcccctcaaacatttactcttttttgttacaaacaatccagttatactcttttagttacgttaaaatgtacagctaaattatcattgactatagtcactctgctgtggtatcaaatagtaggtctcattcactctttctattttttttttttggtagccattaaccagccacaccttccctttagcccccactacctttcctagcctttgttaaccatctatgtactctctatgtccacgagttcaattgttttgatttttagataccacagatgagtgagaaagtgcaatgcttgcctttctgcacaaacattgcagttattttttacttattcaacttaacataataatctccaattccatccgtattgctgcaaatgacaggatctcattttttaaatggctgaatagtactccactgtgtatatgtaccacattctctctccctcttttttttttttttttttttgagatggagtctcgctctgtctccaggctggagtgcagtggcgcaatctcagctcactgcaacttcagcctcccaggttcaagtggttctcctgcctcagcctcctgagtcgctgggactacaggcgccagccaccacgcccagctaatttttttgtatttttagtagcgatggggtttcaccatgttggccaggatggtctcaatctcttgacctcatgatccacccacctcggcctcccaaagtgctgggattaccggtgtcagccaccgcccccggccataccaccttctctttatctattcatctgttgctggacactttgattgcttccaaatcttggctattgtgaacagtgctacaacaaacatgggagtgtggatacctgtttgatacacttacttcctttcttttgggtatatacccaccagtgagattgctggatcatatggtaactctaattttagtcttttgagaaacctttaaactgttttccatagtggttttactaatttatattcccacctgcggtgtacagtggttcccgtttctccacatcctcaccagcatttgttactacctgtcttttgtatataagctgttttaactgggatgagatgatatcttattttagttttgatttgcatttctctgatgatcaatgatgttgagcaccttttcacatgtctgtttgacattcgtatatcttgttttgagaaatgactatccaaatatttcacccatttttttgatcagattgttagattttttttcctatacagttgtttaagctccttttatattctggttattaatcccttgccagatgagtagtttgcaaatattttctcctattctgtggattgtctcttcactttgttgatcatacctttgctgtgcagaagtattttttaacttgatgtgatcccaattgtgcattttttacttggttgcctgtacttgtagggtattactacttaagaaatttttgctcaaaccaatgtcctggggagtttctctgatgttttcttatgggagcttcatggtttgagatcttaatcatacatctttaatccattttgatttgatatttgtatagatatatgggcctagtttcattcttctgcatatggatattcagttgtcccagcaccatttattgaagagactgtctttttccagtgtatgttcttggcatctttttcaaaaatgagttcactgtaggtgtgtgggtttgtttccgagttgtctgttctgttccatcgttctatgtgtcagttttaatgccagtacatgctgttttggtttctgtagcctcagtagtaagtatcatatgaagtcaagtaacatgattccttcagttttgttcttttttcttaggatagttttggctattctgggtcagttgtggctctatataaattttaggattgttttctctatttctgtgaagaatgtttttggtattttgataggaattgcattgaatctgtagattctttgggtagtatggccattttaacaatgttgatacttctaatccatgaacatggactatcttttctttttttgggtgtccttttccatttctttcattagagttttatagttttcattatagagctatttcatctctttggctgagttaattttcaggtatttaattttatgtgtgacctttgtaagtgggattacttttttgattttgttttcaaattgttcactattggcatgtagaaatactactaattttttatgttaattgtgtattctgcaaatttactgagtttgtttatcaattctaatagtttttggtacagtcttcaggttttacaaatataagatcatattgtttacaaacaagcataatttgacttgttcctttcctatgtggatgctctttatttttcttgagtgattgctctagccagagcttctactattatgttgaataatagtagtgaatgtgagcattcttgtcatgttccagatcttagaggaaagccttttagtttttcccaatttagtatgatactagttgtgggtctttttatgtgatttttattatgttgagattttccttctatatccagttttctgagggtttttatcatgaaggaatgttgaatcttatcaaatgctttttcagcattaattaaaacgtttatatggttcttgaccttcattctgtatatatgatgtatcacattgattgatttgtgtatgttgaactatccttgcatcctagggataaatcccacttgttcatgaggaaatatctttttaatgtattatttaatttggttcactagtatagtattgagactttggaatcaatattcatcagagatatgtgcttgttgttttcctttttagatgtgtctttgtctggttttggtatcagggtaacaagaatttcaagaatgagcctggaagtattccctcttcctctgtttttcagaatagtttgtgtaggattggtatcagttattctttaaatgtttggtagaattcagctctaaagccatctgctcccaggctttgttttttgttttttgtttgttttgttttgttttgttttttctaaagtgggagactttttattgcagaattaatctcattacctgtttttggtcttatcaggttttggatttcttcatggttcaatctttgtaggttgtatgtgcctgggaatttttccatttttttagagatttcaatttattggcatatagttgctcatagtagtcactaataattctttgaatttcagtggtatcagttgtaatatctctgctttcatgtctgattttattaattttgatctttttttcttagtcggcctgaacgtttgtcaatgttgtttaacttttcaagaaaacaggtttttgtttcattgatcttttgtattgttttcttcatttcaatttcatttatttctgctgtaatttttattatttgtgttcttctactaattttgggcttgggttactcttgttttttcagttatttaagatacacatttaggttgtttatttcaagtttttcttcttttctgatgtaggcccttatagctataaatttccttcttagtattgctttcgctgtatttcatagattttggtatgttgtgtttccactatcatttgtttctagcattttttcaatttccttttaaatttctttgatgacctactggtcattcaggagcatattgtttcatttccatgtgtctgtatagtttccaaaattcctcttgttattgagttctagttttattccattgtggtcagagttgatgcttggtaatatttcaattttttggattgttcaagacttgttttgtgatctaacatatggtctatccttgagaaaaatccatgtgctgaggaaaagaatgtttattctgaaacttttggatgaaatgttatgtaaatatctgtaatcaatttgttctatactgcagattaagtctgatgtttctttgttgattttctgtctggaggatctgtctgatgctgaaagtggagtgttgaagtctccatctattattgtattgaggctttctctttgctttggtctaatagtatttgctttatatatctgggtgctccagtgttgagtgcatatatatttacaattgcaatatcattttgatgaattgacccctttatcattatatggtgacctttatctcctcatagtttttgtcttgaactctattttgtctaatacttgtataggtactccactttttttggcttccattgccatgaattatctttttccatcccgttgttttctttctgtgcatgtctttatagacaaagtgtgtttcttagaggcaacagattggtgttttgtttgtttgtttgtttttccatttagccagactatgtcttttgattggagagtttagtccatttacattcaatgttagtattggtagttaggacttacttttgtcattttgttatttgttttctggttatgttgtggtctgctcgtctttctttcctaccttcctatttttctttagtgaaggttattttctctggtgatataatatagttttttgctttttatgtttgtgtatccattctatgctttttggtttgagattaccatgaggcttgcaaatactaccctctaacccattatttcaagctgataacaacttagcactgttcgcataagcaaacaaacaagcacaaaaacaaaacaaatgaagactctgcaccttaactccatcttcttcatttttaactttctgttttcactatttatttcttattgtactgtgtatgtattcaaaggttgttgtggctattatttttttaattatactttaacttctgggatacatgtgcagaacgtgcaggtttgttacatcggtgtacatgtgccatggtggtttgctgcacccatcaacccgtcatctacattagatatttctcctaatgctatccctagcccccctcaccctaaaaggcccagttgtgtgacgttccctgtgtcctccctgtgtccatgtgttctcattgtttagctcccaattatgagtgataatgtggtgtttggttttctgttcctgtgttagtttgctgagaatgatggtttccagcttcatccaggtccctgcaaaggacatgaactcatccttttttatggctgcatagtattccatggtacatatgtgccacattttctttatacagtctatatttgatgggcatttgggttggtcccaggtctttgctcttgtgaacaatgctgcaataaacatacatgtgcatgtgtctttatagtagaataatttataatcctttgggtatgtacccagtaatgggattgctggatcaaatggtatttctggttctagatccttgaggaatcaccacactgttttccccaatggttgaactaatttgcactcccaccaagagtgtaaaagcattcctatttctccacctactctccagcatctgttgtttcctgactttttaatgatcaccattctgtcatgagatggtatctcattgtggttttgatttgcatttctctaatgagcagtgatgatgagcttctttctttcccatattttcttgggcacataaatgtcttcttttgagaagtgtctgctcatatcctccacccactttttgatggggttgtttgtttaatagattgcaaaaattttctcccattctgtaggttgcctgtcactctgatgatagtttcttttgctgtacagaagctctttagtttaattagattccatttgtacattttgtcttttgttgcaattgcttttggtgtttcagtcatgaagtctttgctcatgcctatgtcctgaatggtattgcctagcttttcttctagggtttttatggttttggatattacatttaagtttttaatccaccctgaattaatttttgtataatgtgtaaggaaggggtccagtttcagttttctgcctaaggctagccagtttgcccaacaccatttatcaaatagggaatccattccctcactgcttgttttttgtcaggtttgtcaaaatcagatggttgtagatgtgtggcattatttctgaggcctctgttctgttccattggtctatatatctgttttggtaccagtaccatgctgttttggttactgtagacttgtagtatactttgaagccaggtagtgtgatgcctcctgctttgttctttttgcttaggattgtcttgactacacgggctcttttttggttccatgtgaatttctaagtagtgttttccaattctttgaagaaagtcaatggtatgaaatgtttttccatgtgtttgtgtcctctcttatttccttgagaagtggtttgttgttctccttgaagagatctttcacatctcttcttagctgtattcctaggtattttattctctttgtagcaattgtgaaatggagttcactcatgatttggctctctgtttgtctgttattggtgtataggaatgcttgtgaattttgcatgttgattttttatcctgagactgctgaaattgcttatcagcttaaggagatttggggctgagatgatgggtttttctaaatatacaatcctgtcatctgcaaacagagacagtttgacttcctttctttctatttgaataccctttatttctttctcttcctgattgtcctggccagaatttccaatactatgttgaacaggagtggtgagagatggcatccttgttttgtgccgattttcaaagggaatgcttcccgtttttgcccattcagtatattggctgtgggtttgtcataaatagcacttaatattttgagatacattccatcagtacctagtttcttgagtgtttttagcatgaaggcatgttgaattttatcaaaggccttttctgcatctgttgagataatcatgtggtttttgtcattggttctgtttatgtgatggattatgtttattgatttgcatatgttgaaccagccttgcatcccagggttgaagacgacttgatcttggtggataagcctttttatatgctgctggatttggcttgccagtattttattgaggattttcgcatcgatgtttatcaaggatattggcctaaaattttctctttttgctgtgtctctatcaggttttggaatcaggatgatgctggcctcataaaatgagttaaggagtagtccctctttttccagtgttttgaatagtttcagaaagaatggtaccatctcctctttgtacctctggtagaatttggttgtgagtatgtctgttcctggactttttttggttgctaggctattaattactgtctcagtttcagaacttgttattggtctattcagggatttgacttcttcctggtttagacttgggatgttgtatgtgtccagtattttatccatttcttctaaattttctagcgtatttgcatagaggtgtttatagtattctctgatgatagtttgtatttctctgaagtcagtggtaatatctcctttattattttttattgtgtctattggattattctctcttttcttctttactagtctggctagctgtctttctattttgttgaacttttcaaaaaaccagctcctggattcattgattttctgaagggttttaggtgtttctatctccttcagttgtgctctgaccttagttatctcttgtcttctgctagcttttaaatttgtttgctcttgcttctccagttcttttaattgtgatgctagggtgtcaactttagatctttcccactttctcctgtgggcatttagtgctataaatttccctctaaacactgctttagctgtgtcccagagattctggtacattttgtctttgttctcattggtttcaaagaacttatttatttctgtcttaatatcgttatttactcagtagtcattcaagagcaagttgttcagtttccatgtagttgtgcagttctgagtgagtttctgaatcctgagttctaatttgattgcactgtggtatgagagactgtttgttatgatttattttgttttgcatttgctgaggagtgtttcacttccacttatgtggtcagttttagaattagtgtgatgtggtgctgagaagaatgtgtattctgttgatttgaggtggagagttctgtagatgtctattaggtcagcttggtccagagctgagttcaagtcctaatatccttgttaattttctgtctcattgatctgtctaatattgactgtggggtgttaaagtctctcactattattgtgtgggagtctaagtctctttgtaggtctctaagaacttgctttatgcatctgggtgcccctgtattgggtgcacatatatttaggatagttagctcttcttgttgcgttgattcctttaccattatgtaattctcctctttgtcttttttgacctttgttggtttaaagtctgttttatcagagtctaggattgccacccctgctttcttttgctttccatttgtgtggtaaatattcctccatccctttatgttgagactatttgtgtctttgcacatgagatgggtttcctgaatacagcacaacaatgggtcttgactctattcaatttgctggtctgtgccttttaattggggtatttttcccatttacatttaaggttaatattgttatgtgtgatttttttcctataattatgatgctagctggttattttgcttcattagttgatgtagtttcttcatagtgccagtggtctttacaatttggtgtttttctgaagtggctggtactggtttttcctttccacatttagtgcttgcttcagaagctcttgtgaggcaggcctggtggtaacaaaatctcttagcatttgcttgtctgtaaggattttatttctccttcaactatgaagctttttggcttgctatgaaattctgggttgaaaatccttttctcgaagaatgtccccactctcttctggcttgtagggtttctgccaggagatctgctgttagtctgatgggcttctctttttggtgactcagcctttctttctggctgttcttaacattttttccttcatttcaaccttggtgaatctgactattatgtatttttgggtgctcttctcaaggagtatctttgtggtgttctctgtattccctgaatttgaatgttggccagtcttgctaagttgggtaagttctcctggataatatcctgaagagtgttttccaactttgttccattatccccatctctttcaggtacaccagtgaatcataggtttggtcttttcacatagtccaatatttcttgaggctttgtttgttccttttcattcttttttctctaatctcatcttcatgcattatttcattaaattgatcttcaatgtctgatatcctttcttccgcttgattggttcacctattgatatttgtgtatgcttcacaaagttctcatgctgtgcttttcagctccatcaggtcatttatgttcttttctaaactggttattccaggtagcaattgctctaaccttttttcaaggttcttggctcccttgcattgggttagaccatgcttctttatctcagttgagtttattacccaccttctgaagcctacttgtgtcaattcatcaaactcattctctgtccagttttgttcccttgctggtgaggagttgtgatcctttggaagagaagaggcttccggtttttggaattttcagccttttttgccctggtttttcctcatcatcatggatttttctacctttggtctttgatgttggtgaccttcagatggggtctctgtgtgtacatcctttttgttgatgttgatgctattcctttttgtttgttgattttccttctaacagtcagggtcctctgctgcaagtctgctgtagtttgctggaggtccactccagaccttgtttgcctgggtatcaccagtggaggctgcaaaacagcagatattgctgcctgttccttcctctggaagcttcatcccagagggttacccgccagatgtcaggcagagctctcctgtatgaggtttctgtccaccattgctgggagatgtctcccagtcaggaggcacagaggtcagggacccacttaaggaggcactctgtcctttagcagagctcaagtgctgtgctgggagatctgctgctcttttcagagtgtcaggcaggaaagtttatgtctgctgatgctgctcccacagctgccccttctcccaggtgctctgtcccagggagatgagagttttatctataagcccctgactggagctgctgcctttctttcagagatgccctgaccagagaggaagagtctagagaggcagtttggctacagtggttgtgcagagctgctgtgggctccacccagtttgaacttcctggtggctttgtttacaccgtaaggggaaaattgcctactcaagccccagtaatggcggacgtccttcccttgactaagctcaagcatcccaggttgacttcagactgctaaactagcagtgagaatgtcaaaccagtggatcttagcttgctgggctccaaggaggtgggatccactgagctagacaacttggcttcctggcttcagccccctttccaggggactgaatggttctgtcttgctggcattccaggcaccactggggtatgacaaaaaacttctgcagctagcttggtgtctgcccaaatgatcgcccagttttatgcttgagacccatggccctggtggcataaacactggaggaaatctcctggtttgtgggttacgaagaccatggggaaagtgtagtatctgggccagaatacatcgtccctcactgcatggtcccttacagcttcccttggctaggagagggagttccccgaccccttgcacttcccgggtgaggcaacaccacaccctcctttggctcgtcctccgtgggcttcacccgctgtctaaccagtcccaatgagatgagccatgtaactcagttggaaatgcagaaatcacccaccttttgtgttgatcttgctgggatttgcagactggagctgttcctattaggacattttgccagccactccactattttttttcattattacttcatcatttagtttttctatttaagtgatgtttatgcaccacatttacagtgttatattagtctgtgttttctgtctccttactattacccgtacgttttatagcttcaagtgattacttattgcccattaatgtccttttctttctgactgaagtaatccgtttgaaatttttctaggagagatctggtgctgatgaaatcactcagcttttgttggtctggaaaagtctttatttctctttcacgtttgaaggatattttctccagttacactattctaggctgaaagttttctttcttcagcacttttaatatgtcataccactctctgcacttttaatatgtcataccactctctcctggcctttttccactgaaaagtctgctgccacatgtagtggagctccattgtacattatttgttccttttcttttgctgctttcagaatcctttctttatccttgagcttagggaaattgattattaaattctttgaggtagtcttcttcaattttacccagcattgtttgttgagaaaaaccattaattcctatcaaattgcagtagtcccttttttgaaatcaattgaccatgaatgttggtgttaatttctggactctcagttgtgtttcattgttctttttgtctaccctaatgcgagtaccatagaatcctgattcgtgcagctttgaaggaagctttgaaatcagaaagtgtaatcctccaaatttgttattttttaacaatttctttttgtgatcttgtcacttggcatttccagacacattttaggagtagttttccactttctgtgataaaacatctgctgggatttgatagggattgcactgaatatataactgcaatctataaagactctccctgtgctggatttcagttcagctggtcattcttgcttgtacaactctgtgacaaattgaaaatataattttggccttttatttctcttatcttaattgtagcagaaggtatcatgcttttctgaaccttgtgcattctgcccaaaaatggaagttctcagccacgtgtggttgttcacacctgtatccaagcactttgggaggccaagatgaggggaccacttgagaacaggagttgaagaccagactgggcaacatagggagactctgtctcaacaaaaaaattaataaattagctgggtgttgtgatgcatgcctgtagacacagctactccagaagctgaggtgggaggacacaaatgtttgagactggagtgagctgtgatcaagccattgcactccagcctgggtgacgagtaagaccctgtctttctcgctcccctaccccaaaaaagaaggtctcactggttatcttttatgtatcaagtaacacacgatcatacaaaaaattaataattcttggttcctgcctgtactagacagataaaattgaaagcagttatacaactagtatactaactcctcataaagactacctgaagagaatattattatcatttgcattttacagatgattataccaaggcagagagtagttgtcaaatgaagtctcagaccatatttgaagcagaaaatctgctttcctgtcttggcagtctgactccacaatcttctgttagaaacaattatactgtaaaaatggaaaagaaataaaatccaagattggagactgattttaacatcgattcctcttaaaccattaagtaatcaaaaataaattaagtaatcaaaaataaattaaatagagaaaaataaaaccaaatattcatatatgaagatctagactcttcaatggaaaacgtgttttttaagtagcccacaatagttacacaattgctgagtattttaactaaaaaattaatatttaacaattaagtaaactcaagagaaaaacttagtcaaaggtctcagcatgagagataagtttgaaaaatattgaaaatgggttgaaaagcccaaatgggaaaatagggctatttttacctggatgatgtccctgaaattaattttccattttggaaattataggacaacaatttcttctatccatgagtgagtgagtatgtgtgtatgggtttgagtgtgtttgtattaatgagcttcttaagaataagttattcaaaagtattagtagcaaccgggttttaagaattattggcctttctgagattcccaagaaaaacttgaatccttttgctaggaaaagtttggattcactctacatattactcacgttgaaaaattaaatttactttggtgatgatcctagttatgtccaagctccctttaccaggttatacaaccagtgtgtcatctctgtattaggttgtaaaatttctctaacaactgaagttgctgaacacaaattgtggagaggttaaacaaagaaataagtgcagaacaattaaaaaactcttcattggcatgctagtagatgagaaatcacttttcacttcaacaccaatatggaaaattttatcttacagcaaggacattgtgtttgaataggagttaatttgagctgttttggaaatcatcatgttttccataaagacagcattgatttcatccactggcatattgagatgctttcctgtttgacattggtcacagaatttaaaaaggaacaagaacattcctgcaaattcaggaatcaggtacacatagatgttaaggtcaagaccttaaaggaaatcttgaccagtgatatcaggcttgcctttaaaaaaattcagacatgataaatttactaccaatcattttttcttcaacaataatatatttatattttcccatggacacctacattaaacttatagactctttttatttttcaactttttttctttgagtccttttaagagttgttaaacaatcctgaaatttcccttactgtatgctgttaactaattatattttttcaaagtcatctgacacaatgattgattaaaggaagtatctccagtataattacagttacttataacaagagtatttgaaatttgaagaaaaaggttagacaatttataatgaaatataaataaatatgtataatatataaggcattattaataagtgtatatgaaatagtcatagaatgaaaaagattaatgtaattcattgaagtaaacatacattctgaataagaatagaaaaggacttggaaaatattgtttaataatattttatataaatacaaaaatgtatatattagcccaacattatttattttggaaaggatatgacacaatgggaattttcatacactactcctagaattataaatctgtgccatcatttcggctgagtatggcattatctcattaaggtgaaggatcatatcctaagatcaagtatttacactcttatcagaatacatatacatacacatgcatatcactgagtttcaatagctaaagttgagaagtcctccaaatgtctcagtcctccaaatggataaagaaattgtggcatacttatacagtggaatactgtacagtgatcaaaattaacaaacaagactgacatgtttacaacagaataatacaacaaagaaaatgaacaaatttgagctacatagataataatactcacagatgtgagaggaattatcaagatggaaaaatacatttactgtaatctcatcgacgtaaagtttgaaaaactttatttttaatacattgtcattcattacattggtgataaaaccctacagtgaaacatatgagtgatcatcatatgagtgatcatcataacaatttgggatagtcagaagggaggaaaatatcaacaagaagacatatatcgggagtatctggattgctagcaaattctattttcttccttttttttttttttttttttttactctttcatttggatcttatctgtgcgaagtatctttgactgtgttggtcaccgttgaatcaaatatctaaataaagtgaatctggaacatcctagtgtccacatcaaaagcactcaataaagttggatgggggagtggtagtggtggtacagcaacagggtagcctagttaggttgcacaagcccatctaaacacgtgtgattatctgattagaaccaggaaactggttactagaaaaagtaatttagtgaactgtagaaagaaaatattacatattgaagcacctcacaatgacttaacaccaattttatttgaggaatttctttagtgttaaaatacagtaaacagccacagtaacagtaataccactaacattcttgagcatttattgtgtgcttagaaatttgtgtatgaattcatttaatatagtcctatggcttaacacgagattttgttcatttttttaatattttatttatttatttatttttattttactttaagttctagggtacatgtgcacaatgtgcaggtttgttacatatggatacatgtgcttgttggtgtgctgcacccattaactcgtcatttacattaggtatatctcctaatgctatccctccctcctccccccaccccacaacaggccccagagtgtgatgttccccaccctgtatccaagtgttctcgttgttcagttcccacctatgagtgagaacacgtggagtttggttttctgtccttgcgatagtttgctcagaatgatggtttctagcttcatccacgtccctacaagggacgtgaactcatcattttttatggctgcatagtattccatggtgtatatgtgccacattttctttatccagtctatcattgatgggcatttgggttggttccaagtctttgctattgtgaatagtgctgcaataaacatatatgtgcatgtgtctttatagcagcatgatttataatccttcgtttatatatccagtaatgggatggctgggtcaaatggcatttctagttctatatccctgaggaatcgccacactgtcttccacaatgtttgaactagtttacagtctcaccagtagtgtaaattgttcctatttctccacatcctctccagcacctgttgtttcctgactttttaatgattgccattctaactggtgtgagatagtatctcattgtggttttgatttgcatttctctgatggccagcgatgatgagcattttttcgtgtgtcttttagctgcataaatgtattcttttgagaagtgtctgttcatatccttcacccacttgttgatggggttgtttgatttttttcttgtaaatttgtttaagttctttgtagattctggatattagccctttgtcagatgggtagattgtaaaaattttctccttctgtaggttgcctgttcactgtgacagtagtttcttttgctgtgcagaagctctttattttaattagatcccatttgtcaattttggcttttgttgccattgcttttggtgttttagccatgaagtccttgcccatgcctgtgtcctgaatggtattgcctaggtttacttctagggtttttatggttttaggtccaacatttaagtctttaatccatcctgaattaatttttgtataaggtgtaaggaatggatccagtttcagctttctacatatggctagccagttttccagcaccatttattaaatagggaatcctttccccatttcttgtttttgtcaggtttgccaaagatcagatggttgtagatgtgtcatattatttgtgagggctctgttctgttccattggtctatatctctgttttggtaccagcaccatgctgttttggttactatagccttgtagtatagtttgaagtcaggtagcgtgatgcctccacctttgttcttttggcttaggattgtcttggcaatgcaggctcttttttggttccatatgaactttaaagtagtttttttccaattctgtgaagaaagtcattgttagcttgatggggatggcattgaatctataaattaccttgggaagtatggccattttcatgatattgattcttcctatccatgagcatggaatgttcttccatttgtttgtatcctcttttatttcattgagcagtggtttgtagttctttgaagatttccttcacatcccttgtaagttggattcttaggtattttattctctttgaagcaattgtgaatgggagttcactcatgatttggctctctgtttgtctgttattggtgtataagaatgtttgtgatttttgcacattgattttgtatcctgagactttgctgaagttgcttatcagcttaaggagattttgggcagagaagattaggttttctaaatatacaatggcaaattctattttcttaccaaggtatggtaacatcaattttaaccttataattttttatcttactgtttattagttgttattactctgtatctgtatgttttgctccacaataaaaaatgttaaaaaagcagaaacctaaagtacatttctaagtgtaaaattagggtgatgcagcatattcttatagatatcattgtaattagagtttttgctgaataaagaatagaggattatggtactaagaaatccaagttaaaatttaaaacttttctatttttattttgagacaggatctgactctgttgtccaggctggagtgcacaagaacaatcttggctcaatgcagcctctgtcaccttggctcaagtgattctcccatcttagcctccagagtagctaggacaacaggcgtgcaccactacgccctgctaattttttctatttttttgtagagacatggtttttccatgttgcccaggcaggtcttgaactcctgtgcttaggcaatccacctgcctcagcctcccaaatgatgggattacaggtgtgagccaccacacctggcccaaaacattacttaaattaattcacacaaaagaagagataggcaagaattgttaatccactttcttagtgctaatatgaatttgaaacatcaaaatttgaatatccatgattgatagacaccttttttcttatttccaatttaattatttttgatacacatttgaaagtgtaagaaattcaggaatttacaataaattatagtacgatggatattaaatatattaaattaaatgtattaaaaatgtgtctctaaatgaaatatttatattcacattgttagcattctaatttcactatactattcctgtgtacaccagtgtgttgggtaaaattttttgttactataaattttttggctgtccattagagaaaaaaatcatagaaaggcaaattttttaaggtataaaaaataatttagcctgatctttgagtatgtttgtgcacatataatgctactttgactgctgtagtaaaataatccagatttagtcaccatagctaagaatgagaaaaagcatttgtgatagtttgctgagaatgccgtcattttttgataaagttttaagtactgttttactatttgatcttttaaagattgttaaaaactaagaagtgttgatttctgctaataaaaacagcttaaaatttatatcatggaatagaatggtggagctgtggcggagatactttgtcttattaattgaaatgacattttgagatccagtgctgctcactgaatttccctgtgaggagagtttgtggtgatgaccccacaacagacaagctactatccaaaaaaactcctcacatcaaatcaatttccagtttcttccaagttgcaggaggatgcctagaccttggttttattctcttctttgaccaaagtattacaaaaggaagaaaatcattaccattttcatgtcaggagggtggcatggagatggacttagcctattttcggtgttccatctcttgccctttataagggttagttgactgtttatgatacattccggtatttcccatttttgttttggttcatttctaagtgtgcattataattttaatattaaagtttttgattaggagaaatgtctcatagaaattattattactcatctgattatatactgaagggaaaaatcaattagttgtatatacattcttatacaactctaagatagttgaaataggaactttcttatttagttgcatcatgaggaaatttgagatgatgttatctgccaagcgcagatctctccaaaggatttcttctagccttaattatccacctcacaggacaaacctttgccattccccatctattttttctttcggctcctcaattcctgacacaacaaagttgtacatatttcccacactcttggtttagcagagttcttttatcagttatgtttttctgcaagagaagaccctctaaaacattagacatatatatctcacatgtctttggatttcatttgtgtgtgtgtgtgttttctgttttttgagatggagtctcactctgttgcccaggctggagtgcagtggcactatcttggctcactgcaacctccacctccagggttcaagcgattctcctgcctcacccttctgagtagatgggactacaggcacactccactgagcccacctaatttttgtatttttagtagagatggggtttcaccatgttggccaggatggtctcaatctcttgacttcgtgatctgccctcctcagcctcctccacacctggcctggatttcatttttctaagctgggtttgatggatggctctggtgatttgagatgggccaaattcggcatcttggagatagagtttggccaatttagtctggatcaggtgggggcaatctgactacattactttctcattctccttctgggaacagtgtacttgcgaggcgatattctcatggtaaatggaaagaggaagaatccccagtatggaagccatctcaaatctctatgcaaagtgtagtaattttctgtttatcaaagtaagttaaatgattgaactccaagttcaggggaaaggtagtcagtcttcctgtgataggaggatactgcaagattatataccaaagggtcgggtactcaggaattcttataaaatggctaaatattttatataataataaatatttaaacattagacttgagagaaactttaccaaaggcctaagaattagagatatgtttgataaataaatattattcatgggctgaaaactcttgagtgggaaaatagggctaatttcatctggacaacttcttggaaactcattttttattttggaaattatgagaaaataatttgttccattcataagtggtgtgcacatgcgtgtatttgtgttcatatttatgagcttgtgaataatgaagttatacaaaagtattagcagcaaccaaatcttatggagtattggcctgcctgtggttctcaagaaaatcttagatgcttttgataaaagcagtttggattctgtgtatacaaatctggcattttaaaaagtccatattggtaatgatcttagttgtgaccaagctccctttaagactttagacatttgctatatgatctatgtattgggttataaaacttcccaaacaactgaagttgctaaacacaaatgatggagaggttacacaaagaaaaattgcaaactctgaaagagagtacattcttatttgtgtactagcaaatgaggattcaggtttccagtcaatttcagtatgaataattctagcctgtaacaagaacaaacagtgaatgaatgagttaatttgagttgtttgaaaataagaatgttttccataaagagatcattgaactcatcagttaacacgccatggtgatttctggcttgacactggtcacaacgtttaaaagtaaaaagaatgacccagcagatttacaaattaggtgcatatagaatttaaggtcaggatattcaagcaatcacaaccagtgatattacattgagaggtgaagccagctggacttcctgggtggagtggagatttggagaactattctgaagctagcaaggggattgtaaaatgcaccaatcagtgctctgtaaaaggcaccaatcagcactctttaggtagcatggggattataaaatgcaccaatcagcactctttaggtagcatgggaattataaaatgcaccagtcaacactctgtaaaaatgcaccaatcagcactctagctagccagaggattgtaaaatgcaccaatcagctctctgtaaaaggcaccaatcagcgctccataaaacgcaccaatcatcaggatcctaaaagtagccaatcacagggaggattgaaaaaagggcactctgataggacaaaaatggaacatgggaggggacaaataagggaataaaagctggccattccagcccacggggcagcccacggggcaacccactcaggcccccttccaccctgtggaacctttgtccttttgctcttaacaataaaccttgctaccactcagtctttgggtccacaccgtctttaagagctgaaaccttgctactgctcagccctggggccatgccatctttaagagctgtaacatcactgcaaaggtccgtgcctccattcttgaagtcagcgagaccacgaacccacctgcaggaaccaactccggatacaacaccagcattttaaaaatttctttttgtctgttcagacatgataacttttctgcccatcatattttccattctagtagtggttacatttgttattggaaattttgctaatggcttcatagcgttggtaaattccaccgagtgggtgaagagacaaaagatctcctttgctgaccaaattgtcactgctctggcggtctccagagttggtttgctctgggtgttattattaaattggtattcaactgtgttgaatccagctttttatagtgtagaattaagaactactgcttataatatctgggcagtaaccggccatttcagcaactggcctgctactagcctcagcatattttatttgctcaagattgccaatttctccaaccttatttttcttcgcttaaagaggagagttaagagtgtcattctggtggtgctgttggggcctttgctatttttggcttgtcatctttttgtggtaaacatgaatcagattgtatggacaaaagaatatgaaggaaacatgacttggaagatcaaattgaggcgtgcaatgtacctttcagatacgactgtaaccatgctagcaaacttagtaccctttactgtaaccctgatatcttttctgctgttagtctgttctctgtgtaaacatctcaagaagatgcagctccatggcaaaggatctcaagatcccagtaccaaggtccacataaaagttttgcaaactgtgatctccttcttcttgttatgtgccatttactttgtgtctgtaataatatcagtttggagttttaagaatctggaaaacaaacctgtcttcatgttctgccaagctattggattcagctgttcttcagcccacccgttcatcctgatttggggaaacaagaagctaaagcagacttatctttcagttttgtggcaaatgaggtactgagtgaaaggagagaagccttcatctccatagattcagaagaggggcattgtgtgtcttctagcagaaaacaaactggtggtgtatgaaacattttatatttcttacagtgttttctgtaatgtatgtgtatgaataatttccaaacatatacctagataaatctttaacctagtctaaaaaatgtatgtatgtgtgtgtgtatgtgtgtgtgaaaaacttaagaacattgacaataacatactcttttttgtttttttcatatgaactgccagattatacaaaatatgacaaaaattcctcagaattatgaagccatgtgtatttcattcatgtattttatctttcatttgtagaatttacaatgtctatttataattattaagaactaacagcttatctcaggaaagatattgctgttttctattgttatttgaaccacacaaatataccacagtgtgcttagaaatcattgtttgaacctctatcttattggatggtaaggtcattcaattctaaaccaataatgtggatgtatctttggggttttattccattatgaattcctattttatggttagtaaaaagcaaacagaattattgtaaacaatgcacactatagaattcgagtgacaagtataggtagaataaatttcatatatgtctaccataaacagtactgaagaatactagatttaaagcaagtatgtgaatagcttagaaaaaaatctctttgataataaagggaggaaatatgatcatggtcttgattgctattatcggtttccatacgcagttagaaacgtcatttcttccagcttttgaattaaagaaaagctgtttttgaagttgagatctgatgtaaattattttagtatttttttctaagacacttctaagcccctgaattgctaattatatcctcatcttccatttacaaaattccttctaaacttcagataagagaactcaaatcttctcttttctaaaaaaaaaaactatcaatgtaaaaatagtatagaaattatggaaaataattcagtgaaactttttgtaaatgttaaaatagtatctatgaaatctatgtattaattatgggatgtgccttaccattgtaattttgttgtcagtgatgaaagtgttttgacatattcattaacaggaagttctattataagaaagaaatgtacagtcttgttcacagctaaattctatatgactacattaattcttggtgttatgaagttttaacaatgttatttaatgttatttaaaccttaagataaatcatccccacacctgatttatgtaattttttaatcatatatcttcctcagtacaatgtaagaactgtaaagaaagagatcatgtctgtcttgctttctgttgattcccaggacctagaacccagcaccaagaatagatggccaaaaatgatactttaatgaacaaataaatgggtggctaaaatggataagttgatgtggtaaatcaatgaaaaggaaactcatcacaaaatctgcagttgcatgaattcccctgttctggtctcaggttgaggtttcaggcttatccaagcagaatccttcctcagaggaaaagtttggctattccacaattttaggggaaatatcacactagtgatatatatagtgatatatagtcacactatatatatatatagtgatatatagtcttgatgcagctgtgtcaggtgtctgaattggagacaaggtaaaacatcaaaattagatggcaccttggaaggctgaggcgggcggatcacgaggtcaggatatcgagaccatcccggctactatggtgaaaccccgtctccactaaaaatacaaaaaaattagctgggagtggtggtgggcacctgtattcccagctactcggaaggctgtggccggagaatggcgtgaacgtgggtggcagagcttgcagtgagccgagaccgcgccactgcattccagcctgggcgacagacaaaaaaaaaaaaagaaaagaaaaaattaggtggcacctatgacaatactttaaaaagcatataaaagactttggtctatttgcataagtatttttttattgtgaattatatatttgtgttatgatattttctagttgattattaggtaaacaaaatggcatttcatttcaaaaaattgagttagtaaccagctacttgaccaaaatgtttttaattaatacctgttaatgaaagtgatgacatttatttagaagtaaagttcaagacaaaaatggcagggacatgtggaaattgagacaggaagaaatgtgaaacaatgctctagtcgctttgaattctgctggatcatctggcacagtggccatagcagcttggaccagagcctgtatctgctgtagagccctcttttgttctgggttccacttgagaccagtagcctttggaaactttattaatgagtcagagcaatattttcaaacgtggaatatgttggctccaaaatctcaataggtccccaaaacattgtatctcttttgtagtgataggaagtacatagagagagcaacatgccatttactttaaaaaagattgttttgacatgtgccctagggacactgcacaccttaaaacatcacctatgctgtaggtccctgaatcttctcaggtttatttcttttcttctggtattttacttccatccaacattagggtattttactatatttaataaacttgcaacttcctgattattgtaccaactaatactttattattattgttattattttgaacagggtctcattctatccctgaggctggagttcagtggcaggatcacacctcattacagcctcaaccttctgggctcaagtgattctcccacttccgcatttctagcagctgggactgcaggggtacaacaccttgcctggctaattttggtatttcctgtagggctaggatttcaccatgttacccaggctggtctcaaactcctgggctgaagtgatctgtctgtgtcggcctccaaaagtgctgggattacagtcatgtgccacagggcccggtttgtaatattactaatatattaaattagcacgatgttttaaaaaatgtaaattaaactgagaacagaagtgacatagccctgacataaaacagtgaagcagtgctattattcttacaatacaagccaaattgttttgattttcctgcataatgggtgtagattaacaaacattcaccaaatcatgagccccgtaaaaagtatcaaaagctctgctctgctcagtgaagatagcacatcctggaaagcatttgtgagtgttgattgaagtttatggtagtctgcattcactataacctgtctgtctttggtagaggccagataggttaagtgaatcgggttatagaaaggactaccatcccctgtaactttcaagtgttttgtcatgacagtgaccagttccattccttggggaatgcagttattatattttatacattgtgttgccaatggaggagaatttcagaggcttccccttggtcctgctataataatgttccttactctacagttcaggaagaatgtgatagttctgccagctgccatacgtatccatttcaattacacattcaggaagaggtaataactacaaactggttagatccaccttgggatagacatgagccgaagctctgggcagcatctgaccttcaagaactcccactgcaggctggatgtgatggcgcatgcctgtagtcctagtactttgggaggccaaggtgggaggatcttttgagagcaggagttcccttcgcaacatatggaaactctgtctctacaaaaaatttaaaaaattagctggcggggtggtgcatgcctatagttccaaatacttgggaagctgaggcaggaggattgcttgagcccaggagttccaggctgcagtgggctatgatcctgccactgtactccagcttgggtaacaaacggagactgtctcggaggaagaaaaaaaaaagaagtgcaagttctcactggtatcttaaatatcaagtaaaaagggatcaaatcaataattaacaatctttggttcctgcctatagcaaacaggtaaaatggaaagtagttatacaaagggtatattatattaactcctaacaaaattaaacaaagccagttttttttcatctcctttcattttttttttttttgaaacagggtgttgctctgtctccccgttggagtgcagtggtgtgatctcgaccaattacaacctccgtctcctgggttcaaatgattctcctgccgcagccaaccaagtacctaggatcataggcatgcacaaccacaactggcaaatttttgtatttttagtggagacagggtttcaccatgttggccatgctgttttctaactcctgacctcaggtgatccacctgcctcggcctcccaaagtgctggaattacaggcctgagccaccgtgcccagcctattatctgctttttataggtaattatactgaggcaggcagtagttgtaaaatggagtctcacatatctgtatgaaacagggaatctggtttcctgtctttgtagtctgactcgaagatcccctcttagaaaccattatagtgtaaaaactgaaaagatataaaatccaagattggagactgattttaatatctattcatcttaaaccatttagtaatcaaaaataaatagggaaaaataaagctggatattcatacatagagaagtgtagattcttcaatggaaaacatgttttttaagtgtccaaggaatagttataaaatttctgagtattttaattaaataactaagatttaagtgttagactcatgagaataacttagtcaaaggcctaagcatgagagattaagtttgataaacattgaaaatgggctgaaaagcctgagtaagaaaattaattactttttcattttagaaattataggacaacaatttttcccaaccgtcaggggtgtatatatgtgcatgtgaaagtgcttatgttaatgagcttgttaataataagttatacaaaattattagttggcagcaaccagattttaaggaatattggccttcttgggcttccgaagaaaaccttggacgcttttggtaggaaaagttgggattcactctccataaatccggcgttgaaaaaatgaatcaacagtggtcatgattctagttttgaccaagctacatataacagtgtaggcatctgatgtatgatctatgtattaggttggaaaatttcccttacaactgacattgctgaatacaaattatatagaggttaaacaaggaaaaaaattacaaaatgatgaataagaatatgacttgatttgcatgctagcaaatgagaattcagctttcacatcaacatcagtatgaaaatttttatcttataacaaggacatagtatttgaataggagttaatttgagctgttttggaaattatcatgttttccattaagatagccttgaactcattcaatagcatgctccggtggtttcctgcttggcattagtcagagaacttaaaaggaacaggaacattactgcacaaccagaaatcaggtgcacatagaaattaaggtcaggaccttaaagggaatcttgcccattgatattagtcctgccctaaaaaaagtcggacatggtatgtttactactaatcattttttttccataacgttaatggtattttgtattttcccatgggcacctacattacacttatagactattttgatatttcaacctattattttctttgaatccttttaaggagttgttaaacaatgctgaaatttgccttacagtatgctgttaactaatcatatttctcaaagtcatttgacataatgtttggttaaaggaaatatgtctagcatagttatacccgttcataacaaaagagtatttaaatctttaagaaaaaatattagaaaagctaataatatgaataaataaatatatgaagtatataattcattattaatatatgtgcatgaaatcatggtcatagaatttaaaagtaataatttttgaattaaggatacattctgaactataatagaaaaaggcttcaaaaatgttaggtttataatgtttcatatagatacgaaagtgtaaaaattagtctgatgttacttattttggaaagcatatgaagcaatgggaattttcatacattgctcctagaattgtaaatcagagcaattactttgtctgactatggcattatctgattaagttgatggatcacatttgaacacccagtatttgcactgttatcagaatatatgtgcacacacatgcatatcactgagttttaatagctaaagttgagaagtctctcaaatatccatcagtgataaaatggataagtaaattatggcatacttgtacaatagaatactatacagcaatcaaaatgaactgttggagacatgtgctcggagtagccaaaagaaatccccacttggacaatttctcagcaaggcacctttacgtcagcagaagggtgctgcttgcacctgttacaatcccaagagaagagcatacctaacaaaggagggaaggagtttttaatcctaacacagttcctgtttctgtgtccttcccttattggctggggttggattgcacaatctaagctgatcctgaatggcttagacttaaacttttccaaatagggtaaacgcacattttgcaaaaagaaagaggggtgggaggtaggattcatttacaacatttacaacttatggctgggaagttgagtctttaaagaggaatttagttgtcctaacggaaccagctagagtgacatgtttacaaagaatataaataaaaagaaaaatgaagaaatttgaactacatagatatgagaggaattaagtttgaaaaaatgattcagtataattccatttatataaagtttacaaaaatgtatttttaataaattgaaatttattacactggtggtgaaattctaaggtgagacatatgagtgattatcctaacaattgggatggtagggatggaggaaacaaaagggaaatgttatcagtaagatggcatatatggagagtgtctggattgctggtgaaatctactttatgaccatgatgtggaatcatgactcttaatgctataatttttttctttactgtacattagacctcattactttatatactttatatatatatgttatgtttcacaatattaaatatttcacaataatgaaaatatttaaaaagtagaaacatacactaaatgaatgaatataaaataggctgaacaaacatattcttatagacatcattgtaattagagtttttgctgaataaagaatagagcattatgatagtaataaatccaagataaaattttaaacttttttttaaattaattagaaaaaggaagagataagcaggaagactacctccacattcctaatgttattcttactttgaaacatcagattttgagcacttatattttactggacacatttttttcttatttccaatttaattatttatgataacatttcaaagtggcagaaattagtgaatttccaataaattatagtagtatagatattaaatgtataggacaatttttctaaatttatctttaaatgaaataattatacacatatttttaccattcaaagattataataccatgcatgtgtacacatgtgtaaggaaaaatattttgatactgcaaatttttttaatattagagaaaaattagtagaaagataattttattaaggcataaaacatatttagtgtagttactttgactgctataataaaaacacccagattttgtgacagtagctgagaatgtaaataagcagtcaagagaatttaacttggtaatgatgctattaaaagatgaaatgaagcttattcagtctataattgcacagagtatttgtgtaagttcatatgaaactggaccaaaactaaacagccaaaaaaagagtattatttgctttaggtcacttttgccataatttttagaatgtggtgaaagaaaaaaaatagcaagtaaatcattggaaatgtgttggctttgcgttattcctgatgaaatactatatgagggtatttgtctaggcctgattctgagaataatataagaatggtgccaagcacagtggctcattcctgtaatcccagcactctaggaggccaaggcagtggattccctgaggtcaggagttccagaccagcctggccaacatagtgaaaccctgtctctactaaaaatacaaaaattgacgggtggggtggtgggcacctgtaatcataggtacttgggaggctgaggcaggagaattgattgaatcagggaggcagaggtttctgcaagccgagattgtgccattgcactccagcctgggtgacaagggagaaacttcatctgagaaaaaaaaaaaaattgtaaatccatgaggaagaataagagtgttctcccatcacccttaactccagtactttgaaaagaagacccaaatcacagttatttggtaacattctcccttttagttgacatcatcatcattattatcatcatctctatttacatctgttttatgaaatgatttatttttgaaatatttacatacataatttcgtaacatctatgtaatttctaagagatatcattgtgggaaagttacattagtaaacagcaaagttcaagtaacaataaatacatttagatttagaaagttaagtgtagtgtagtttaacatacattgcttaagaaaacaattgtagatgacattaaactaaaccaagaaacactataaaaaagattttgattttagtataaataaaattccttaataagaaaaataaaccatttcatgatcaagctctgatttacaaagagaggattttagggctaaataaatcaaagagaagtaagccttcccccacatcttctctatttcatttaggtaatgatggggttcagaggcacagagccccatttctacaacataagcaaagtgaaaattaattcattgaatacagcaatgtagctgtggtagatgaactatattttatctattgccatgatattttgagatccagtgctgctcattgagttcccctgtgggcagagtttgtggtgaggagccagcaacagacaagctaatatccaaaaacatctactcacatcaacttaatttccagtttctttcaaattgaaggtaagttccaagacaaactttttattctattctctgaccaagtgttgggaaaagaaaactgttaccattttcatttctagcatactaaaacaaaaaacataaaaaccccaaaatctaaaacacttttaaaaataacatggtgttaagagtagtttgttcagtttccctatagaaaatgatttatggaaggagaataaaagtttattctgaacactaaaacaataagaccaaaaaaatgaattatcaatattgagaatccaatagacagaattagcctgttagatgcagtagaagagagaattagtgaattggaagatagctaaacagaatgaagcatagagagaaacagatggaaatataccaagctagagggtatcacattgatgctacagtcagaacacctaacatacttctggagttctgtaagattagaggagagaaaatcaagcaagagaaatgttgcaaggatttttccaaaagtgataaaatgtattcctccatatatttttagtaatctcaaacttcaagcatgataaattaaaccaaattagcataaaataatacaggacaccaaagaccaatagaaaatctgaaaagtagcgagaggtggaagatagagtatgtcgtgtgttgaaaagaactgcattctaaatacaacctgattttaacagaaaacatggaagaaggaactcaatggaaacatgtcttcagtgcatttccaaagagtagtagaacttcataaacagaaattgaaaatatttttcagagaaaataaaaatgactgaaaatgcaaagttgaacatgcaaggagcaataaaaattattgacaatgaaaaataagtgtaattctaaataaatgttgactgtataaaaattattgtcttgttagattaaatttataattgataagatatatgcaaatggcaataaagagactggagataaaggtgacaggaataaatttagttagactatgttttgggcttttctatgtctgtgcagataatttgaacatcataatcaaggaccctgtaattctacacccaggtatatatatgcaaaagaattgtagtaaatgatgtaggtcattgaagcattattcataatagctaaaaaataagctgcccaaatatatatcaaataaagatggataaataattacagtaaaatcataaaatggaaaaatatggagaaatgaaatgaaataaatcacatgtacatgcaactatgggattaaatttctgatacagaatgttgatttcaggaagccatgaataagaacatatagaattgcacctatacacagttcaaagaaggccaaaccaagctattgagtttagggtcgcatacctagttggtaaagtataaagaaaattttaaaaagatcaacataaattatggatgttgcttatcacaggagatgtgaagaaacgtgtagcagattggaaagtggcattgaggtaaacctaggctcttagcaattttccatgtcttgccctacatgatgattacatgagtatttatgacacattgctatgcttcccagttttgttttggctcatttctaagtgtgcactctagttacaatacaaaaattgttaatgaggagaaatgttccatgaaattattattactctgctcattatatactgaagggaaaaatccactatttgtatacattcatgtataactctaagaggttttaagtagaaatgttctgattttagttgtaacttttggaaatttgacatgatgttacctgccaaccccacgtttttcaataggtttttcttctaggtttaattatctacttcatatgacaaaactttgacattctccatctatttttcccttggatccagaattcctaacacaacaagggtggtcatgttacccacactcttagtttagcagaatacctatatcagttatgtttttctgcaagagaaaatcctccaaaactgctttagatatttgtgtctcataagtctttggatttcatttttctaagcttggtttggcagatggctctggtgattggagatgggccacatactgcatcttgcagctagtttggctgatttaggctggatcaggtagtggcattctgactccattagtttctcattcttcttctgggaacagtgtactagccagatgatgtcctcatggtaaaaggaaaagagcaggaaactccaacatggaagctgtcttaaatatctgtgtaaagtctactaacttcctgttgactgaagcaaattagaggagtgaatttagagtccaagttcaaggtagtcaccctgcctgtggtgggaggatactgcaggattatatgacaaaatgtagggtacttagaaacatttacaaaattgctgaatattttaattaaaatttaaacaaaaaacagacttgaatgtaaatttaccaaagacctaagcataagaaacatgtttgataaacattattcattgtctgacaacgctgaataggaaaatagtactaattctacctggatgacctcctggaaactcgttttccatttggtgagtaataagaaaataattccttccatcccctaatggtgtgagtgcatgtgtgtctatgtgtttaggagcttattaacaataatgtcatataaatgtattggttatcagaaaccagattttcaggtgtattggcctcacaggactttccaagataaccttggatgattttgacaaaaggtttagaatctggtatttaaatctggcataaaaataaatccatattgatatgatcctatttatgaccaagctcctttaacaatttagacatttactgtatgatatatgtattgggttttaaaatttccctatgtaacaactgaagatgctggatacaaattatggagaggttaaacaagaaaaaaattgcaaaacaatgaaaaagaatatggctttatttgcatactaacacacgagaattcacttttgacttcaacatcagtataaaacatttcagcatatagcaaggacagatagtctataaagaggaatgagtttcagctgttttgagattaataatattttccctaaagacagctttgaattcatccattggcatatgctggtgctttcctgttgacattagagaacttaaaggcagaaaatgttactgcacatttagaaatcaagtgtttatcgaagttaatgtctggatattaagggaatcacaaccagtgttattaagcctgcatttttttttttgttgttgttcaaacatatgtgttctgctcatcattttatcaattctggtagtgtttgcatttgttcttggaaatgttgccaatggcttcatagctctaattaatgtcaatgactgggttaagacacaaaagatctcctcaactgaccaaattgtcactgctctggcattctccagaattggtttactttgatcatattattacattggtatgcaactgtgtttaattcagctttatatagtttagaagtaagaattgttccttctaatgtctcggcaataatcaatcatttcagcatttggcttgctacgagcctcagcatattttatttgttcaagattgccaatttctccaattttatttttctccacctaaagaagagaattaagagtgttcttcttgtgatactgttggggtccttggtatttttgatttgtaatcttgctgtggtaaccatggatgacagtgtgtggacaaaagaatttgaaggaaatgtgacttggaagatcgaattgaggaatgcaatacacctttcaaacatgactataaccaaccatgctagcaaacttcacactgttcattctgactctaatatcttttctgctgttagtctgttctccgtgtaaacatctcaagatgatgcagctccatggcaaaggatctcaagatctcagcaccaaggtccatataaaacctttgcaaactgttatctccttccgtatgttatttgccatttactttctgtgtataatcacatcaacttggaatcctaggacacagcagagcaatcttgtattcctgctttaccaaactcttgcaatcatgtatccttcattccactcattcatcctgattatgagaagtaggaagctaaaacagacctctctttcagttttgtgtcaggtgacgtgctgggtgaaataacagaaaccctcaactccatagattcacaaggggagcatggtgtgtcttttagcagaaaagaaactgatggtgtctagaacgttttatatttctgtcagtttgttgtagtgtatgtatttgagtaatttcaaaacagattcctaggatagtcttttatatatatataatatatataaaattcatatatatataaaatacgtatgggtgtatatgtgtgcatgtgtgtgaataataacattgaccataaattatgaagcctagtatatttcatatatataagtatgtgtattttatgatagctaattgtatgatatttcatttgaagaatttatctctctttgtaattaagaaattacagcatttatcagaaaatcattgctgttttccattgtaatttgtaccacatacatgtacttaactatcattgtttgaacctctcattttctggatggtaaagacattcaattctaaatcaatgatgagactgtatctttgtagtaggttttatttcattatgaattgttactttacttttagtataaagcaaatagaatttttgttagataatgatgtacacaataaaattagtgtacatattaaataaaatcagtgacaaacatgtagagtatatgtatttgcctttgggaaggcaaattttgtatatgtataacaaaactgtactaaagaatactagatttaataccagtatgtgaatagcttagaaaaaaatcatttctataataggaatgaagaaacaaaaccatgatcatttcagtgctattataattttttaagtgtagttagaaaaatcatttcttccaccttttgagttaaagaaaatcttttttgaagttgacatctgatgtcaagtatttccatttattttgcttagcaacctctgagcctctgaatttccaatattcttctttgtctcccattcctgatattcctcaaaaaaactcaaatattccctttctttaaaaaaaaaagcccaacataaacagggtgtagaaactatagatgataatcgaatgaaactttcttcaaatgttaaaaattgcctgtgaaatctatatattgatgataggaaatatattaatgactattataatgatgtaaatggtgaaatgatacaaagtgtgctgatgtatccattgataccaagttctattataagaaggtaatctacagccttgtggaacagctaaattctgtgtgactatattcattcttggtgttatgaaattttaacattgttatctcaaccttaaaataaatcaactcctcatattatatatatataatatatatatacacacatacattttgtttatcatacatcttccctagtactatgtaatcagcataaaaagagaggtaatagctgtcttgctttctcttgactcacaggatctaaaagccagcacaaagaatagttggtcaaaagaatatattaatgaacacataagtgattggataaatggataatttgttgtggtaaaccaatgacaatgaaactcatcacaaaatctgcagttgcttgaattttctagtttcaggttgaggttataggcttatcaaagaagaagcatttctcagagcaaaagtttgactgttccaaaattctaggggaaatatcactgtaatatagctttgctgtagctatatcaggtgtgtgaagtagagacaaggtggaacgtcaaaattagatggcacttattctaatgctttttgaaaagcatattaaagattttggtatatttgcacagggtcagggtcagcagtgtgtgccagctgctcggggctagctgaccccatgacaagaatgttagggaacttcccagtagctgctaaacacacttttgtttttagggaatgtctctttctccttcaatatgacttatgctgccttcaatgctttgctgatacaaaagaactgaactcaaaagaagtaaaaataaaagctagcaaactttgcaactggttaagctggttgtaaacgtacctaatcactttctactgtgaatgatatatttgtattgtgatattttttagctggttattagatacacaaaaaaggtatttcatttttaaaaattgagttagtaaccactcaccttacttacaaattatttgtatattattttgtttagtatcctttctaaatgaatgttttaattgccacgttataaacacatggaaaagtgattcagatgaatgtatatcttagctttgggtgtctagaactagagccaatgtctgattttacagtgatgacatttatttgggaaggcaagtccagggcagcaatgagggatacatgtggaaactgaggcaaaggaagatgtaaaatcatgtgtcatgatgttgatatgactttgccagttgtcgcttcacaatgaggtgagacagacagcatggtggtcatcagatacatgcacttggctccccgtacttttccagaagggttacaaggggaagccacaacaaatattagtccatggaggagagaaaagggagaatgtatcctagctgtcttctgtcttctatcttcctttggccaaagattgtttgaggcagaactaccatctttgcttttcttccttacattatccaaccccttggtgnnnnnnnnnnnnnnnnnnnnttattgttagaaaacaatgcacacaatagaatttgagtgagaagcatatgcagagtaaatttaatgtatgtctaccataagcggtactgaggaatattagatttcatatgtgaatagcttaggaaaaaattccttctctaataaagggatgaaacatcatgatcatgatcttgattggtatcatcagttatgcatatgcagttagaaacgtcatttcttccgcttttgaattaaagaaaatctgtttttgaagttgagatctcatgtaaattattttagtattctttctaaagcacttttaagcccctgatttgctaattatatccttaccttccgtttgtaaaattccttctaaacttcagataagagaactcaaatcctctctttttgaaaaataaaatcaatgtaaatatagtatagaaattgtggaaaatatttcagtcaaactttttgtaaatgttaaaatagtatctgtgaaccctatgtattaattatgggatgagccgtaactttgtaattttgtcatcaatgatgaaatgaaagggtgttgacatattctttaataggaagttctattataagaaagaaatgtacagtcctgttcacagctaaattctattacgttcattaatactttaatgaacaaataaatgggtggctaaaatgggtaagctgatgtggtaaaccaatgaaaaggaaactcatcacaaaatctgcagttgcatgaattcccctgttccggtctcaggttaagattacaggcttatccaagcagaatccttcctctaaggaaaagtttggctattccacaattttaggggaaatatcacaataatatagtcttgatgcagctgtatcaggtgtctgagttggagacaaggtagaacatcaaaattagatggcacctattacaatagtttgaaaaatcatataaacaactttggtctatttgaattttttttctattgtgaattatatatttgtattatgatattttctagttgactatttaaataaaatggcatttcatttcaaaaaattgagttagtaaccagctactttaccaaaatgtttttaatgtaatacctgttattaaagtgctaacatttatttagaagtcaaattcaagacaaaaatggcaaggacgtgtggaaattgagacaggaagaaatgtgaaacaatgtgtggtgatgtctggtatggctctgctggcagccacttcacagtgaggtgagagagacagcatgacggtcatcagatgcgtgtacttggcttccagcactttttccagaagggctacagggggaaaccacagctggcattagtccgtggaagtgagagaggagggagaatgtatctgctcggctgtcattagtcttctatttcttattggtcagggtttccttgaggcagaactatcatctctgttgttctgtcttccatcatccagtcccttggtggtggtcatgaaagtcataccttatgcccacagtgtggtgatgcattcaagtcccaaatggaatgatgacctggatcgggcaaggtactagccaggggaataggacatagtgaagggaatctaagaaagcacatgtttgtgtccaataccatcactccttgtgccactgaggcgtgctcataccctccagtcatggctggctttatgagcatatgacgtccacagttgcatagggttttgtgcttatagggacttgtgtttagagggactctatgcttggattaatgttctccacttgctgttttgtttttcacacagaggatactcctctgctgaagagggaatgttcttgcactaattccatagggatttgctctcctgtctcctacaggcttgtcagagacatgcacagagtcctataatgaccactatgtatgtttctagcatctttgaatcctgctggatcatctggcacagtggccagagcagcttggagcagagtccatatcttctgtagagcccacttttgttctggattctgcttgagaccagtagcctgggaaacttcattaatgagtcagagctatattctcaaatgtggaatatgttgtctccaaaatcccaataggcccccaaaacattgtgtctcttttgtagtgataggaaatttatagagagagcaacatgccatatactgtaaaaaagattgtttcaacgtgtggtctagggacactgaatgctttaaaacatcacctatgctgtaggtccctgaatcttctcaggttgatttcttttcttctggtattttacttccattcatcgttagagtattttactatagttaagaaacttgccacttcctgattattgtaccaagtaatatattattattattattgctattattttgagacagggtctcattctgtccctgaggctggagttcagtggcaggatcacagctcattacagcctcaaccttctgggctcaagtgattcccccacctctgcattgctagcagctgggactgcaggggcacaacatcacgcctggctaatttttgtattttctgtagggctaggatttcaccgtgttacccaggctggtctcaaactcctgggctcaaatgatcttcccgtgtcggcctcctaaaatgatggcattacagtcatgtgccacagggcctggtctgtaatattattaatatattaaataatcacgatgttttaaaaaatgtaaattaaactgagaacagaagtgacatagccatgatataaaacagtgacagtgttattattattataaaacgaggcaaattgttttgatttttcctcataatgggtgtagattaagaaccattcaccaaatcacaagcccggtaaaaagtaccagaagctctgctctgcttagtgaagacagcacatcctggaaagcatttgtgagtgtttatttaagttcatggtagtctgcattgattctgtaatccatctggttttggtagaggccagataggttaagtgaatcaggttatagaaaggactaccatcccctgtaacttgcaagtgttttgtcatggcagtgaccagttccattccttagggaatgctgttattatattttgtacattgtgttgccagtagaggagaatttcagaggcttccctttggtcctgctataataatgtcccttactccacagttcacgaataatgtgagtgtcctgccagctgccatgcatatccatttcagttacactttcaggaagaggtaataactacaaactgattagctccaccttgggatggacatgagccaaagctctaggtagcatctgaccttcagaaactctcaatgcaggctggatgtcatggctcatgcctgtagtcctactactttgggaggccaaggtgggaggaccccttgagagcaggagttccctttgcaacatatggaaactccatctctacaaaaaatttaaaaaattagctggcatgttggtgcatgcctatagtcccaaatacttgggaagctgaggcaggaggattgcttgagcccaggagttcaaggctgcagtgggctatgattgtgccactgtactccagcttgggtaacagagggagactgtgtctcagaagaaaaaaaaaaaacaagtttaagttctcactggtatcttaaatatcaagtaaaacagtatcgaatcgataatgaacaatctttggttcctgcctataagaggtaaacttgaaagtagtaatacaaatagtatattaactcctaacaaaattaaccaaagacagttgtattttcatcgccctttgttggtggtggtggtgtttttgagatggagtttgcacggtctccccactggagtggagtggcatgatctcaactaactacaaccccccactcctgggttccaatgatttttctgccacagccacctgagtagctgggattttatgcatgtgccaccacacctggctactttttgtatttttagtggagacagggtttcaccgtgttggccatgctggtttcaaactcctgacctcaggtgatgcacctgcctcagcctcccaaagtgctgggattacaggcctgagccaccgcacccggcctatcgtctcctttttataggtaattatactgaggcaggcagtagttgtaaaatggagtctcacatcatagttatatgaagcagggaatctggtttcctgtcttggcagtctgacttcaagatcccctcttagaaaccattatactataaaaactgaaaagaaataaaatccaagattggagactgattttaacatctattttaaaccatttcataatcaaaaataaattaaatagggaaaaataaacctgaatattcatacacagagaagtgtagactcttcaatggaacacgttttttaagtgtccgaggaatagttataaaattgctgaatattttcattaaataactaagatttaagtattagactcaagagaaaaacttagtcaaaggcctaagcatgagacattaagcttgataaacattgaaaatgcgctgaaaagcccaagtaagaaaattaatttttcattttagaaattataggacaataatttactcaaccatgaggggtgtgtgtgtgggggggggaatgtgtttatgttaatgagcttgttaacaataagttatacaaaactattagttaacagcaaccagattttaaggaatattggccttcctgggcttccaaagaaaaccttggatgcttttagtaggaaaatttaggattcactttccataaacctggcattgaaaaaatgaatcaacagtggtcatgactctagttttgaccaagctacatataacagtgcaggcatccaatgtatgatctatgtattagtttggaaaatttccctaacaaccgacattgctgaacacaaattatagacaggttaaacaaggaaaaaatttcaaaatgatgaataagaatatgacttgatttgtatgcctggaattgagaattcaggtttcacttcaacatcagtatgagacattttataacaaggacatagtatttgaatatgagtcagtttcagctgttttggaaattatcatattttccgttaagtcagccctgaactcattcaatagcatgccccggtgctttccgttttgacattagtcagagaatttaaaaggaaccagaacattactgcacaatcagaaatcaggtacacatagaaattaaggtcaggaccttaaagggaatcttgtccattaggccttgatattaggcctgccttaaaaaaattcagacatggtatgtttactactaaccatttttttccataacagtaatggtagaatttgtattttcccatgggcaccttcattgtacttaaagactattttgatatttcaacatattattttctttgagtccttttaaggagttgttaaacaatgctgaaatttgccttacagtatgctgttaacaaatcatatttctcaaagtcatttgacataatgattggttaaaggaaatatgtctagcataattatacttgttcataacaaaacagtatttaaaacttgaagaaaaatattaggaaaagtaataaagaatatgaataagggttgggtgtcgtggctgatagctgtaatcccagcacttcgggaggccaaggtgggtggatcacgaggtcaggacatcaagaccatcctggctaacacggtgaaaccctgtctctacaaaaaataccaagaaaaaaaaaattagctgggtgtgatggcaggcccctgtaatcccaagtattcaggaggctgatgcaggagaatggcgtgattctgggaggcagagcttgcagtgagccaagatcatgccactgcactccagcctgggcaacagagcaagactctgtctccaaaaaagaaaagaaaagaaaaaagaatatgaataaataaataaataaataaatgaaatatgtaattcattattaataaatgtgcatgaagtcatggtcatggaatttaaaaagagtaacaatttttgaattaagaatacattctgaaacataatagaaaaaggcttataaaatgttaggtttaataatgtttcatataaatattaaaggtaaaaattattctgatgttacttattttggaaagcttatgaagtaatgggaattttcatacactgctcctagaattgtaaatcagagcagttagtttgtctgagtatggcattatctgattaagatgatggatcacatctgaagacccagtatttgtatccttatcagaatacatatagacacacatgcatatcactgagttttaatagctaagttgagaagtctatcaaatgtccatcagtgattaaatggataagtaaattatggcatacttgtacaatagtatactatacagcaatcaaaatgaactgttggaagcaagtgctcagagtagacaaaagaaaccaacacttcgacagaaaatttctcagcaaggcatctttactttggcagaagggtgcagaagggtgctgcttgtgcccgttacaatcccaagagcccacggaacaaaggagggaaggagtttttaatcctaacacagttcctgtttctgtgtccttctcctgttggctggggttggaccgtgctatctaaactgatcctgattggctaagacttaaacttttccaaatagggtaaatgcaggatttgcaaaaagaaggaggggtgtgaggtaggattgatttacaacatttgcaactgttggccagaaggttgagtctttgaagggaacttaattgtcccagcagaaccaactagagcaacatgtttacaaagaacataaataaaaaggaaaatgaacaaatttgaacttcatagatatgagaggaattattaggtttgaaaaatgattcagtataattccacttatataaagtttacaaaaatatatttttaataaattgaaatttattacactggtggtgaaattctaaagtgagacatatgaatgattatcataacaattgggatggtagggatggaggaaacaaaagggaaatgttatcaacaagaaggcgtatatggagagtgtctggattgctggtgaattctactttatgaccatgatgtggaatcatgactcttaatgctataagttttttctttactgtacatttagaccttattactttatatatatatgtatgttatgtttcacaataataaaaatatttaaaaagtagaaacatacactaaatgaatgaatgtaaaataggctgaaaaaacatattcttatagacatcattgtaattagaatttttgctgaataaagaagaatacagcattatgatagtaagaaatccaagaaaaattttaaacttttctttaatttaaaaaaggaagaggtaagcaggaagtctacctccactttcttaatgttattcttaccttgaaacatcagattttgagcatctgtattttgctagacaccttttttcttctttccaatttaattatttatgataacatttcaaagttgcagaaagtagtgaatttccaataaattatagttatacagacattaaatatacatgacaatttttctaaatttatccctaaataaaataattatacacattttttaccattcaaagattttaataccatgcatgtgtacacatgtgtgaaaaaatattttgatattacaaattttttgaatattcaagaaaaattcatagaaagataattttgttaagccttaaaacatatgtagtgtaactactttgactgctataataaaatcacccagattttgtgaccatagctgagaatgaaattaagcagttgagagaatttaacttgttagtgatgctattaaaagatgaaatgaagcttatacacttcataattgcacagagtatttgtgtaagttcatatggaagtggaacaaaattaaacagccagaacaagagtattctttgctggaggtcacttttggcataatttttagaatgcaatagaagaaaaaaatagcaagtaaatcactggaaatatgttggttttatgttattcttgatgaaatgctagttgagggtatttgtcaaggcctgattctgagaataatatcggaattatgctgggcaaagtggctcatgtctgtaatcccagcactctaggaggccaaggctggccgatcacctgaggtcaagagttccagaccagcctggccaacatgatgaaaccccatctctacaaaaaataaaaaaaaattgctgggtgtggttgcagccacctgtaatctcagatacttgggaggctgaggcaggagaatcgattgaaccagggaggcagctgttgccgtgagccaagattgtgccattgaactccagactgggtgacaagagagaatttccatctcgaaaaaaaaaattgtgtatctatgaggaagaataatagtgttctcccaccaaccttaactctaatgcttttaaaagaaaaccaaaatcacatttattaaataacattctaccttttagctgacatcatcattatcatcatctacatttacatctgtcttattaaatgatttatttttgaaatatttacatacataatttggttaatgtctgcataatttctaagagatatcattgtaggaaagttatattagtaaacagcaaagttcaagtcaggctgaatacatttagatttagaaagttaagtgtagtgtagtttaaaatacaatgcttaaggaaacaattataaattatattaaactaatccatgtaacactatgaaaagattttgattttagtataaataaaattgcttaataggaaaaataaataaaccatttcatgatcaagctcttatttataaagtaaggatgttagggctaaataaatcaaagagaagtaacccctcccccatatcttctctatttcacttaggtaatgatgaaatttaaaggcacagagccccatttctacaacataagcaaaatgaaaattaattctttgaatacaacaacgtagctgtggttggtgaaatatattttatctattgcaatgatattttgagaggtagttctggtcattgagtttgcctgttagcagagtttgtggtgatgacccagcaacagacaagctaatatccaaaaaaagctactcacatcaacttaatttctagtttctttcaaattgaaggtaaattgcagaacaaagcttttattctattctctcagcaaactattgggaaatgaagaaaaccactaccattttcttttctaacatactaaaacaaaaagccaaaaacccaaaactcaaaaatgcttttaaaaagaacatggtgttaagagtagtttgttcagtttctccctagaaaatgatttatggaaggagaataaaagattattctgaacactaaaagaataagactgaaaaaaatgaattatcaatattgagaatccaatagacagagttaaccagttagatgcagtagaagagagaataagtgaattagaagatagctacacagaatgaagcacagagagaaagagatggaaatatacaaagctagagggtaacacattgaggctacagtcacaacacctaacatacttctggagttctgtaacagtagaggggagaaaatagagcaacaaaatgttgcaaggagttttccaaaagtgataaaatgtatgcctccatgtattttttgtaatctcaaacttcaggcatgatgacttaaatcaaattaacataaaataatacaggacacaaaagaccaatagaaaatctgaaaagtagctagaggttgaagatagagtatgttgaaaagaactgcattctgaatacaacctgattttaacagaaaatatggaagcaggaatgcaatggaatcatgggaatcatgtcttcagtgtgtttccaaagagtagtagaccttcaaaaacagaaattgaaaatgatatttttcagataaaataaaattactgaaaatacaaagttgaacatgcaaggagcaataaaaattaatgacaatgaaaaataagtgtgtaattctaaataaatgttgactgtataaaatagtgtcttcctggattgaatgtataatcgataagatatatgcaaatagcaataaagagactggagataaaggtgacagagataaatttagtcaaactatgtttttggcttttttatgtctgtgaggagaatgtgaacgtttatcaaggaccctgtaatttcacacccaggtatatatatgcataagaattgtagcaaatgatatgtgaaagaatgctcattgtagcattattcataatagctcaaaaacaagctgcctaaatatatatcaaataaggatggataaataattacagtaaaatcataaaatgaaaagttatacagaagcgaaaagaagtggatcacatgtacatgcaactgtggggttaaatttcatatacataatattgattccaggaagccatgaataagaacatataggattgcacctataaacatttcaaagtgggccaaaccaagctattgagtttagggttgcatagcttgttggtaaagtaaaaagaaaatttaaaaaaagatgatcataaattatggatgttgcttatcacaggagatatgaagaaaggtataggggaaatggaaagtggcattgaggtaaacctaggcttttagcaatgttccatgtcttgccctacatgaaggttacatgagtgtttatgacacattgctatgttttccatttttgttttggctcatttctaagtgtgcagtctagttataatataaaaattattaatcaggagaaagattccatgaaaattattattactctgctcattatataccgaagggaaaaattcactatttttatacatttatgtataactctaagcgattttaagtagaaactttctgattttagttgcacctttctgaaacttgacatgatgttacctgccaatcccagatttttcaataggtttttcttttaggtttaattatccacttcatgtgacaaaactttgacattctctgtctatttttcccttgaatcctgaattcctgacacaacaagggtggacatgtttcccatactcttggtttagcagagtgcctttatcactcaggtttttctgcaagagaaaatcctccaaaactgctttagatatttgtgtctcatatgtctttgaatttcatttttctaagctagatttggtggatggctctggtgactggagacgggccatgtactgcatcttgaagctagtttggctgatttagtgtagataaggcagtggcattctgactccattagtttctcattcttcttatgggaacagttattggccagatgatgtcctcacggtaaatggaaaagagcaagaaactccagtatggaagccgtcttaaatctctgcgtaaagtctactagtttgctgttcactgaagcaaattacatgagtgaattcagagtcaatggtcaaggtagtcaccctgcctgtggtgggagggtgctgcaggattatatgaaaaagtgtagggcacttcgaaatatttacaaaattgctgaatattttaattacataattaatatttaaacaaaaaacagacttgagactaaatttatcaatggcctaagcatgagaaacatgtttgataaatattattcattgtctgacaaccctgagtggaatacgagtaattccacctggatgacctcctggaaactcattttccatttggggaattataagaaaataattccttccatcccctaaaggtgtgagtgcatgtgtgtctatgtgtttaggagcttattaacaatgatgtcatatcaatttattggttatcagaaaccagattttcaggtgtatcggcctcccagggctttccaagataaccttggatgattttgataaaaggtttagaatctggtatttaaatctggcataaaaataaatccatattggtatgatcctagttatgaccaagctcctttaacaatttagacatttactgtatgatatatgtatttggttttaaaatttccctaagaaacaactgaagatgctggattcaaattatggagaggttaaacaaggaaaaaaattgcaaaacaatgacaaagaatatggctttatttgcatactaacacatgaaaattcacttttcacttcaacatgagtataaaaaaattcagcatgtagcagggacagatagtatatgaagaggagtgaatctgagctgttttgagaataacaatattttctatttctatgaagacagctttgaactcatccattagcataggctggtgctttcctgttgacattagtcacagaatttaaaggcagaaaatgttattgcacatttagtaatcaagtgtttatcgaagttaatgtttggatattaagggtatcagaaccagtgttattaagactgcaatttttttctttttgtctgttcaaacatggtatattttctgctcatcattttatcaattctggtagtgtttgcatttgttcttggaaatttttccaatggcttcatagctctagtaaatgtcattgactgggttaagacacgaaagatctcctcagctgaccaaatcctcactgctctggtggtctccagaattggtttactctgggtcatattattacattggtatgcaaatgtgtttaattcagctttatatagttcagaagtaggagctgttgcttctaatatctcagcaataatcaaccatttcagcatctggcttgctgctagcctcagcatattttatttgctcaagattgccaatttctccaaccttatttttctccacctaaagaagagaattaggagtgttgttctggtgatactgttgggtcccttggtatttttgatttgtaatcttgctgtgataaccatggatgacagtgtgtggacaaaagaatatgaaggaaatgtgacttggaagatcaaattgaggaatgcaatacacctttcaaacttgactgtaagcacactagcaaacctcatacccttcattctgaccctaatatgttttctgctgttaatctgttctctgcataaacatctcaagaagatgcagctccatggcaaaggatctcaagatctcagcaccaaggtccacataaaagctttgcaaactgtgatctccttcctcatgttatatgccatttactttctgtatctaatcacattaacctggaatctttgaacacagcagaacaaacttgtattcctgctttgccaaactcttggaatcatgtatccttcattccactcattcttcctgattatgggaagcaggaaactaaaacagacgtttctttcagttttatgtcaggtcacatgcttagtgaaaggacagcaaccctcaactccatagattcacaaggggtgcatcgtgtgtcttctagcagaaaacaaactgatgatgtcttgaacattttatatttctatcagtttttccatagtgtatgtatttgagtaatttcagaatagatatctataaaagtcttacatatatatatggttgtatatgtgtgcatgtgtataaataacaacattgaccataaactatgaagctgagtatatttcacatatacaatgtatgtatattttcttatagttcattgtataatatttcatttgaagattttattttctctttttaaaattaggatcttacagcttttatcaggaaattattgctgttttccattgcaatttgtatcacatatatgtacttaactatcattggtgaacccctaattgtttggatggtaaagaagtttaatattaaatcaatgatgagaatgtatctttggggtaggttttatttcattaggaattcttattttacgtttggtagaaagcaaatagaattgttagctaatgatgcacacaataaaattttagtgacaaagatatgtagagtaagttttatttatatataccaaaaacagtactaaagaatactaaatttaatacaagtatgtgaatagcctagaataaaaatcatttctataataggaatgaaaaaacatgatcatgatcctttcagtgctgttataattttttatgtgtagttagaaaagtcacttattccactttttgaattaaaggaaaccttttgtgaagttgacatctgatgtcaagtatttccatttattttcttagccacctctgagctcctgaatttccaattttctcctttgtctcccattcctaatattcctcaaaaaaactcaaatattctctatcttaaaaaaagtcccaaagagagtatagaaactatagatgataatcaaatgaaactttcttcaaatgttaaatgttaaactttcgttaaatgttaaaaattatctgtgaaatctatatattgatgataggaaatgtattaatgatatgttttattataatggtgtaaatggtgaaatgacacaaagtgtgttgatgtatccattgataccaagttctattataagaaggaaatgtacagccttgctgaacagctaaattctgcatgactgtgttaattcttggtgttatgagattttaacattgttatgtaaaacttaaaataagtcaactcctcatctgatatatatatatatattacatccacatatatatgtatcagatccacatctgatatatatatacacacacattttatttatcatgcatcttccctagtacaatgtaatcaccataaaaagagaggtcatatctgtcttgctttgtctggactcacgggatctaaaagccagcacaaagaatagttggtcaaaaatgatacgttaatgaacacattagtggttggataaatggataatttgatgtggtaaaccagtgaaaacgaaactcttgacaaaatctgcagttgcttgaattttctagtttcaggttgaggttataggcttatcaaagaagaagcatttctcagagcaaaagtttggctattccccaattctaggggaagtatcactgtaatatagctttgatgcagctatatcaggtgtgtgaagtagagacaaggtggaatgtcaaaattagatggcacttattgtaatactttttgaaaagcatataaaggattctggtatatttgcacagggccaggttcagctgtgagtgccagctgctcggggttagcagaccccatcacaagaatgttagggaacttcccagcagctgccaaacacactcttgtttttagggaacatctctttctccctcagtatgacttatgctgccttcaatgctttgctgatacaaaagaagtgaacacaaaagaaatgaaaaaaaaaaaaagctagcaaactttgcaactggttaagctgtttgtaaatgtacccaatcactttctactgtgaatgatatatttctattatgatattttctagctggttactatatacacaaagatggcatttcgcttttaaaaattgagttagtaacgagtcacctttcttacacattatttatatatatattttagtatcctttctaaatgaatgttttaattgccatattataaatgcatggaaaagtgatgcaactgaatgtatatcttagctttgggtgtctagaactagagccagtgtctgagtttacagtgatgacatttatttgggaaggcaagtccagggcagcaatgaggggtaaatgtggaaactgaggcaaaagaagatgtaaaaccatgtatcatgatgttgacatgactttgccgttgtcacttcacaatgaggtgagacagacagcatggtgatcatcagatacatgcacttggctcccggtacttttccagaagggttacaaggggaaaccacagcaaatattagtccatggaagagagaaaagggagaatgtatcctagctgtcttttgttttctatttacctttggccaaagttattttgtggcagaactaccatctttgcttttcttccttacattatccaaccccttggtggctgtttgggaaagtcagactaaccaatacccccatttttctaagagatacttgttttgttttttttttaattttttgtctcttttcctcgcccctttccctatgtttcccactttctacttaactttttagaaatgcacaaaactgtttactatcccctcaccagacagtcccttcgggcaagttcatctaactatgtgctccaagagggatctctccttgagacttgacagttgatttgcagacaaaagtatgccctcatggaactctcacctccaggggttccccttagacctcacacccattaggaggggatgtggagaggatgctcaggtggccacttttacaactgctgtcctgctcatttccctccctactttataaaaatgtccactttctgctccaaaggtgaagtgtcacattagaaggcaggatgctttatgctccttccccaaaactaatctccaaataagttctctatttttgtatcagactgtgctctttttaattagactttacatgaagtgagcaactaagcttttctgttacaagacttcatgcccacagatacattcaagtcccagatggaaaggtgatctggatcaggcaaggtgctgaccatgggaacaggagagagtcaagggaatctgaggaagcacatgtttgtgtccaatatagtcccctccttgtgccactcagatgtgctcatgccctccaactgtggctggttttataagcagatgccttgtgtagttgcacgcagtcttgtgcttgaggggctttttgcttggattaatgttctgcacttgcatttttatttttcagacagcagatactcctccgctgaagagggaatagttctgcagtaattccctaggggtttgctttctcctctcctacgggcttgatggagacaggcacagagtcctataatgcccacgatgcatgcctctagcagctttgaattctgctggatcatctgactcaatgggcagagcaggttgggccacagcctatacctgctgtagagatatcttatgttctggattccacttgaaaccactagtctttgcattcattctgtaacccatctggttttggcagaggctaggtaggttaactgaacagggatttaaaaaggactttattaacaagtcagagcaatatcctctattgtggtatttgtggactccaaaaccccaagagagtcaataaacactgtgcttctcttttagtgataagaagtatttatagggcaacaggccacttactttaaaaaggatgtttctgctgggcatggtggctcacccctgtaatcccagcactttgggaggccaaggtgggcagatcacttgacgccatgagtttgagaccagcctggctaacatggtgaaaccaggtctctactttaaaaaaaaaaaaaattgccaggcatggtagcacatggctgtaaatacagctagtaaggaggctgaaggatttgaactgattgaacccaggaggcgaagtttgcagtgagccgagatggcaccagtgcactctagcctgggcaacagagcaagactctgtctcaaaaataaatatataaataaataaatggatttttcgacatgtagaccaggaatatgagaccttaaaaacaatatctatgttgcaggtttccaaatattatcaggtgtatctctttctgctagtattttatttctatttaacgttcaagtattttactatatttagggacctttccatttcctggttattgcaccaattactgtaacattattaataaattaacatgatgttttgcaaaatgtaaattaaactgagagcagaagtgacatcgccctgacataaaacagtgaagcagcactttcgttcttaccaaacaaaggccaactgttttaatctcccgacccacccgtgggtgaaaaacaagaaatattcacttaatcgagagccacatgcaaagtgccagaagctctgctctgctcagggaagataccacatcctagagagcatttgtaagtagtgatttaaatttatggaactctgccctcattttataatgtatctgattttggtagaggccatttaggttaagtggagagggatgtaaaaagactaccatcccctgtaactttcaagtgttttgtcatggtagtgatcaattccattccttgggagaatgtgattattatttttcaatccttgttgccagtggaggagaatttcgcaggcttcgccttggtcctgctctaatagtgtcccttactctgcaggtcaggaagaaggtgagagtcctgccagctgccatgtttgtccatttcaattacatgttcaggaagaggtaataacagcaaactgattagatccaccttgggatgtacatgagtcaaaaatctaggtagcatctgaccttcaaaaactcccagtgcaggcttggtatgatggctcttgcttgcaatcccggaactttggtaggcacagttgggaatatctattgaggccaggagttccagaccaccctgggctacatggtgagagcttgtctctacaaaaactaaaaaaagaaaaaacaacaacaaaaattagtttggcatggtggtgctcacctgtagtcccagttacacagaaggatgaggcaggatactcccttgaacctgaaaacaatatgcgagtcagttgctggtggcatccagaatccagttaaaaagagtgaggcctggttcaaaagtaatgaatttatttcaaacctagcttggggaaggggcacaaagagtcctgcctttaagtgtaccacttcacctttggagcagaaagcagacacttttataaggtaaggggggttattgagcaagggtagagggtcctcctgcaagcttggtgccttttctaccatgcaggggtctgtccagcagaccctgactcaatgacagaggaataacatacaccgacatgtatgttttgcttgtcagtccagccgagcatccgggccacttaacagactctaaggaagagtgctgtcagctgccgccccaacttgctggccttcttggcatttatttagaacacattaaatgacaaaaactttgagtcaacaccattagagggtaatcaactctgtcaccttcccccaggagagcaatcctgcctgtgagtgatgaaaggttagctttaggactacctgagtaagcaagctctttagataaactactatacattcctttgtgtctgtgccaaagtgctctggctctggcaaagagactggctgccttcagccaaactatctgaagttatgcaaaaacttttggtcttccaagaaggtcttttttttattttataattttccctaccattctgactgaacccctgcactaccagatagttgaattggcacctgcctttgcagaaatacattataaaagtggccaagtaggtatgctttccatatgccctcctgttggatgaaagtccttaggtaattcctagagtggagcagagcctggaatttcctggtccacttcctggaggtaaaaattctgtggtgggtgtgtttggtctgcaaattgactgtcagttctcaggagagattggtctcggagcacatagttagaaaaatgtgccctgcagggaatgtctagtgagtgggggtgaaaggttctatttgcatttatgaatggctaagcaggatacagggaacaaagggaaaggggagagaagagaaaataataataaaaatcataattcattctctttttcttagaaaaaaatggggcaatctgttacaaaccctggaattcaaggctgtagtgagtaatgatcatgccactgtactagatacagcctgggtgacagattgagactgtctctctgaaaaagccaacgcaaataacacagaaaacaaaagaaaattaaaaagaaaatctcctactccatctcatggaccacagtgtcttttgggtacctagataattagtgttagttcaggctctgctggggtggccaatatctggtttactggtggcaatttcatacgagtctgcagcaacgtcaagtcttgcctccccagaggaaggaattcaactgaggggcataagtaagaagagactgaaggaagtttctgagcaggaatggaagtttattaaaaagagagcaggaaagaaaggaagagactttattggaagtctcttggaagacacttggaagagaccacagcgggcactttggagatcaagtgcagtgttagatctttgacttgtggttttatatgttggtatacttctggggtcttgtgttccttttcccatgattcagccccttagggtgggctgctcacatgtgtggtagcctgctaacactttggaggtgagcatgcgcagtgtgtttactggagttgtacacatgcttgcctgaggcattcttcccttttttggtggaatgcccacagaaggtcatattccaccattttctctcttaacacgcatgccttagcctactcaccctattcctgagctgctgactaccaattttaagcgtttttatttattgtgaaattgcctctccctggcgcctgtgaccaattattatttttagagaggcagggtgtcaactgccagggcatcagctgatggccacctgacattccttgtgggtggtgggagccctcttctgccccactcatgcctgactaactacgtactgtaaaagccctatacctaaaagtctcagatggtatggatgtgtgtcctttcctctgggtactgtttatctaggaaatggctgcaggtctttgagaaagcatcatataaatacattctgaatattctgtggtgaattttcagcatctgttatcaaggggacttaagcttcccttcaattattgaattcttgttcttggaattggctcagtcctgacaactggttgaggtttcttgattttccacttcaaaggccgacctcaggaatgagcttttcagctccattttgctcttggtttataagtatttatcaaagtgtgaagcctcttcaactattggcttatgaactcattccaatgaagctactgctgtcatcgtttcattgattctgacgtttccaagatcaccagagtctatgttgccaaggttagtcttcatgttgcatgctctattagccacattgaacgtagtttatttgcatttcaggatgatgccctttcctgattttatctttgttcactgggcaccactccacttctcattctcctttgctagttgtcttttgtctctaaactgaaaacatgagattgcccaagatctcaattctacaatctctgcaatgatgcctgttgtgttggtgatctcatgtattctccttactgacaatgtagccaaatcagttaacagacaagcgtaagggtgattatccatttatattaattatttattcacacatcttggcatatagcacattatgtaaatatttttccttcaaatgtcaaatttacatttagaagtaacagtaccaggttggatgctgtggctcaagcctgtaattgagcaccttgggaggtttaggtagacagatttcttgagcacaattattggagaccaacctaggaaacatggtgaaacccagtctctagcaaaaatatgacaattagctaggtgaggtggtgtccacctgcagtcctagctacctgggaggctaaggtgggaggatagcttgaggctgggagctgtagagagcagtggagagcagtgagccaatccgaaaccactgcactccagttggggctacagagtgagaccatgtctcaaaaaatgaaaaatagaagtaataataccaaaaatctaagggaaaagatggagtattaataatatttttgcttgaatttccactaaatcagagtgagggtgacccaccatctaatttagttttatttaaaatagcattatacatattgatagattactatgcaggggattattattattatagaaataatgatctaagtagagaaatatacagatggaattatggttgattaacccacttatattacttgcagttgtacaggtagtatgttttagtatcttagttactaatctcaccttttacatatagctctataatcaaatatgagttattttttgtgtatggtatgaaataagaatataaatttatctttatgcatgtcctccaaatgtctttcagacctccaaatggataaacaaattgtggcatacttatacaatggaatactatacagtgatcaaaattaatgaactagacagacatgtttacaacagaataatacaacaaagaaaatgaacaaatttgagctacatagataatctcacaaatgtgagaggaattatcaagatggaaaaatacattcagtataatctcatttacataaagttcaagaaaaatatttttaatatattgtaatttgttacattggtgataaaactctacagtgaaacatatgagtgatcatcataacaattgggataatcaggagggaggagataaacgggaaatatcagcaagaagacatatattgggagtgtctggattactggcaaattctattttctgaccaaggtgtggtaacatcgatgttaatgttataattttttctcttactgtttattaggttttattatgctccatatgtaagttatgctccccaataaaaaaaaaaaagttaaaaaagcagaaacataaaatacattcctacatataaaattagggtgatacagcatattcttatagataccattgttattagagtatttgctgaataaaggagaatagagcattatggtactaagaaatccaagttaaaatttaaaatttttcttattgttttgagacagggtctctctctgttgcccaggctggagtgcacaagcagaatcttggctcagtgcaacctctgctatccaggctcaagtaattctcccatctcagcttccagagtagctaggacaacaggagtgcaccaccacgccctgctaattttttctgtttttggtagagacagggttttggcatgtttcccaggctggacttgaactcctgtgctcaggcaatccaactgcctcagccttccaaaatgctgggattacagatgtgagccactagacctgccctgaaacttttcttaaattaatatttttttaaaaagaagacataagcaagaactgtaaatccaccttcttaatgctaatatgaatttgaaacatcaaaacttgaatatttatgacagctaaacaccttttttctctttccaatttaattatttttaatacagatttcaaagtgtcacaaagtcatgaatttccaataaattatactacgatggaggttaaatatatagacctattatcccaaaatgtgtctctaaatgaaatatttgtattcatattgttagcattctaatttcacaatactaatcatgtgtacacctgtgtgttgggtaaaatattttgttaatataaattttttggttctgcattagagaaaaaaatcatagaaaggcaaatttaagatataaaacatatttagcatgatctttgagcatgtttgtgcatatataatgctactttgactgctatagtaaaatccagatttagtcaccatagctaagaatgtgaaaaagccttgcaagaatttggcttgctaatgatgctattaaaagatgaaataaagttgatatactgtattattgcagagagtatttttctatattcatattgaaaaatgcccaaaaagccccaaaatagaatcctaattgtcggatgtcacttttgctatgaatttttaaaatgtagtaaaagaaaaaaaaagcaaagaaattcttgaaaatatgttggttttacattattcttgatgaactaccacatgaggatacttctctaggcctgatgctgagaatcatagaagaaacatgaggccatgaggaagaatagtagggttctctcactaccctgaactccagtacttaaaaaacaagatggaaatcacatttatcaaatagcattctcccttttacctgccataattattatcatcatcatctatatatacatctatctcattaaatgatatatttttgaaatatttaaatacataatttggaaaataagtaatttttaaaagaccatcattgtgggaaagttacaggagtaaacagcaaagcttagtcatgctcaatacatgtagatttagaaattaagtatagcttattttacaatatattgcttaagcaaataattatttatagatgagcttaaactaatctttgtttcattatgatcactatagaaacaatttagattttagtgtaactaaaactaaccagtaagaaggacaaagcaaatgatacattttatgagctagcttttatttctaagagaggattttaggaccaaatagtcaaacagagttaagacctcagatcttctgtcacacttgtgtgagtgatggtggagttcgaaagttatagttctataaacaaaactatactacggatagggattaaatggtggaattctttagaaacaccagattcagttttgtttccatgagacttaaaagttcttcaatctttcataaacttgtatgtactgttttactctttgatcttttgaagattgttataaatgaagaagtcttgatttctgctaataaaaacagagtaaaatttaaatcatggaatagaaaggtggagctgtagttgagatactatattttattaattgtaatgacattttgagatccagtgctgctcactgaatttccctgtgaggagagtttgtggtgatgacccagcaacagacaagctactattcaaaaaaagctactcacatcaaatcaatttccagtttcttccaagttgcaggagaatgcgtagaccataattttgatctcttctgtgacctaagtattacaaaaagaagaaaatcactaaaattttcatgtcaggtgtactaaaaatttataaaaactattttttaagaacttggtgttataaatactttgtttagtttctccattaaaaatgatttatagcaagagaataaaagttcatttctacccctaaaacaataagataaaaaagagtaatgaatattgagaatccaatagacagagttgagaaccagttaaacataagaaagaattagtgaattggaagataactgcccagaatgaagcataaagagaccaagaggtagaaaatataaggctagagggtcagagacattgaagctacaatcagaacaactaacatacttctgcagttccagaagattagaagagagaaaatgggccagaagcattgtggagatttttccaaaagtggtaaagtgtatcagttcatatatttttagaaaccatcaaacttcagacaagataactaaaaccaaattaatataaaatgacaggacatcaaagaccaataaaaaacctgaaaggtaactaaaggaaaagacagattatgttaaagggaataactgtctaaatgacaacctgattttcaacagacaaaaatgaagctagaattcaatggaatcatgccttcagtgcatttcaaaagtagaatagaccttgataaacagaaacttaaaatgatatttttttcagataatagaaaaattattattattatcagtattattctatgtggagttggagtctcaatctggtgtccaggctggagttcagtggtaggatcatggcttactgcagtctggaactcccgggatcaaaccatcctcccacctcagccttgtgagtagcttccttatgcctggctttttcatttattgtagacacagtttcgctgtgttgcacaggctggtcttgaactcctgggtgttcctgactcagccttacaaaatgttgagattatgggtgtgagccaccctgccttgccaataaaaggactttttgaaactattaaattgaatatgcaaaaaggaatacaaattaatgaagtggtaaatatgtgcataattctaaatgaatgtttactgcataaaataataatgtcttgttggggtaattatataattgataagatatatgcaaatggcaaaaaatagaatggaggtaaagctgacaggagtacatttagttaaattatcttttaaacttttctatgtctatgaggatattttgcacaatgaccctgtaattctactcaaaggtatatatacagaggaattgcatcaaatgatatatgaaagaatgctctagtagaattattcgtaactgttcaaaaaagaagctggccaaatatatattaaggatagatcaatcattacagtaaatccacacaatggaacaatatagagaagtgaaaaaaaatcacatgtacttgcaactatgtgactaaatttcagaaacacaatgttgagtccaagaagccacaaacaagaagaacatgtaggattgcacctacacgcagtgcaaagcaggccagaccaagcgatggagtttagggttgcatacctagttggtaaagtgtaaagaaaattaaggaaataatcaccataaattttggatattgcttatctcaggaggtatgaagaaatgtttagggacttggaaagtggcatggaggtggacctaggttgtgtttggtgttccttgtcttgcctgcatcatggttacttgaatgtttatgatacactgcggtatttcccatttttgttttggttcatttctaagtgtgcattataattttaatgtaaaatgtttaattaggagatatgtctcatagaaattattattattcatctcattatatactgatggcaataataaactatttgtatacattgttatacaactctaagggagttgaagtgagcactttcttatttagttgcaacgtgaggaaatttgagatgatgttatcctccaaccccagaactttccaatggatttcttctagccttaattatcgacctcacaagaacaaacctttgcaatttcccatctatttttgcttttggctcctgaattcctgacacaacaaggttgtacatatttcccacactcttggtttagcagagttgatttatcagttatgtttttctgcaagagaaaaaccctccaaactacattagatgtttatatctcacatgttgttggatttcattttttttaagctgggtttggtggatggctctgtttatttgaaatggaccaaattctgaatcttggtagtagttagagtttggccaatttggtctggatcaggtgggggcaatctgacttcattagtttctcactctccttctgggaacagtgtactagccaggtgatattctcatggtaaatggaaagaggaagaatccccattatggaagccatctgaaatctctatgcaaagtgtagtaattttctgtttatcaaagcaagttaaatggttgtactccaagttcaggggcaaggtagtcagtcttctcagtgatggcaggatactgcaagactatatatcaaagggttgggtactcaggaattcttatacaattgctaaatgttttgtatagtaataaatatttaaacattagtcttgagagaaactttaccaaaggcctaagaattagagatatgtttgataaataaatattattcatgagctgaaagccctgagtgggaaaataggactaacttcacctagacaacctcctggaaactcctttttttattttggaactgatgagaaaataatttgttccattcgtgagtggtgtgcacatgtgtgtgtttgtgtgtgtatttatgagcttgtgaataatgaagttatacaaacgtattagcagcaaccagattctgaggttctccagaaaatcttagatatttttgataaaagcagtttggattctgtgtatttaaatctgtcatttaaaaaagtccatataggtgatgaacttaattatgaccaagctccttttaagaatttagacatttactatatgatctctgtattgggttataaaacttccctaacaactgaagtcactaaagacaaatgatggagaggttacacaaggaaaaattgcaaacactgaaagtgaatatgtccttgtttgcatactagcaaatgagaattcaggtttcatgtcaacttcagtatgaataattccagcctataacaaggacagacagtgaatgaatgggttaatttgagttgttttgaaaataagaatattttccataaagagagcgttgaacttacccattagcatgccatggtgatttctggcttgacattggtaacaacaattaaaagtaaaaagaatgtcacagcacatacacaaatcaggtgcatatagaatttaaggtcaggatattcaagcaatcacaaccagtgatattacaccagcattttaaaaatttctttttgtctgttcagacatgataacttttctgcccatcattttttccattctaatagtggttacatttgtgattggaaattttgctaatggcttcatagcattggtaaattccattgagtggttcaagagacaaaagatctcttttgctgaccaaattctcactgctctggcagtctccagagttggtttactctgggtattagtattaaattggtatgcaactgagttgaatccagcttttaacagtatagaagtaagaattactgcttacaatgtctgggcagtaatcaaccatttcagcaactggcttgctactagcctcagcatattttatttgctcaagattgccaatttctccaaccttatttttcttcacttaaagaggagagttaagagtgttgttctggtgatactattggggcctttgctatttttggtttgtcatctttttgtgataaacatgaatcagattatatggacaaaagaatatgaaggaaacatgacttggaagatcaaactgaggagtgcaatgtacctttcaaatacaacggtaaccatcctagcaaacttagttcccttcactctgaccctgatatcttttctgctgttaatctgttctctgtgtaaacatctcaaaaagatgcagctccatggcaaaggatctcaagatcccagcatgaaggtccacataaaagctatgcaaactgtgacctccttcctcttgttatgtgccatttactttctgtccataatcatgtcagtttggagttttgagagtctggaaaacaaacctgtcttcatgttctgcgaagctattgcattcagctatccttcaacccacccattcatcctgatttggggaaacaagaagctaaagcagacttttctttcagttttgtggcatgtgaggtactgggtgaaaggagagaagccttcatcttcatagattcacaagagcagcattgtgtatcttctagcagaaaacaaacgtgttatatgaagcattttatatttcttactgtgttttctgtaatgtatgtatatgaataactttcaagcatgtacctagaaaagtcttttacctaacgttagtctaaaaaagtgcgtatgtatatatatgtatttttgtgtgtatgtttgtatgaaaaacaaaagaacattgacagtgacatactcttttttgttttttcacacaaactgccaaattatacaaaatatgacaaaaattcttaagaattatgaatccatacctatttcatttatgtattttatatttcatttgaataatttatgatctatatttataattattaagaactatcagcttatctcaggaaagacattgctgttttctattgttatttgaaccacacaaatataccacagtgtgcttcgaattcattgtttgaacctgtaactttttggatggtaaggtcattcaattctaaatcaataataaggatgtgtctttgaggttttattccattatgaattcctattttatgtttagtaaaaagcaatcagaattattgatagaaaacaatgcacacaataaaatttgagtgacaagcatatgtagagtaagtttcaactatgtctaccataaacagttctgaggaatattagatttaatacaagcatgtgaatagcttagaaaacaatctcttctataatagggatgaaaaatcatgattgtgatcttgattgctattatcagtttccatatgtagttagaaaagtcatttcttccagcttttggattaaagaaaagctttttttttgaagttgagaggtgatgtaaactattttagtatttttttctaaagcacttttaagcccctgaattgttaattatacccttaccttccatttataaaattccttctaaacttcaggtaacagaacccaaatcttccttattctaaaaaaaaactatcaatgtaaaaatagtatagaaattatggaaaataaatcaatgaaatttttgtaaatgttaaaatggcatctatgaaatctatgttttaattatagaatgtgctttacagttataattttgttgtcaatgatgaaatgaaagtggttgacatattcattaataggaagttctattatgagatggaaatgtacagtcttgttcacagctaaattctacatgactgtattaattttggtgttatgaaattttaaaaatgtgatttaaaccttaagataaatcatccccacatgtgatttatgtgtttttttaaaatcatgtatcttcctcagtacaatgtaagaactgtaaaatcagatcagagatgatctcatctctgtcttgctttctgttgaatgtaagatcagagagcaagatgatctcatctctttcttgctttctgttgactcccaggacctagaacccagcaacaagaatagatggtcaaaaatgatattttaatgaacaaataaatgggtggataaaatgggtaagctgatgtggtaaaccaatgaaagggaaactcatcacaaaatctgcagttgcatgaattcccctgttctgttctcaggttaaggttacaggcttatccaagcagaatccttccgcagaggaaaagtttggctattccacaattttaggggaaatatgacaataatatagtcttgatgcagctgtatcaggtgtctgaattggagacaaggtagaacatcaaaattagatggcgcctattacaatatttttagaaagcgtataaacaaccttggtctatttgaatatgtatttttttctattgtgaattatatatttgtattatgatattttctagttgattattatttaaacaaaaatggcatttcattttaaaaattgagttagtaaccagctactttactaaaatgttttttatgtattacctgttattaaggtgatgacatttatttagaaatcaagttcaagacaaaaatggcaaggatatgtggaaattgagacaggaacaaatgtgaaacaatgtgtggtgatgtctggtatgactctgctggcagccacttcacagtgaggtgagagagacagcatgacggtcatcagatgcgtacacttggctcccagcacttttccagaagggctacaaggggaaaccacagccggcattagtccagggatgagagagaggagggagaatggagaatgtatctgctcagttgtcttctgtatttgatttcccattggccattgtttccctgaggcagaactaccatctctgctgttctgccttccatcatccagtccctaggtggaggttgtgaaagtcagacctcatgcccacagtgtggtgttccattcaagtcccaaatggaaggatgatctggatcaggcaaggtgctggccaggggaataggagatagtgaagggaatctaagaaagcacatgtctgtgtccaataccaccactctttgtgccgctcagatgtactcatgccctccagtcatggctggctttatgagcatatgacttgcacagttgcacagaggatactcctctgctgaagagggaatggtcttgcactaattccatagggatttgctctcccctctcccacaggcttgtcagagacgtgcacagagtcctataatgcccactatgtatgcctctaacagctttgaattctgctggatcatttggctcagtggccatagcagtttggatcagaacctatatctgctgtagagccctcttttgttctgggctccatttgagaccagtagcctatagaaacttcattaatgagtcagagcaatattctcaaatgtggaatatgttggctccaaaatcccagtaggcccccaaaacactgtgtctcttttgtagtgataggaaatatagagagagagcaacatgccgtttactttaaaaaagattgttttgacatgtggactagggacactgaaaacctgaaaacatcacctatgttgtcagtccctgaatcttcacatatctcttttcttctggtattttacttccattcaatgttatagtattttacaatattaagaatcttgcctcttcctgtttattttaccaaataatatataattattatttgagacagggtctcattctgtccatgaggctggagtgcagtggcaggatcatagctcattgcagcctcaaccttctgggctcagttgattctccctcctcagcattgctagcagctgggactgcagggacacaccaccttgcctggctaattttggtattttttgtagggctgggatttcaccatgttacccaggctggtttcaaactcctgggcccaagtcagcctcctaaagtgctggaattacaatcatgtgccacagggcccgggctgtaatattattaatatattaaattagcatgatgtttttaaaaaaatgtaaattaaacagagaacagaagtgacatagtcctgacataaaacagtgaagcagtgctattattcttacaatacaaggcaaattgtcttgattttccctcataaagggtgtagattaacaaatattcaccaaatgacgagccccgtaaaaagtgccagaagctatgctctgctctgtgaagacagtacatcctagaaagcatttgtgagtgttgattgaagtttatggtaatctgcactcattctataatccatctggttttggtagaggccagataggttaagtgaatccggttatagaaaggactaccatcccctgtaacttgcaagtgttttgtcacggcagtgaccagttccattccttagggaatgcggttattatattttatacattgggttgccagcagtggagaatttcagaggcttcaacttggtcctgctataataatgtcccttactctacagttcacgaagaatgtgaaagtcctgccagctgccatacgtatccagttcaattacacgttcaggaagaggtagtaactacaaactgattagatccaccttgggatggacatgagacaaaactctaggtagcatctgaccttcaaaacctccccctgcaggctggatgtgatggctcatgcctgtagtcttagtagtttgggaggccaaggtgggagaatcccttgagagcaggagttccctttgcaacatatggaaactccatgtctacaaaaaattgaaaaattagctggcgtggtgctgcatgcctatagttccaaatacttgggaaactgaggcaggaggattgcttgagcccagggtttcaaggctgtagtgggctatgatcctgccactgtactccagcttgggtaacagagggagactctgtctaagaagaaaaaaaaaaaagtgaaagttcttactggtgtcttaaatatcaagtaaaacaggttcaaatcaataattaacaatctttggttcctgcctatagcaaaaaggtaaaatggaaagcagttatacaaatagtatgttaactcataagaaaactagccaaagacagatttattatcatctgctttttttgttgttgttttctcgagacggagtctagctctgtctcccaggctggtgtgcagtggtgtgatctcgactaactacaacctccacctcctgggttcaaatgattcttttgctgcagccatctgagtacctgggattacagacgggcaccaccacacctggctaatttttgcatttctagtggatatagagtttcaccatgttggccatgctggtcttgaagtcctaacctcaggtgatccacctgcctcagcctgccaaattgctgggagccacgggcctggccaatcatctgctttttataggtgataatactgaggcagggagtagttgtaaaatggagtctcagatcatagctataccaagcagggaatctggtttcctgtcctggcagtctgactccaagatcccctcttagaaaccatcatactgtaaaaactgaaaagaaataaaaatccaagattggagactgattttaacatctattcatctaaaccattaagtaatcaaaaatgaattaaatagaggaaaatacaactgactattcatacacagagaagtgtagactcttcaatggaaaacatgttttttaagtgcccaaggaatagttataaaattgctgagtattttaattaaacaactaatatttaagtattaggctcaagagaataatttagtcaaagtcctaaatatgagaggctaagtttgataaagattgaaaatgcactgaaaagcccaagtaagaaaattattttttcattttagaaattataggacaataatatttcccaactatgaggtgtgtgtatgtgtgtgtgtgaacgtgtttgtgttaatgagcttgttaacaataagttatacaaaattattagttggcagcaacgagatttttaggaatattggccttcctgggcttcccaagaaaacgttggatgcttttggtaggaaaagttaggactcactaaatctggcacagaaaaggtgaatcaacagtggtcgtgattctagttttgaccgagctgcatataacagtgtaggcatctgatgtacgatctatgtattaggttagaaaatttcccttacaactgccattgctcagcacaaattatagagaggttaaacaaggaataaatggcaaaatgatgaataagaatatgacctgatttgcatgctggcaaatgagaattcagcttttacttcaacatcagcatgaaacattttatcttataacaaggtcacagcatttgaataggagttaatttgagctgttttggaaattatcatgttttccattaagacagccttgaactcattcagtagcatggcccggtgcgttcctgcttgacattagtcagagaatttaaaaggaacaagaacattactgcacaatcagaaatcaggtgcacatagaaattaaggtcaggaccttaaagggaatattgcccattgatattaggcctgccttaaaaaaattcagacatggtatgtttactactcatcattattatccataacagtaatggtagaatttgtattttcccataggcaccttcattacacttatatactgatttgatatttcaacatattattttctttgggtccttttaagtagttgttaaacaatgctgaaagttgccttacagtatgctgttaactaatcatattttctcaaagtcatttggcataatatttggttaaaagaagtatgtctagtataattacatgtgttcataataaaagagcacttaaaactttaaaaaatattagaaaaacgaataaaggaaaatgaatacatatataaaatatataattcattattaataaatgtgcataaaatcacactcatagaatttaaaaagagtaacaatttttgaattaaggatacattctaaattataatagaaaaaggcttataaaatgttagttttaataatactttatgtaaatattattgagtttcctgcttcatacatgtccctgcaaaggacatgatctcatccttttttatggttgcatagtattctatggtgtatatgtgccacattttctttagccaatctatcattgatggacatttgggttggatcccagtcttcactattgtgaatagtgccgcaatgaacatacgtgtgcatgtgtctttatagtagcatgctatttaatcctttgtgtagatagccagtattggaatcactgggtcaaatggtatttctagctctagatccttgaggaatcaccacactgtctttcataatggttgaagtaatttacactcccaccaacagtgtaaagcgttcctatttctccacatcctctccagcatctgttgtttcctggctttttaatgatcgccattctaactggcatgagatagtatttcattgtggttttgatttgaatttctctgatcaccagtgatgatgagcattttttcatgtgtctgttggctgcataaatgtcttctttcgagaagtgtctgttcatatcctttgcccactttttgatgggatttttttattgtaaatttgtttaagttctttgtagattctggatattagccctttgtcagatgtgtagattgaaaaattttctcccattctgtaggttgtctgctcactctgatggtagtttcttttgccgtgcagaagctcttcagtttaattagatccaatttgtctattttggcttttgctgccagtgcttttggtattttcgtcctcaaggccttgcctatgtctatgtcctgatctttcatatcactgagttttaatagctaaagttgagaagtctctcaaatttccgtcagtgataaaatgtataaataaattatggcacacttgtacaatagaacactatacagcaatcaaaatgaaccaactagagagacaagtttacaaagaatataaataaaaaggaaaatgaacgtatttggacaacatcgatatgagaggaattattaaaattgaaaaaagattcagtataattccatttatataaagtttacaaaaaatatttttaataaattacaatttattacattggtggcgaaattctaaagtgagacatgtgagtgattatcataacaattgggatagtagggatggaggaaacaaaagggaaatgatatcaacaggaaggcatatatggggagtgtctggattgctggcaaattctactttatgaccaagatgtgataacatgactcttaatgccataattttttaatttactgtacatttaggctttattactttataaatatgcttcacaataatgaaaatacttaaaaagcaaatcatataataaataaatataaaataggctgaaaaaacatattcttatagacatcatgataattagagttttgctgaataaagaagaatagagcattatgatagtaagaaatccaagataaaattttaaacttttctttaaatattttaaaaagtaagagataagcaggaagtctacctccacattcttaatgttagttttactatgaaacatcagattctggccgggtgcggtggctcatgcctgcaatcccagcactttgggaggccaagttgggtggatcacgaggtcaggagatggagaccatcctggctaacacggtgaaaccccctctctactaaaaatacaaaaaataagccaggcctgatggcaggcgcctgtagtcccagctactccggaggttgaggcaagagaatggcatgaacctgggagatggagcttgcagtgaggcagagcttgcagtgaggcggagcttgcagtgaggcggagcttgcagtgaggcagagcttgagtgaggcagagcttgcagtgagccgagatctcgccactgcactccagcctgggtgacagagcaagactccgtctcaaaaaaaaaaaaaaaaaaaaaaaagaaacatcagattctgagcatctgtattacactagacacctttttttcttatttccaatttcattatttatgataacatttcaaagaggcagaaattagtgaatttccaataaattatagtaatatagatattaaatacacaggacaatttttataaatttatctctaaatgaaataattatgcccatttttaccattcaaagattataccatgcatgtgtacacatatgtgaggaaaaatattttgatagtacaaagtttttgaatattagagaagaattagtagaaagataattttgttgaggcataaagcatatttagtgtaactactttgactgctgtaataaaatcacccagattttgtgacagtagctgagattaaaaataaacagtagagagaatttcacttgttaataatgctattaaaagatgaagcttatacactttataattgcacagagtatttgtgtaagttcatataaaagtggaataaaattaaacagccaaaaagagagtattctttgctagaggtcacttttggggtaatttttagaatgtggtaaaagaaaaaatatcttgcaaatcattagaaatatgttgattttgtgttactcttgatgaaatactatgtgagggtatttgtctaggcctgattctgagaataatataagaatcgagccaggcaccatggctcatggttgtaatcccagcactttggaagttgagactggtggatcacctgaggtcaggagttccagaccagcctggccaatatagtgaaacccactgtctactaaaaatataaaaattagctggatgtgatggacagcacctgtaatcccagctacttgggaggctgaggcaggagaatcaattgaaccttggaggcggaggttgcagttagctgagattgtgccattgcactgcagcctgggtgacaagagcgaaactccatctcacacacacacacacacaaaatgtaaagccatgaggatgaataatagtgttctcccaccacccttaactctagtgctttgaaaagaagactcgaatcacaattatttagtaacattctccctttcaggtgacatcatcatcattattatcatcatctacatttacatctgtcttattaaatgatttatttctgaaatatttacatacataatttgggtaacgtctatgtaatttccaagagatatcattgtgggaaagttacattagtaaacagcaaagttcatgtcaggctgaatacattgagatttagaaagttaagtgtagtgtagtgtagtttaaaatacattgcttaagaaaacaattatagatgatattaaactaatccaaggaacactataaaaagattttgattttagtataaataaaattgcttagtaagaaaaataaataaaccatttcatgatcaagctcttatttctaaagagaggattttagggctaaataaatcaaacagaagtaagctctcccccacatcttgtctatatcatttggataatgatgtaattcaaaggcacagagcaccttttcaacaacataagcaaagtgaaaattatgtcatggaatacaatgatgtatctgtggttaatgaactatattttatctattgcaatgatattttgaaatccagtgctgctctttgagttccctttgagcagagtttgtggtggggacccagcaacagacaagctaatatccaaaaaaaggtactcacatcaacttaatttccagtttctttcaaattgaaggtaaattctaacacaaagcttttattctattctctgactaaagtgttgggaaaagaagaaaattgttaccgttttcatttctaacatactaaaacaaaaaaaaaaaatcaaaaaaatcagaaacatttttaaaaagaacagagtgttaagagtagtttgttcagttttcctatagaaaataatgttcagaaagagaataaaagattattctgaacactaaaacaataagactaaaaaaatgaaatatcagtactgagaatccaatagaaagagtcaaccagttagagcactagaagagataattagtgaattagaagatagctacacagaatgaagcatagagagaaagaaatggaaaatgcaaggctagagggtaacacactgatgctatcatcaaaacacctaacatacttgtagagttctgtaagattagaggagagaaaacagagcgagagaaatgttgcagggatttttccaaaagtgaaaatgtatcccagcatatatctttagtaatcacaaacttcaggcatgataactaaaatcaagttaacaaaaaataatacaggacaccaaagaccagtagaaaatctgaaaagtagctagaggtagaagatagagtatgttgataagaactgcattctaaatacaacctgattttaacagaaaatatggaaggaggaattcaatggaatcatgtcttcagtgtgtttccaaagagtagtagaccttcataaacagaaattgaaaatgatatttttcagatataataaaaattactgaaaatacaaagttgaacatgcaaggagcaataaaaattaatgacgaaaaataagtgtgtaattctaaataaatgttgactgtataaaacaatattgtcttgttggattaaatgtataattgataagatatatgcaaatagcaataaagagactggagataaaggtgacaggaataaatttagtcaaactgtgttttgggcttttctatgtctgtgaggagaatttgaatgtcataatcaaggacgctgtaattctacacccagctatatatatgcaaaggaattgtagcaaatgatatgtgaaagaatgctcattgtagaattattctaacagctcagaaaagaagctgcccatatgtacatcaaataaggatgaataaataattacaataaaatcataaaatggaaaaacatagagaagtgaaaagaaatgaatcacatgtacatgcagttatgtgattacatttcagatccataatgttgagcacaggaagccatgaatacgaacatataggattgtatctatacagagttccaagcagaccaaaccaagctattgagtttagggttgcatacctagttggtaaagtataaagaaaaattttaaaaaatgatcatcataaattatggacgttgcgtattacaggaggtgtgaagaaaggtgtagagggatggaaacacattgaggtaaacctaggctgttagcaacattccatgtcttgccctacctgatggttacatgagtgtttatgacatattgctatgttttccatttttgttttggctcatttctaagtgtgcagtctagttataatataaaaattattaatcagaagaaatgttccatgaaaattattattactctgctcattatataccaaagggaaaaatacactgtatacattcatgtacagctctaaaagattttaattagaaaatttttgattttagttgtgactactgaaaatttgacaagatgtttcctgccaaccccagatttttcagtagatatttcttctagttttaattatctacttcatgtgacaaaacattgacattttccatctatttttcccttggatcctgaattcctgacacaacaggggtggacatgtttcccacacgcttggcttagcagaatacctatatcacttaagtttttctgcaagagaaaatcctccaaaactgcattagatatttgtgtctcatgtgtctttggatttcatttttgtcagctaggtttggtggatggctgtggtgattggagatgggccacattctgcatcttgaagctactttggctgatttaggctggataaagcagtggcattctgactccattagtttctcattcttcttctgggaacagtgtactcaccagatgatgttctcatggtgaatggaaaagagcaagaaactccaatatggaaaccgtcttaaatctctgtgtaaagtctactaatttgctgttcactgaagcaaattacatgagtgaattcagagtccaagttccaggtagtcaccctgcctgtggtgggaggatactgcaggattatatgacaaagtgtagcgtacttagaaatatttgcaaaattgctgactgttttaattaaataattaatatttaaacaaaaaacagacttgagaataaatttaccaaaggcctatgttgggcacaggcccccaaatctggccataaactggccccagtaaactggccataaataaaatctctgcagcactgtgacatgttcgtgatggccatgacacccatgctgaaggttgtgggtttaccagaatgagagcaaggaacacctggcccacccagggcaggaaaccacttaagggtattcctgagccacaaacaatagcatgagcgatctgcaccttaaggacatattcctgctgcagataactcgccagacccatccctttgtttcggcccatcccattgtttcccctgaagaatactttcagttaatctataatctatagaaacaatgcttatcactggcttactgtcaataaatatgtgggtaaatctctgtttggggctctcagctctgaaggctgtgagacccctgatttcccactccacacactatatttctgtgtgtgtcttaattcctctggcgccacaggattagggtctccacaaccgagctggtcttggcaggcccaagcatgagaaacatgtttgataaatattattcattgtctgacaaccctgagtggaatatgactaattccacctagatgacctcctggggaaactcgttttccaattggggatttataagaaaataattcattgcatctgctaagtgtgtgagtgcatgtgtgtctatgtattgaggagcttattaacaatgatgtcatataaatgtattggttatcagaaaccagattttaaggtgtattggcctcccaggactttccaaaataatcttggatgatattgataaaaggtttagattctggtattaaacaaaccatattggtattatcctagttatgaccaagctccttaaacaatttaaacctgtactgtatgatatgtgtattgggttttaaaatttccctatgtaacaactgacgatgctggacacaaattatggagaggttagcaaggacaacaattgcaaaacaattaaaaaaatgcctttatttgcatactaacacatgagaatttacttttcacttcatcctcaatataaaatatttcagcatatagtaagacagacagtgtatgaagaggagtgaatttgagctgttttgagaataagaatattttctatttctataaagacagctttgaattcatccattagcatatgatggtgctttcctgttgaaattagtcatgaatttaaaggcagaaaatgttactgcacatttaaaagtcaagtgtttatcgacattaaggtctggatattaagggaatcacaaccagtgttattaaggctgcattttttactttacttttcatttgttcaaacatgatatgttttctgctcatcattttatcaattctggtagtgtttgcatttgttcttggaaatgttgccaatggcttcatagctctagtaggtgtccttgagtgggttaagacacaaaagatctcatcagctgaccaaatttctcactgctctggtggtgtccagaattggtttactctgggtcatattattacattggtatgcaactgtgtttaatttggcttcatatagattagaagtaagaatttttggttctaatgtctcagcaataaccaagcatttcagcatctgggtgttactagcctcagcatatttcatttgctcaagactgccaatttctccaaccttatttttctccacctaaagaagaggattaagaatgttggtttggtgatgctgttggggcccttggtatttttcatttgtaatcttgctctgataaccacgggtgagagtgtgtggacaaaagaatatgaaggaaatttgtcttggatgatcaaattgaggaatgcaatacagctttcaaacttgactgtaaccatgccagcaaacgtcacaccctgcactctgacactaatatcttttctgctgttaatctattctccatgtaaacatgtcaagaagatgcagctccatggcaaaggatctcaacatctcagcaccaaggtgcacataaaagctttgcaaactgtgatctccttccttatgttatttgccatttactttctgtgtctaatcacatcaacttggaatcctaggactcagcagagcaaacttgtattcctgctttaccaaactcttggattcatgtatcctttgttccactcattcatcctgactatgggaagtaggaagccaaaacagacctttctttcagctttgtgacaggtgaaatgctgagtgaaaggacagaaaccctcaactccatagattcacaaagggagcattgtgtatcttttagctgaaaacaaactgacggtatctggaacattttatatttccattcgtttttccttagtgtatatatttgaataatttcaaaacagatacctagaaaagtcatctatctatctatctatctatctatctatctatctatcacacacacacacatatatgtgtgtgggtatatgtgtgcatgtgtgtgaataacaacattgaccacaaattatgaagccgagtatatttcacatatatatgtaggtatattttatgatagttcatcctatggtatttcatgtgaagaatttattacctctatttataattaggaacttacagcttttatcaggaaatcattgttgttttccattgtaatttgtaccacatatatgtacttaactatcattgtttgaacctctaattttttggatggtaaaaacattcaattctaaattaatgatgagaatggatctttggggtaggttttatttcattatgaattcttattttatatttattataaagcaaatagaatggttgttagctaatgatgcacacaataaaatttgagtgacaaacatacatacataagtagagtaaattttgtatgtgtataccaaaaactgttctaaaggatactggatttaatagtagtatgtgaatagattagaaaaaaatcatttctataataggaatgaagatacatgatcatgatactttcagtgctgttataattttttaatgtgtagttagaaaagttgtttcttccactttttgaattaaagaaaaccttttttttttgaaattgacatctgatgtcaagtatttccatttattttgcttagccacctccgagcccttgaatttccaattttccctttgtctcccattcttaatatttctcaaaaaaattcaattattccctctcttaaaataaactcaatgtaaacagggtatataaactatggatcacaattgaatgaaacattctgcaaatattgaaaattatctgtctaatctatatattgatgataggaaatgtattaatcatatgtttcattgtgggtgggcagtgagctgaggctcctcaagcatctctttctatttttattttgtttcttgacataggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgaggtgagtcaaagcacttagacgtgttttcaaaccactaatcttgatgattcagaaatgtgctcccttttccaatttcatcctgatacaaatgtatcatctccggatgatgccaatattctccccaattccatcatgagctgttctctataattcagaatctgtagactaagttgtaaaactaatgactgtcaatgtattctacatgaaatagtgggccaaagaaagagggaaacatgataagtagaaaaatatacatacaacatttttttcttacactaaagatcaaataaaacccataggaccaagcctcccacagatactttttataaattctggataaaatatttaaaaaaacagccattcattggcaatggagaatgaacaaaataggcagatactagagagaggtcagcacttggaagaagggaatagcaaggagtgagtttcctgattttatagctggccctagtgtgcaccaggcagaggactaaaacgtcagaagaaaactgtagacttactgggttgaagtaacagaggactgagtttggcataacacgagcagcaggaggtcaggagaaaatctgagaaaggagaaggccagaaaaggggagccccaacttctgaatataaactatccaaagctttgtctggtccctataccatgcatgtatagggcagacttcatgtagcccagctaaaataattaaattgagatttcagttatcatcaagcacagtgaagacagagatagcaacaaaacatattactttaggcaaagatactctattcttgaaaacctaaactacattccattacctttcataacagtcatattccttgtccattctggtttctaccttggttctaactcctacttttattaattacactaatcaaagtaattctctttcaaggagaaaactggaagttatgtaattgaagactattaaaaataactattttggcagatgtgcaaaattctcaagcgcatatattacaactttctatagtcatatacatcctttttacacttgcttgaattggtctacaaaacccccatgtttcatagtgtaatccaaacaaatagccactccataaaatataagaataaaagttatatttatttattatataacctttgattggtgaccacatttcagtattccaacttaactagaaattatccgaagattttcatcaactcactgaatttaatattagtctaaggtcttaaattgcaccaggaatcttggaaattaaatttaagctgataggctagagaaaataattactgtcaatatgtggagtttttcataatttgtattcagtttatttgaaagcataattttacattttttggtattttaacattatgtggacatattaatttaccttatcagtaaacagatataggaagtttaggaatttctttttttaaaatgtatttttaagtttcatggatacatactaggtgcatacatttattgggtacatgagatgtgttgatacaggcatgcaatgtcacataatgaagaatggggtagccatcccctcaaacatttactcttttttgttacaaacaattcagttatactctttcagtcattttaaaatgtacaactgaattatcattgattatagtcaccctgctgtgctatcaaatagtaggtcttattaattctttctatttttttttttttttggtaaccattaaccagccactccttccctttagcctccactacctttcccagcctttgtttagcatccatgtactctctatgtccatgccttctgtgcaaacattgcagttgtttctgatgtattcaacttaacataataatctccaattctatccatatattgctgcaaatgacaggatctcattttttaatggctcaattgtactccattgtgtatatgtaccatattatctttatctattaatctgttgctggacactcaggttgcttccaaatcatggctattgtgaacagtgctacaacaaacatgggagtgtagatacctgtttgatacacttatttcctttcttttgggtatatacacaccagtgagattggtggaacatatggtagctctaatttttgtcttttaagaaaactttcaatggttttccatagtggttttactaatttatattcccacctgaggtgtagaatggttcccgtttctccacatcttcaccagcacttgttacatgccttttggatataagctgttttaacggggttgagatgatatctatctcattttagttttggtttgcatttctctgatggtcaatgatgttgagcaccttttcaccttttcatatgtgtgtttgacatttgtatatcttcttttgagaaatgcatattcaaatctttcacccattgtttgatcagattgttagattttttttttcctatacagttgttaaagctccttttatattctggttattaatcccttgtgagatgagtagtttgcaaatattttctcccattctgtgggttgtctctttactttgttgattgtaccctttgctgtgcagaagtattttttaacttgatgtcatcccaattgtgcatttttgacttggttccctgtgcttgtggggtattactactcaagaaatttttgctcaaaccaatgtcctggggagtttctctgaagttttcttatgggagcttcatggtttgaggtcttaaagatacatctttaatccattttgatttgatatttgtatagatatatgggactagtttcattcttctgcatagggatattcagttgtcccagcaccatttattgaagagactgtctttttccagtgtacgttcttggcatctttttcaaaaatgagttcactgtaggtgtgtggatttgtttccaagttgtctattctattccgttggtctatgtgtctgtcttaatgccagtaacatgctgttttggttactacagcctctgtagtataatatgaagtcaggtaacatgattcctccacttttgttcttttttcttaggatacttttggctattctgggtcagttgtggctccatataaattttaggattgttttctctatgtctgtgaagaatgtttttagtattttgataggaattacattgaatctgtagattctttgggtagtatggccattttaacaatgttgatacttctaatccatggacatggaccatcttttcttttgttgggtgtccttttcaatttcttgcattagtgttttatagttttcattatagagatctttcatctctttggttgagttaatcttcagctatttaattttatgtgtggcttttgtgagtgggattaattttttgattttgttttcagattgttcactattgacatatagaaatactactaattttttatgttaattgtgtatactgcaaatttattgagtttgtttatcaattctaatagttttttggtacagtcttcaggttttataaatataagatcatattgtttgaaaacagggataatttggcttattcttttcctatgtggatgctctttatttatttttcttgcatgattgctctagctagagcttctactattatgttgaatagcagcagtgattgtgagcatttttggcatgttccagatcttagaggaaagtcttttagtttttcccaattcagtatgatactagttgtgggtctttctatatgatttttattatgtttagattttccttctatattcagatttctgagggtttttatcatgaaggaatattgaattttatcaaatgctttttcagcattaatttaaatgatcatatggttcttgtcctacattctgttgatatgatgtattacattgattgattttgatttgtgtatgttgaaccacccttgcatctcagggataaatcccacttggccatgaggaattatctttttaatgtattatttaatttgattcgctagtatattgttgagactttagcatcaatgttcatcagggatatttacttgtagttttcctttttcaatgtgtctttgtctggttttggtatcagggtaataagattttcaagaataagcctgggccgggcctggtggctcacgcctgtaatcccagcactttgggaggctgagttcggtggatcacgaggtcaggagatcaagaccatcctggctaacacagtgaaaccccgtctctactaaaaatacaaaaatttagccgggcgtggtggtgggcgcctgtagtcccagctactcgggaggctgaggcaggagaatggcgtgaacccgggaggtggcgcttgcagtgagtggagagcatgccactgaactccagcctgggtgacagagtgagactctgcctcaaaaaaaaaaaaaaaaaaaaaaaagaatgagcctggaagtagtccctctttctctattttttcagaagagtttgagtaggattggcatcagttctttaaatgtttggtagaattcagatctaaagccgtctgctcccaggcttttttttttttttttttttaaactgggagacattttattgcagaatttatctcattacctgtttttggtcttatcaggttttgggcttctttatggttcgatctttgtaggttgtatgtgtctaggaatttgtccatttgttttagagattccaatttattgatatatagttgttcatactagtcactaatatttctttgaatttctgttgtatcagttgtaatatctccattttcatctctgattttattaatttggatctttttttcttagtctgcctaaacgtttgtcaatgttgtttaacttttcaagaaaacaagtttttgtttcattgatcttttgtattgttttcttcatttcaatttcatttatttctgctgtaatttttattatttgtgttctactaattttgggtttgggttacttttgtttttctagttctttaagatacacaattaggttgtttatttgaatttttcttcttttctgatgtaggcttttatagctgtaaatttccttcttagtattgtttttgctgtatttcatagattttggtatgttttgtttccactatcatttgtttctagcaattttccatttccttttaaatttatttgttgacctactggtcattcaggagcatactgtttcatttccatgtgtttatatagtttccaaaattattcttgttattgatttctagttttatcccattgtggccagagttgatgcttggcaatatttcagttttttggattgtttaagacttgttttgtgatctaacatatggtctatccttgagaaaaatccatgtgctgaggaaaagaatgtttattctgcaacttttgggtgaaatgttacgtaagtatctaataatcagtttgttccatagtgcagattaagtctgatgtttctttgttgattttctgtctggaggatctgtccaatgctgaaagtggaatgttgaagtctccatctattattgaattgaggcttttctctttgctttgctctaataatatttgctttatatatctgggtgctccagtgttgagtgcacatatatttacaattgctatatccttttggtgaattgacccttttatcgttatatggtgaccttctttatgtcctcatagtttttgtcttgaaaactattttgtctaatattagtataggtactctacttttttgttttgttttttttttttttttttggtttgccttgacatggaatatctttttccatccctttattttctctctgtgcatgtctttataggcaaagtgtgtttcttagaggcaacagattggagttttttttttgttttgtttttccatttagccaaactatgtcttttgattggagagtttagtccattttcattcaacgttattactggtagtaaggtcttacttctgtcattttattatttcttttctggttatgttgtagtctgctattctttctttccttccttcctatttttcattagtgaaggttattttctctggtgatatgatatagtttcttgctttttatttttttgtgtatccattctatgctgttaggtttgagattaccatgaggcttgcaaatgctatcttctaacccatcatttcaagctaataaccacttagtactgtttacataagcaaacaaacaagcacaaaaacaaaacaaatgaggactctgcaccttaactccatcttctcaggttttaactttttgttttcactattaatatcttattgtactgtctatgtcttcaaagcctgttgtagctattttttaaaattatactttaagttctggggtacatgtgcagaacacgcagggttgttacataggtatacatgtgccatggtggtttgctgcacccatcaacccgtcatctacattaggtatttctcctaatgctatccctagctccccaccctccaaaaggcccaggtgtgtgatgttcccctccctgtgtctgtgtgttctcactgttcaattcccacttatgagtgataacatgtggtgtttggttttctgttcctgtgttagtttgctgagaatgctgatttccagcttcatccatgtccctgcaaaggacatgaactcatcatgaacagatgattatactgaggcacagagtagttataagatgaagtctcagagcatagctatgtgaagcagaaaatctggtttcctgtcttggcagtttgactccaaaatcctctcttagaaacaattatactttttaaatggaaaagaaataaaatccaagattggagactgattttaacatctattcctcttaatcctttaagtaatcaaaaataaattaaacggagaaaaatgaaaccaaatattcatatacaaagaactctagactcttcagtgagaaacatgtgtttttcaagtcacccaaaatagttacacaattgctgagtattttaattaaacaataaatatttaagtattaactgggctctagagaaaaacttagtcaaaggcctcagcatgagcgataagtttgataaatattgaaaatggtctgaaaagcccaagtggaaaagcagggctatttctacctggatgatgtccctgtaattaattttccattttggaaattagaggacagaaattccttctatccatgagggggtgagtatgtatgtatgtgtgtatgtttgtgaatgtgtttgtatgaatgagcttgtaaacaataagttatacaaaagtattagtagccaccaggatttaaggattattggcctttctgaggttcccaagaaaaccttaaatgcttttggtaggaaaagacgggattcattctacatattactggcgttgaaaatataaatctactttggtgatgatcctagttatgcccaagctccctttaccaggtaataaaaccaatgtgtcatctgtgtattgggttgttaaattgctgaacacaaattatggagagtttaaacaaggaaaaaattgcagaacatttaaaaaactcttcattggcatgctagtagatgagaattcaggttttacttcaacaacgatgtggaaaattttatcttacagcaaggacattgtgtttgaacaagagttaatttgagctgttttggaaattatcatattttccataaagagagcattgattacatccgttggcctattgagatgctttcctgtttgacattggtcacagaatttaaaaggaaaaacaacattactgcacacttaggaatcaggaatagaagtaaaagtcaggtaaagggaatctcgtcaggatatcaggcctgcctttaaaaaaattcagacatgataagtttactaccaatcattttttcaataacaacaataatatatttatattttcccatggacacctacattaagcttgtagactatttttatatttcaatatttttttctttgagtccttttaagagttgttcaacaatcctgaaatatcccttacagtatgctgttaactaattatattttttcaaagtcatttgacataatgattgattaaaggaagtatctccagtataagtacacttgcttataacaaaagagtatttgaaattgacattacttattttggaaaggatatgacacaatgggaattttcatacaccactcctagaattataaatctgtgacatcatttcggccgagtatggcattatctgattaagatgaaggatcacatcctaagacccagcatttatactcttatcagaatacatatacattcacatgcatatcactgagtttcaatagctaaagttgagaagtcctccaaatgtctatcagtcctccaaatgaataaacaaattgtggcatacttatacaatggaatactatacagtgatcaaaattaacaaacaagactgacatgtttacaacagaataatacaacagagaaaatgaacaaatttgagctacataaataataatacagatatgagaagaattatcaagatggaaaaatacatttagtataatctcatttacataaagtttgaaaaacattctttttaataattgtaatttattacattggtgataaaactctgtagtgaaacatatgagtgatcatcataacaactgggatagtcaagaaggaggaaaatgtcagcaagaagacatatattgggattatctggatggctggcaaattcttttttcttgccaatgtgtggtaacatccatgttaacgttacaattttttctctttctgtttctgttgtgttattactctctatgtgtatgttatgctccacaataaaaaatgttaaaaaagcagaaacataaagtatatttctaagtataaaattagggtgatacagcatattctcatagataccattgtaattagagtttttgctgaataaaggagaatagagcattatggtactaagaaatccaaattaaaatttaaaacttttctttttttattttgagacagcgtctcactctgttgcccaggctggagtgcacaagcgcaatcttggctcaatgcaacctccgccacctgggctcaagtgattctcccatctcagcctcctgaatatctaggacaacaggtgtgcaccaccacaccctgctgattttttctatttttttttagaggcaaggttttgccatgttgcccaggctgggcttgaactcttgtgctcaggcaatccacctccctcagcctttcaaaatgctgggattataggtgtgagccaccacacctgacctaaaacttttcttaaattaattttaaaaaaggagagataagcaagaactgtaaatccaccttcttaatgctaatatgaatttgaaacatcaaaatttgaatatttattattgatagacactttttatttccaatttgattatttatgatacacatttgaaagtgttagaaattcatgaatttccaataaattatactacgatggatattaaattaaataaatatatccaaaaatgtgtctctaaatgaaatatttatactcatatttttagcattttaatttcacaatactattcacatgtacacctgtaagttgggttaaatattttgttactataaattttttggctctacattagagaaaaataccatagaaaggcaaattttttaaggtataaaacatatttagcatgatctttgagtatgtttgtgcatatataattctactttgactgctatagtaaaatgatccagatttagtcaccatagctaagaaggggaaaaagcatttgcaagaatttggcttgctaatgatgctattaaaagataaactaaagttgatatactgtattattgcatagactatttgtccatgtttgtattcaaaaatgccaaaaaaaatcccaaaatagaatcctaattgttggaggtcgtgtttcttatcgaattttaaaatgtagtaaaagaaaaaaaagcaaataaatcgttgaaaatatgttggttttacattattcttgatgaaataccatgtgagggtacttgtctaggcctaatgctgagaatcatagaagaatcgtgaggccatgaggaagaataatagtgttctctcatcacgctgagctccagtacttagaaacaagcctgaaatcacatttaccaaatagcattctccctttgcacctgccatcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctccatggtaaaggatctgaagatcccagcaccaaggtccacataaaagttttgcaaactgtgatctttttcctcttgttatgtgccgtttactttctgtccataatgatatcagtttggagttttgggagtctggaaaacaaacctgtcttcatgttctgcaaagctattagattcagctatccttcaatccacccattcatcctgatttggggaaacaagaagctaaagcagacttttctttcagttttgcggcaagtgaggtactgggtgaaaggagagaagccttcatctccatagattcatgagaggggcattgtgtgtcttctagcagaaaacaaactggtggtgtatgaaacattttatatttcttactggtttttctatactgtatgtgtatgaataatttcccaacgtatacctagaaaagcctttgacctaatattagtctagaaaaaaatatatatatatgtgtgtgtgtgtttatgtgtgtatgaaaacttaagaacattgacaataacatgctcttttctgtttttttcatacaaactgccaaattatacaaaatatgacaaaaatttcttagaattttgaagccatgtatatttcattcatgtattttatatttcatttgtagaatttatgatgtctatttataattattaagaagtagcagtttatcccaggataaatattgctcttttctattgttatttgaaccacaggaatacaccacattgtgcttagaattcattgcttgaacctcgaatttattggatggtaaagtcattcaattctaaatcaataatgaggatgtatctttggtgttttattccattatgaatttctattttatgtttagtaaaaagcaatgagaattattgttagaaaacaatgcacacagtagaatttgagtgagaagcatatgcagagtaaatttaatgtatgtctaccataagcggtactgaggaatattagatttcatatgtgaatagcttaggaaaaaatcccttctctaataaagggatgaaatatcatgatcatgatctggattggtatcatcagttatgcatatgcagttagaaacgtcatttcttccgcttttgaattaaagaaaagctgtttttgaagttgagatctcatgcaaattattttagtattctttctaaagcacttttaagcccctgaattgctaattatatccttaccttccatttatgaaattccttctaaacttcagataagagaactcaaatcctctctttttgaaaaataaaatcaatgtaaatataatatataaattgtggaaaatatttcagtcaaactttttgtaaatgttaaaaaagtatctatgaaatctgtgtattaattatgagatgagccttaacgttgtaattttgtcatcaatgatgaaatgaaagggtgttgacatattctttaataggaagttctattataagaaagaaatgtacagtcttgttcacagctaaattctacttgactgtattaattcttggtgttatgaaatttaaacaatgtgatttaaaccttaagatgaatcatccccccacctgatttgtgtatttttttaatcatatatcttcctcagtacaatgtaaggactgtaaaaaaagagataatgtctgtcttgctttctgttgactcccaggaactcgaaaccagcaccaagaatagatggtcaaaaatgatactttaatgaacaaataaataggtggctaaaatggataagttgatgtggtaaaccagtgaaaaggaaactcacacaaaatctgcagttgcatgaattcccctgttccagtctcaggttaagattacaggcttatccaagcagaatccttctcctaaggaaaagtttggctattccacaattttaggggaaatatgacaataatatagtcttgatgcagctgtatcaggtgtctgagttggagacaaggtagaacaccaaaattagatggcacctattataatagtttgaaaaatcatataaacaactttggtctatttgaatatgtatttttttctattgtcaattatttgtattatgatattttctagttgattatttaaacaaaaatgacatttcatttcaaaaaattgagttagtaaccagctactttaccaaaatgtttttaatgtaatacctgttattgaagtgctaccatttatttagaagtcaagttcaagacaaaaatggcaaggacgtgtggaaattgagaccggaacaaatgtgaaacaatgtgtggtgatgtctggtatgaccctgatggcagccacttcacagtgaggtgagagagacagcatgatggtcatcagatgcatgtacttggcttaccagcacttttccagaagggctacaaggggggtccgcagctggcattagtccatgggagagagagaggagggagaatgtatctgctcatctgtcattagtcttctatttcctattggtcagggtttccttgaggcagaactatcatctctgctgttctgtcttacatcatccagtcccttggtggtggtcatgaaagtcagacctcatgcccacagtgtggtgatgcattcaagtcccaaatagaaggatgacctggatcaggcaaggtgctggccaggggaattggacatagtgaagagaatctgagaaagcacatgtttgtgtccagtaccgccactccttgtgccactgaggcgtgctcataccctccagtcatggctggctttatgagcatatgacgtccacagttgcatagggttttgtgcttatagggacttgtgcttagagggactctatgcttggattaatattctgcacttgctattttgtttgtcagacagaggatacttgtctgctgaagagagaatggtcttacactaattccatagggatttgctctcccctctccaacaggcttgtcagagacatgcacagagtcctataatgaccactatgtatgttctagcatctttgaatcctgctggatcatctggcacagtggccagagcagcttggagcagagtctatatcttctgtagagccctcatttgttctggattccacttgagaccagcagcctgggaaacttcattaatgagtcagagcaatattctcaaatgtggaatatgttgtctccaaaatcccaataggcccccaaaacattgtgtctcttttgtagtgataggaaatttatagagagagcaacatgccatatactgtaaaaaagattgtttcaacgtgtggtctagggacactgaatgctttaaaacatcacctatgctgtaggtccctgaatcttctcaggttggtttcttttcttctggtattttacttccattcatcgttagagtattttactatagttaagaaacttgccacttcctgattattgtaccaagtaatatattattattattattgctattattttgagacagggtctcattctgtccctgaggctggagttcagtggcaggatcacagctcattacagcctcaaccttctgggctcaagtaattctcccacctccgcattgctagcagctgggactgcaggggcacaacatcacgcctggctaatttttgtattttctgtagggctaggatttcacagtgttacccaggctggtctcaaaatcctgggctcaaatgatcttcccgtgtcggcctcctaaaatgatgggattacagtcatgtgccacagggcctggtctgtaatattattaatatattaaataatcacgatgttttaaaaaatgtaaattaaacagaagtgacatagccgtgatataaaacagtgacacagtgttattattatgatacaaggcaaattgttttgatttttcctcataatgggtgtagattaagaaccattcagcaaatcacaagcccagtaaaaagtaccagaagctctgctctgcttagtgaagacagcacatcctggaaagcatttgtgagtgttgatttaagtttctggtagtctgcattcattctataacccgtctggttttgatagaggccagataggtttagtgaatcggcttatagaaaggactaccatcccctgtaactttcaagtgttttgtcacggcactgaccagttccattccttagggaatgcggttattatattttatatattttgttgccagtagaggagaatttcagaggcttccctttggtcctgctataataatgtcctttactctacagttcacgaagaatgtgagtcctgccggctgccatacatatctatttcaattatactttcaggaagaggtagtaactacaaactgattagctccaccttggaatggacatgagccgaagctctaggtagtatctgaccttcaaaaactccccctgcaggctggatgtgatggctcatgcctgcagtcctagcactttgggaggcgaaggtgggaggatcccttgagagcaggagttcccttcacaacatgtggaaactccgtctgtacaaaaaatttaaaaaattagctggtgtgttggtgcatgcctatagttccaaatacttgggaagctgaggcaggaggattgcttgagcgcaggagttccaggctgcagtggactatgatcctgccactgtactccagcttgggtaacagagggagactgtgtctcagaagaagaaaaaaaaacaagtataagttctcaccggtatcttaaacatcaagtaaaacagtatcgagtaaaacaaaaaactaaaaactccaaaagtcaaaaacacttttaaaaagaacatggtgttaagagtagtttgttcagtttccccatagaaaatgatttatggaaggagaataaaagattattctgaacactaaaacaataagactgaaaaaatgaattatcaatattgagaatccaatagacagagttaaccagttggatacagtacaagagagaataagtgaattggaagatagctacacagaatgaagcatagaagggaagagatggaaatacacagagctagagggtaacacattgatgctacagacagaacacctaacatacttctggagttctgtaagattagaggagagaaaatagagcaagagaaatgttgcaaggatttttccaaaaggtataaaatgtatccctgaatatatttttagtaatctcaaacttcaggcatgataactaaaaccaaattaacataaaataatacaggacgcaaaagaccaatagaaaatctgaaaagtagctagaggtagaagatagagtatgttgaaaagaactgtattctaaatacaacctgattttaacagaaaacatggaagcaggaattcaatggattaatgggaatcatgtcttcaatgtgtttccaaagagtagtagaccttcataaacagaaattgaaaatgatatttttcagataaaataaaattactgaaaatacaaagttgaacacgcaaggagcattacaaattaatgacaatccatgctggctaacacggtgaaaccccgtctctactaaaaataaaaaaaaattagcctggcgtggtggcgggcacctgcagtcccagctactccggaggctgaggcaggagaatggctaaacccggaaggcggagctttcagtgagcagagatcgtgccactgcactccagcctgggtgacagggagactatgtctcaaaaaaaaaaaaaaaaattaatgacaatgaaaactaagtgtgtaattctaaataaatgttgactatataaaacaatagtgtcttcttggattgaatgtataattgataagatatatgcaaatagcaataaagaggctggagataaaggtaacaggaataaatttagtcaaactgtgttttgggcttttctatgtctgtgagaagaatttgaacatcataatcaaggaccctgtaattctacacccagatatatatacacagaggaattgtagcaaatgatatgtgaaagaatgttcattgtagcattattcataaaagctcaaaaaataagctgtccaaatatatatcaaataaggatggataaataattacagtaaaatcaaaaaatgaaaaaaatatagagaagtgaaaagatatggatcacatgtacatgcaatgatggggttaaattttggatacaaaatgttgattccaggaagccatgaataagaacatataggattgcacctatacatagatcaaatcaggccaaaccaagctattgagtttagggtcgaataccttattggtaaagtataaagaatattaaaaaaagaccatcataaattagggatgttgcttatcacaggagacatgaagaaaggtgtagggaattagaaagtggcattgaggtaaacttaggctcttagcaatgttccatgtcttgccctacatgatggttacatgagtgtttatgacacattgctatgttttccatttttgttttggttcatttctaagtgtgcagtctagctatatgataaaaattattaattaggagaaatggtccatgaaaattattattactctgctcattatatactgaagggaaaaatccactatttgtatacattcatgtgtaactctaagagattttaagtagaaactttctgattttagttgcaactttaggaaacttgacatgatgttacctgccaaccacagatttctgaataggtttttcttttaggtttaattacccacttcatatgacaaaacttggacattctctattttttccttcgatcctgaattcctgacacaacaatggtgggcatatttcccacactcctgatttagcagaatacctacatcacttatgtttttctgcaagagaaaactgagttagataattgtgtatcattatgtctttggattacatttttctaacctaggtttggtggatggctctggtgattggagatgggccacgtactgcatcttgccgctagtttggctgatttagggtagataaggcagtggcattctgactccattagtttctctttcttcttctgggaacagtgtgctagccagatgatgtcctcatggttagtggaaaagagcaggaaacttcaatatggaagccatcttaaatctctgtaaattctactaatttcctgttgactgaagcaaattacgtgagtgaattcagagtccaaggtcaaggtagtcaccctgcctgaggtgggagggtactgcaggattatgtgacaaagagtagggtacttagaaatatttacaaaattgctgaacattttaattaaataattaatgtttaaacaaaacagacttgagtgtaaatataccaaaggcctaagcttgagaaacatgtttgataaatattattcattgtctgacagccctgagttggaaaataagactaataccacctggatgagttcctggaaactcattttccatttggggaattataagaaaataattccttccatgccctaagggtgtgagtgcatgtgtgtctatgtgtttaggagcttattaacaatgatgtcatatcaatttattggttatcagaaaccagattttaaagtgtatcagcctcccagggatttccaagataatcttggatgattttgataaaaggtttagaatctggtatttaaatctggcataaaaataagtccatattggtatgatcctagttatgaccaagctcctttaacaatttagacatttactatatgatatatgtattgggttttacaatttccctatggaacaactgaagatgctgtatacaaattatggagaggttaaacaaggaaaaaaattgcaaaacaatgaaaaataatatgcctttctttgcatactaacacatgagaattcattttccacttcaacctcagtataaaaaagtacagcatatagcaaggagagaatctatatgaagaggagtgaatttgagctgttttgagaataatgaccttttctatttctataaagacagttttgaattcatctattagcatatgctggtgcttgcctgttgacactagtcactgaatttaaaggcagaaaatgttattgcacatttagtaatcaagtgttcatcgaagttaacatctggatgttaaaggactcagaacaagtgttactaagcctgcatttttttatctgttcaaacatgatgtgttttctgctcatcatttcatcaattctggtagtgtttgcatttgttcttggaaatgttgccaatggcttcatagccctagtaaatgtcattgactgggttaacacacgaaagatctcctcagctgagcaaattctcactgctctggtggtctccagaattggtttactctgggtcatgttattcctttggtatgcaactgtgtttaattctgctttatatggtttagaagtaagaattgttgcttctaatgcctgggctgtaacgaaccatttcagcatgtggcttgctgctagcctcagcatattttgtttgctcaagattgccaatttctccaaccttatttctctccacctaaagaagagaattaagagtgttgttctggtgatactgttggggcccttggtatttttgatttgtaatcttgctgtgataaccatggatgagagagtgtggacaaaagaatatgaaggaaatgtgacttggaagatcaaattgaggaatgcaatacacctttcaagcttgactgtaactactctagcaaacctcataccctttactctgagcctaatatgttttctgctgttaatctgttctctttgtaaacatctcaagaagatgcggctccatagcaaaggatctcaagatcccagcaccaaggtccatataaaagctttgcaaactgtgacctccttcctcatgttatttgccatttactttctgtgtataatcacatcaacttggaatcttaggacacagcagagcaaacttgtactcctgctttgccaaactgttgcaatcatgtatccttcattccactcattcatcctgattatgggaagtaggaagctaaaacagacctttctttcagttttgtggcagatgacatgctgagtgaaagaagagaaaccctcaactccatagattcacaaggggagcatcgtgggtcttctagcagaaaacaaactgatggtgtctggaacattttatatttctatcagtttttccatagtgtttgtatgtgagtaatttcaaaacagatacctagaaaagtcatatatatatttatgggtgtatatgtgtgcatgtgtgtgaataacaacgttgaccataaattatgaagctgagtatatttcacatatatagtatttatattttattatagttcattgtatagtatttcatttgaagaatttattatctctctttataattaagaacgtacagcttttatgaagaaatcatttctcttttccattgtaatttgtaccacatatatgtgcttaactatcattggtgaacctctaattttttggatggtaaagacattcaattttaaatcaatgataagaatggatctttggggtaggttttatttcattatgaattcttattttatgcttagtagaaagcaaatagaattgttgttagttaatgatgcacacaataaaattggagtgaaaaacatatgagtaaattttgtatatgtataccaaaacagtactaaagaatactagatttaataccagtatgtgaatagcctagaataaaaatcatttctataataggaatgaagaaacatgctgatgatcatttcagtgctgttataatttttttatctgtagttagaaaagtcattgcttccactttttgaattaaaggaaaccttttgtgaagttgacatctgatgtcaagtatttccatttgtttttcttagccaccttgagcccctgaatttccaattttctcctttgtctcccattcctaatattcctcaaaaaaactcaaatattctctatcttaaaaaaacaggccaatcaaaggagggtatagaaactatagaagataatcaaatgaaactttcctcaaatgttaaaaattatgtaaaaattacataaaaatctgtgaaatctatataattgataggaaatgtattaatgatatgtattattataatggtgtaaatggtgaaattacacagtgtgttgatgtatccattgataccaagttctattataagaaggaaatgtacagccttgttgaagagctaaattctgtgtgactgtgttaattcttggtgttatgaaattttaacattattatgtagaacttaaaataagttaactccacatcatatatatatctatgtatctatatctatatctatagacatatatatatatatatatatatatatatcgcttatcatacgtcctccctagtacaatgtaatcaccataaaaagagaggtcatatctgtctcgctttctcttgactcacaggacctaaaagccagcacaaagaatagttggtcaaaaatgatatgttaatgaacacataagtgattggataaatggataatttgatgtggtaaatcagtgaaaatgaagctcatcataaaatctgcagttgcttgaattttctattttcaggttgaggttataggctttttgaagaagaagcatttctcagagcaaaagtttggctagtccacaattctaggggaaatatcactgtaatatagctttgatgcagctatatcaggtgtgtgaagtagagacaaggtggaacgtcaaaattagatggcacttattctaatgctttttgaaaagcatattaaagattttggtatatttgcacagggtcagggtcacctgtgagtgccagctgctcggggctagcagaccccatgacaagaatgttagggaacttcccagcagctgccaaacacacttttgtttttagggaacgtctctttctccttcagtatgacttatgctgccttcaatgctttgctgatacaaaagaagtaaactcaaaagaagtaaaaataaaagctagcaaactttgcaactgattaagttggttggaaatgtacctaatcactttctactatgaatgatatatttgtattatgatattttctagctggttatcatatacacaaaaaggcatttcatttttaaaaattgagtttgtaaccagtcacctttcttacacattatttgtatatttttttagtatcctttctaaatgaatgttttaattgccatgttataaacgcatggaaaagtgatgcaactgaatgtatatcttagcttttggtgtctaaaactagagccaatgtctgagtttacagtgatgacatttatttgggagggcaagtccagggcagcaatgaggggtaaatgtggaaactgaggcaaaagaagatgtaaaaccatgtgtcgtgatgttgatatgattttgctggtggccacttcacaattagtgagacagacagcatggtggtcatcagatgcatgcacttggctccccatacttttccagaagggttacaaggggaagccacaacaaatattagtccgtggaagagagaaaagggagaatgtatcctagctgtcttctgtcttctatttccctttggccaaagtttgtttgaggcagaactaccatctttgcttttcttccttacattatccaaccccttggtggctgtttgggaaagtcacactaaccaatacccccatttttctaagagatagtttttttttaatttattttttctcttttcctctcccctttccctatgtttccccgctttctacttaactttttagacatgcacatagaactgtttactttccccccaccagacagtcccttcgggcgagttcatctaactatgtgctccacgagggatctctccttgagacttgacagttgatttgcagacaaaagtatgccctcatggaactctcacctccaggggttccccttagacctcacatccattaggaggggatgtggaaaggatgcccacgtggccacttttacaactgctgtcctgctcatttccttccctactttataaaacgttcactttctgctccaaagatgaagtgtcacgttggaaggcaggatgctttgtgccccttccagcaagctaacttccaaataaattctctatttttatatcagaccttgttcttgttaattagactttacatgaagtgagcaactaagcttttctgttacaagacttcatgcccacagatacattcaagtcccaggtggaaggatgatctggatcaggcaaggtgctgaccatgggaacaggagacagtcaagggaatctgaggaagcacatgtttgtgtccaatatagtcccctccttgtgccactcagatgtgctcatgccctccaactgtggctggttttataagcagatgccttgtgtagttgcacggggtcttgtgcttgaggggctttttgcttggattaatgttctgcacttgcatttttatttttcagacagcggatactcctccactgaagagggaatagttctgcagtaattccctaggggtttgctttctcctctcctacgggcttgatggagacaggcacagagtcctatgatgcccacgttgcatgcctctagcagctttgaattctgctggatcatctggcacaatgggccgagcaggttgggccagaccctgtatctgctgtagagatattatatgttctggattccacttgaaaccaggagtctttgcattcattctgtaacccatctggttttggcagaggctaggtaggttaactgaacagggatttaaaaaggactttattaacacatcagagcaatatcctctactgtggtatttttggactccaaaatccctagaggctcaataaacgccgtgcttctcttttagtgataggaagtatataggaagccatttaccttaaacaggatgtttctgctcggcatggtggttcacgcctgtaataccagcactttgggagaccaacgcaggcagatcactggaggccaggagtttgagactagcctgagcaacatggtgaaaccccatctctacttaaaaaaaaatacaaaaaaatttagccaggcatggtggccaatgcccgtaaacccagctactcaggaggctgaaggatttgaattgattgaacccaggaggcgaagtttgcagtgagccgggattgcaacactgcattccggcctgggcaacagagcgagactctatctcaaatataaattaattaattaattaattgatttttcaacatgtggaccaggaatatgggacccctgaaaacaatatctgcgttggtgttctctaaatattttcaggcatgtctctttcttctgatattttatttctatttaatgtttaagtattttactataattaggtaactttccatttcctggttattgtaccaattaccgtaacgttattaatatattaaattaacatgatgttttccaaaatgtaaattaaactgagagcagaagtgacaaagccctgacataaaacagtgaagcagtgctcttgtttttaccacacaaaggccaattgttttaatctgctgacccacccatgggtgtaaaataagaaacattcactaaatcaagagccacatgcaaactgccaggagctctgctctgctcagggaagataccacatcctagagagcatttgtaagtagtgatttaaatttatggaaatctgcattcattttatagtgtatctggttttggtagaggccagataggttaagtggataggcatataaaaagactaccatcccctgcaactttcaagtgttttgtcatggtagtgatcaattccattccttggagaatgtgattattatttttcaatcattgttgccagtggaggagaatttcacaggcttccccttggttctgctctaataatgtccctgactctacaggtcaggaagaaagtgagagtcctgccagctgccatgtgtgtccattacacattcaagaagaggcaataacggcaaactgattagatccaccttgggatggacatgagtcaaaactctaggtagcatctgaccttcaaaactccctctgcaggctgggtatgatggctcatgcccgcagtccccgcacttttggaggcggaggtgggaatatctcttgaggcccagagttgcagaccaccttgggctacacagtgacagcctgtctgtacaaaaactaaaaaacagaaaaaacaacaacaaaaaattagtttggcatggtggtactcacctgtagtcccagttacccagaaagatgagacaggagactcctttggacctataaccaatatgcgagtccgttgctggccgcatgcagtgtccagttaacaaaagtgaggtctggtacaaaagtaatgaatttattccaaacctagcttggggaaggagcacaaagtgtcttgcctttaagtgtaccacttcacctttggagcagaaagcagacacttttataaggtaaggagggatactgagcaagggtagagggtcctcatgcaggcttggtgccttatctatcagacagttgaattggtgccttcctgtgcagaagtaacttgtaaaagtggccaagtgggtatgctttcaatatgcccttctgttgggtgaaagtcctcaggcaactcccagagtggagcacagtctggaagttccaagtccatttcctggaggtaaacattccttggtgggtgtgctttggtctgcaaattgactgtcaattctcagaagagatctgtcttgctgcacatagttagaagaacgtgccctgcagggaatgtctagtgagtgggggtgaaaggttatatttgcatttatgaagggctaagcaggaaacagggaacaaaaggaaaggggagataagagaaaataataataaaaaaatagtaactcattccctgtttcttagaaaaaatggggcactctgttacaaacccaggaattcaaggctgtagtgagttatgatttgccactgtactacatacctcctaagtgaaggattgagactgtgtatctaaaaaacccaaatgcaaataacacacacacaaaaagaaaattttaaaaaatctcccacttcatctcatggactgcagtgtcttttgagtacccagatattactgttagttcaggctctgttggagtggccaatatctggtttactggaggcaatttggtacgagtctgcagcaacttcaagtctaacctcctcagaagaaagaattcaactgaggggcataaggcggaaaaagagactgagggaagtttctgagcagcaatggaagtttattaaaaagatttagagcaggaaagaaaggaaagtacacttggaagagaccacagtgggcattttggaggtcaagtgcagtgttagacctttgacttgtggttttatatgttggtatacttctggggtcttgtgttccttttcccacgattcttcccttagggtcttgtgttccttttcccatgattcagccccttagggtgggctgctcacatgtgtggtggcctgctaacactttggaggtgagcatgtgcagtgtgtttactggagttgtacacatgcttgcatgaggcattcttcccttttttggtggaatgcccccagaaggttgttttctaccgttttctctcttaacacgtatgcctcagcctactcgccctattcctgagctgctgactagcaattttaagcatctttacttattgtgaaattgcctctccctggtgcctgtgagcaattatcatttttagagaggcagtgtgacaactgccaggccatcacctgatggccacctgacattcctggtgggtggtgagagccttcttctgccccgctcatgcctgactaactatctactgtaagagccctatacctaaaagtctcagatggtgtggatgtgtgtcctttcctctgggtactgttatctgggaaatggctacaggtctttgagaaagcaccgtatgaatacgtcctgaatattcttgtggtgaattttcagcatccttttcaaggggacttacactttccttcaattattgaattcttgttctcggaattggctcagtcctgacaacaggttgaggttctttgattttccacttcaaaggctgacctcaggaatcagtttttcagcctttgaagtgaaaaggcttgctcttggtttataagtatttttcaaagtatgaagcctctttaactattggcttatgaactcattccaagaagctgatgctgtcatcagttcattgattctgacatttgcaagatcaccagagagtctatgttcccaaggttagtcatcatgttgcatgctctattagctgcattgaacttagtttatttagatttcaggatgctgccctctcctgattttatccttatccactgggcactacttctcaatctcctttgctagttctcttttgtctctaaactgaaaatatcagactgcccaaggtctcaattcttcaatctctacaatgatgcctgttgtgttggtgatctcatgtaatctctttactgacaatgtagccaagtgattcaacagacaggaataaggctgattatccatttatattatttatttattcacgcatgttggcatatagcacattatgtaaatatttttccttcaaatgtcaaatgtacattttgaagtaacagtaccagggtggatgctgtggcttaagcctgtaattgagcaccttgggaggcttaggcaggcagatttcttgagcccaattattggagaccaacctgggaaacatggtgaaacccagtctctagtaaaaatacaacaattagccaggtatagtggtgtccacctgtagtcctagctacttgggaggccaaggtgggaaacagattgaggctgggagctatagattgcagttagccaatctcaaaccactgcactccagtttaggctccagagtgagaccatgtctcaaaaaataaaaatctagggagaatcaataatatttttgcttgaatttccactaaatgagattgagggtagcccagcatctaatttagttttatttaaaatagtaattttaatatcaatagattgataggcaggggattattattattatagacataatgatctaagtagagaaatacacagatagaattatggttgattaacccacttgtattacttgcaattgtacagttagtatgttttagtatcttagttactaatctcactttttacatttagctctataatcaattaaatatgagttattttttgtgtatggtgtgaaataagaatagaaatttatctttatgcatgtggatattcaatgttctcagtatcatttgttgaaaaaatgattaattcctattgaactgcagtggtaccatttttgaaatcaattaccatcaatgtcagtgttaatttctggactctcagttgtgtttcattgttcttttgtctactgtaatgccagtaccacagaattctgattagtgcagctttgtagttagctttgaaaccagaaagtgtaatcctccaaatgtgttattttatcaagatttattttggtgatctggtcactgggtattttcagatatattttaggactggtttttcactttttgcaaaacaggcttgttgggatttgatagggattgcactgagtatataagttgacccttcacctgcaaagactctccttgtgctggatttcagttcagctggccctccttgcttgtacaactctgtgatgaattgaatatataattttggccttttattactcttatcctagttgttgcagaaggatatcttgcctttctgaaccttctgtattctgctcaaaaatggaagttctcagctaggtgcagttcacgcctgtatccaagcattttgggagaccaaggtgggaagatcgtatgagcccatgttttcaagaccatactgggcaacatagggagaccccatttctacaaaaaaactgaaaaattagctggctgtgttggtgcacgcccatagtcacagctactccagaagctgaggtgggaggatctcttgagcccaggagtacaaagctgaagtgaactaccactgcactccagcctaggcgacagagcaacatcctttctcaaaacaaaaaaggaaaagtggaagttttcactggtatcttttaagtatcaagtaacacagaatcgaaagaataactaataatcctcggttcctgcctgcactgaacatgtaaaattgaaagcagttatacatatactatactagcacctcataaggactacccagagtattattatcatctgcgttttatacataattatactgaggtagagagaattcgtaaaatggagtctcagatcatagctatataaagcagaaaatctggcttcctgtcctggcagactgactccaagatcttctcctagaaacaattatactataacaactggaaagaaataatatccaatattgaagaccgatttttaacatctattcatcttaaaccattaaataataaaaaatacattagagaaaaataaaagtgaaaatttacatacagagaagtgtaggctcttcaatggaatacacatgttttttaagtgcccaaggaatatttacaaaattgctaaatattttaattaaacaattcatatttaaatattaactagactcaagaaaatgacttactcaaaagcctaagcatgagacacaagtttataaatattgaaaatgggctgaaaacatgattgggaaattagggctatttcaacttggatgacctgcctgaaattcattttccattttggaaattacaggacaataattcctcccatccatgaggagcatgtatgtgtgtgggcacataagtttgtgttaatgagcttgttaagaataaagttatacaaaagtattagttagcagcaaccagattttaaggaatgttggccttcctgggcttcccaagaaaaccttggagtcttttaataagaaaactttggattctgtctacataaatctgacattgaaaaaataaattcacagtggtcatgattctggttatgaccaagttccatatgacagtttagacatccaatgtaggaattacgtgttgggttttaaaatttccataacaactgacattgctgaacacaaattatggagaggttaaacaaggaaaaatattgcaaaacaatgaaggaaaatatgtctgtatttgcatgctagcaaatgagaattcacctttcacttcaacaacagcatgaaaaatttcatcttatagccaggacatagtgtttgaatagaaatttaattgagctgttttgggaattattgtgttctccataaagacagcctcaaactcatccattagcacaccctggtgctttcctgtttgacactggtcagagaatgtaaaaggaaaaagaacattactgcacattcagaaatcaggtgcacatagaatttaaggtcaggaccttacagagaatcttgtccagtgataatacgcctgccttaaaaaaattcagacatggtaggtttattaccaatctttttttgtgctagtaatggtagaatttattttttcctgtggacacctacgttaaacttatagactacttttacattttaacatttttttcctttgagttcttttaggagttgttaaacaatcctgaaatttcccttacaatatgctacaaactaatcataatttctcaaattcatttgacataatgattgattaaagaaatatgtgtagtataattacacctgctcataacaagagtatttgaaacttcaagaaaaaatagagaaattaataaagaaatatgaataaatatatggaatatataattcattcttaataaatgtgcatgaaatcagtcatgtaattaaaaagcaacataattttttgaactaaaaatacattctgaattataatagaaaaatgtttctaaaatgttaactttaataatagtgtatgtaaatatcagtgtaaaatttaatctgatgttactaattttggaaaggatatgacacaatagaaattttcatacactactcttaggattataaagtacaattactttggctgaatatggcattacctgattaaggcgaagtattttttattgtaccacactttagaatgtggtaaaatgaaacaatatcaagtaaatcattgggaatatgttggttttaagttattcttgatgaaatattacctgagggtgtttgtctaggcctgatactgagaataatataagaattataaggccatgaagaaaagttaaaatagtgttctcccatcgccctgaattccagcacttaggaaacatgattgaagtcacatttacagaataaaatagtcccttttagctgacatcaacatcatcatcaatcatctacacctatctcattaaatgatttatttttcattgtacatgattttgataatgtctaagacatttttaaaagattatcattttgggaaatttgcattagtaaaagtaaagttcaagtcaagctgaatacatttagatttagaaattaagtgaagtttagtttaaaatgcattgcttaagcaagtaattgtagatgaccttaaactaatccattgaatgctataagaaagagtttgattttagtgtaaataaaattccttaattagaaaggcaattaaactgtttcatgatcaagctcttattcctaaagagaggattttagattaaataaatcaaacagaagtaagccctcacatcttctctgtctcgcttgggtaatgatggagttcaaagtcacagagccccatttctacaacataaacaaagtaaaaattagttcataaaatagaatgatttagttgtggtttagggactattttttatttattggaattgcattttgagatccaaagctgcttattgaatttccatatgaggagagtttgtgtgaggacccagcaacagacaagctgttttccagaaaaagctactcacatcaaattaatatccggtttctttaaaattgcaggaacatggctagaccaagcttttattctattatctgaccagagttgggaatagaagaaaattgttactattttcatggctagagtactaacaactccagaaaaatacaaggctggagggtaagagacactgacgctatggtcagaatatctaacatacttctggagttctggaggattagagatgagaaatggggcaaaagcaatgtttgggaaatttttccaaaaatgatgaaatgtatatatttccatctctatatatttaggagccatcaaattttggacaagataactaaaaaatttaaaataaaatgacacaggacatcaaagaccaatagaaaatctgaaaagtagctagaggtgaaaggtagattatgttaaaaagagccacattctaaataacaaactgattttcaacagaaaatatgaaagcgggaattcaatggaatcatatcttcagtgtgtttccaaggaacagtagacttttatagacagaaattaaaaatgatattttttcagataaaatataaactaccaaaaatacaaaattgagcatgcaagaaggaataaaaattaatgaaaatgataaatatgtacataattataagtgaatgtttaccatctaaaataatagtatcttcttgttggactaaaggtgtaattgataagatatatgcaaatagtaataaagagactggagttacagaaataaatttagttaaagtattttttggacttttctatgtctgtgggcagaatttgtacatcttaatcaaggaccctataattctatacctaggcatatatgcaaaggaattgtagcaaatgtatatgaaagaatgctcatagtagcattattcataatagttcataaaagaagctgtccaagtatatatcaactaaggatagataattatagtaaattcataaaattaaacaatatagagaaatgaaaagaaataaatcacatgtacatgcatctgtctgattaaatttcagattcataatgttaagtccaggaagccatgaataagaacatataggattgcacctatacacagttcaaagcaggccaaaccaagctattgagtttagggttgcataccttgttgataaagtataaagaaaatcaaggaaatgatcatcacaaataatggatattgcttacctcaggagatatgaagaaaggtatagaggcttggaaagtgtcatggaggtggaactaggctgtttgcagtgttccttgtcttgccctacatgatggttactcgactgtttatgatacattgctctatttcccagttttccagttttgttttggcacatttctatgtatgcattataattttaatataaaaattttgaattaggagaaatgtctcatagaaattattaatcttctcattacgtactaaggggaaaagaaactatttatatgcattcttatacaactctagagagttgaagtagaaactttcttattttagttacaacttgtagaaatttgacatcatgtcacctgccaaccccgtatttttccgtagctttatttcagtttttttctttcagctttaattatgcacctcacatgacaaaactttgatattcctcatctatttttcccttggcttcaggattcttgacacaacaagggtagacatatttcccactctcttggcttagcaaagtatttctatcatttagcatcattttaaaaagaaacttctccaaaactacattagatatttatatctcacatgtctttagattccattttcctaagctgggtttgggtggatcactctggtaatatgagatgggccatgttctgcatcttgaagttagagtttggccaatttaggctacatctggagggggtgatctcattctcattctgcttctgggaatggtgtactagtgtggggatgtgcttgtggtaaatggagaagagcaagaaactccaatgtggaagccatctcaaagacgtatacaaaatttactaatttccagttcatcaaagcaaattacatgagtgagctcagattccaaggtcaaggtagtcaccctgcctatggcaggaggacactgcaagataatatatcaaaggatgagggagtcaagagtatttacaaaacagctgaatagtttaattaaataattaatatttaaacattaaatagacttgagagtaactttaccaaaggcctaagcatgagaaatatgtttgataaatattattctggtctgaaaaccctgagtgggaaaacagaactaattccacctggatgaccttctggaaactcattttttcatttttttaaattaaaagaaaataattccttccaaccccaatgggtttaagtgtgtgtttttgtgtttatgagcttgttaacaataaagtcatataaaagtattggttagcagcaacctgattttaaggcgtattggccttcttgtggttcccaagaaaaccttggatgattttgataaaaggtttgggttctgtatatttaaatctagcattaaaaaataaatccatatttatacgatcctaggtatgaccaagctcttttaacagtttagacatttactgtatgacatatgtattgggttttaaaatttccctatgaaacaactgaaaatgctgaatacaaattatggagaggttaaacaaggaaaaacattgcaaaacaatgaaaaagaatatgtctttttttgcatactagcaaacgggaattcacctttcacttcaacatcagttttaaaaatttcagcgtatagcaagaacagacagtggaataggattcaatttcagctattttgggaataagaaaattttccataaatgcagcattgaactcatccattagcatatgctggtgcttttctgttgacattagtcaaataatttagaagcacaaagaatattattacacatttaggaatgaagtgtatatccaatttaaggtctagatattaaaggaatcacaatctgtgttattaggcctgcatttttcctttctttttgtctcttcagacatgttaaaatttctacttatcattttgtcaactctgtgtgtttgcattcgttcttggaaatttgtctccacaaaaatgttaaaattagcaggcttggtggtgcatgcctgtagttccagttacttggcaagctgaggcaggaaggcaagagtatcacttgtgtccaggagttcaagactacggcgaggtatgattgtgccactgcactccagcttgggtgagagagcaagagcctgtctcagaaaaaaaaaaaaaaaaaaagaaaaggagaaaagaaatggaagttttcactggcaccttctaaatatctagtaacacaggatcaaatcagtaactaaccatctttgttttttcctgtcccagacaggtaaaatggaaagcagttatacaaatgctatactaactcctcacaaagactacccaaagataatattatcatctgtgttttttggtgatcatactgaggcagagagcagttgtgaaatggagtctcagaatcgtcgctatatgaagcagaaaaactggtttcctctcttggcagtctgactccaagatctcttagaaacaattatactgtaaaaacctgaaaaagaagtaaaaaacaagattggagactaatactaacatctattcttcttaatagcataatcaaaaataaattaaacagaaaaataaaagtgaatattcataccaagggaagtctagagtcttcagtggaaaatacatattttttaataagtgcccaaggaatattttaaaaattgctgaatattttaattaaacaattcatatttaaatattagctagattcgagagaataacttattcaaaagcttaagcacgagagataagtttataaatattgaaaattgactgaaaagggtgagagggaaaatagggctatttcaacctggacgacttgcctgaaattggttttccattttggaaattacagcacaataattcctcccatccatgaggggcgtgtatgcatgtgtgtgtttgtgttaatgagcttgttaacaatagacttatacaaacatattagcagcaagcagattttaaagagtattggcctttttgcactttccaagaaaaccttggattcttttgataagaaaactttggattctgtttacataaatctgacatttaaaaaatcaatccacagtggtcatgattctagttacaacaaagttccttttaacaatttagatatccaatgtaggaactatgtgttgctttttaaaatttccctaacaactgacattgctgaacacaaattatggagaggttaaacaaggaaaagtactacaaaacaaggaaacagaatatgtctttatttgcatgctagcaaatgagaactcatttttcacttcaacatcagtatgaaaaatttcatcttatagccaggacatagtgtttgaatagaagttaatttgaactgttttagaaattatcatgttttccataaagacagcattgaattcattcattagcatgccctggtgctttcctgtttgacactggtcagagaatttaaaaagaacaagagcgttaatgcacattcagaaatcaggtgcacatagaatttaatgtcaggaccttaaagggaatcttatccaatgatattaggcctgccttaaaaagaattcagacatgatatgttgataccaatcatgttttccatactggtaatggtagaatttgtgttttaccatggacagctattattaaacttatagactatttttatattttaatattttttctttgtttccttttaggagttgttaaacaatcctgaaatttcccctacaatatgccatgaactaatcatattttctcaaagtcatttgacgtaatgattgattaaaggaaatatctccagtataattacacttgttcataacaaaaaagtatttgaaacttcaagaaaaaattagaaaaattaataatgaaatatgaacaaataaatgtatgaaatatataattaatccctaataaatgtgcatgaaattatagtcatagaattaagagtgatgtaatttttcaactaaagatgcattctgaattataatagaaaaaggtttgtaaaatgttaagtttaataatattttatttatttttgagacagtctcacttcgtggtctaggttggagtgcagtggtgtgatctcagctcaccgcaacctccgcctccgggttcactcaattctcctgcctcagcctcctgaatagctgggattacaggtgtgcatcaccacaccaggctaatttttgtatttttagtattttttgtattttagtattttttcaccatcttggccaggctggccttgaactccatacctgaggttattcacccaccttggcttcccaaagtgctgggattacaggcgtgagccaccgtgcctggccaagtttaattatattttatataaatatgaaagtgcaaaaattactctactaattttggagagcatatgaagcagtgggaattttcatacactgctcctaggattataaatcagtgcaattactttgtctgagtgtgacattatttgaataagatgaaggatcacatcctaagacccaggatttgcactcatatcagaatacatatacaagtatatatcgctgagttttaatagctaaagttgagaagtctcccaaatgaccatcagtaataaaatggataaataaattatgacatacttacagaatgctatacagcaatcaaaatgaacaaactagagggacatgtttacaaagaatatatatgaaaaggaaagtgaataaatttgatttacatggatagcatagtaatatatacagatataatagtaattattaacatcaaaaacattcaatataatcacatttatatgaaatttgcaagaatatttttgtatttttgcaaataaattcttataattgcttataaaagaaattataaattcttataactccttaccaaagaaattataacattttataaaagaaattataacttctcataaaagaaattttattttaagtttttataattcttataatttgaaataaattcttataatttattacattggtggcaaaactgtaaagcgaaacatataagtgattatcataactgggatacttgggagggaggaaacaaaagggaaatcatatcaacaagaaagcatatatggggaatgtcttcattgctggcaaattctactttttgacgaaagtgtggaatatgagtgttaatgttacattcttttttccttttactgtgcatttaggttttattgctttccctacatatgttaggttcccgaataatgaaaatattttaaaagcagaaatattaagtaaattaatgaatataaaactaggctgaaacaatatattcttacatgtaccatcgtaattagagttttgctgaataaagaatacagcattatagtagtaagaaatagggataaaattttatacttttaaaaattaatttaaaaaagaaagatataagcaggaagtgtacatccacattcttaatgctaatcttaatttgaaacaatagattttgaacaactatattgcaatagacttttttcttgtttccaatttaattattcatgatacacgtttcaaattggcagcaattagggaatttttcataaggtacaaatattaaagtatgtaggactatagatattaagtgtataggacaatttttgctacatttatccctaaatgaaataattatactcatgttgttcccattcaaagatcacaatactatgcatgtgcacagcatatgtgttggggaaaatattttgttactataaatttttcaactgtattagagaagaaaacatagaaagataactgttaagctataaaacatatttagtgtaatctttgagtgtgcttgtgtatatgtagtattactttgactgctatagtaaaataacccagatttagtgacagtagctgagattgtaaataagcagttgagagaattttgcctgctaatgatactattaaaagataaaatacagtttgtatgctatataattgtatagaggatttgtatatatgaagttcatatgaaagtacagtgaaaattaaacagcccaaaggagaatactctttgttgtagggcacttttgtcatgattttcagaatgtggtaaaagaaaaaaaaatagccagtaaatcattggaaatacattggttttaacttattcttaatgaaatactgtctgaggatctttgtctgtgcctgatgctgaaaataatataagaaacaagttcatgagcccatcaccctgaaacgcagcacttagaaaacatgattgaagtcacatttatagaagagcatggccccttttaactgacattatcatcatcaccaatcatcatctatatctatctcattaaatgatttatttttgaaatgtttacataaataatttggataatgtctaataaatgtttaaaagattattattatgggaaagttagattagaaaatggaaaatttcaagttgaaccaaatacatttttaagtatagtttagtttaaaatacattgcttaagcaaatcattatagataaccttaaactgatcttaggaacactataggaaagatttagttgcggtgttaataaaattccttaattagaaagataaataagccacttcatgatcaagctcttacttctaaagtgaaggttttattttatttattttttaacctttccacattttattgacaaagaattaatagtataaattacgtttatattgcaaagtttatttatggaaatttgatacgtgtacttctactcctttttacaccttacatgaatatttaaataattgatttataacactccctgatgccaggtaaagtaaagcctaatcgcagttcagaaactcacatgtacaacaaatttaactttctggatatttttaaaactcagcttaatttccctaggtgctccattaacctgatggcagaaattaaatcttaagcaactctgggttctcccacaagcacactttgcttcagagttgtgctgaagttttgaggaggatgggaggaggcaaggaggtgtccagtcctttgtgcatctatcccctggcattctcccatcctgccccaagtcatcagcccacacaggttgctggcacatctaaagtgagaattttaggactaaataaatcaaatagaagtaagccctcacatcttctatatctcacctgatagtgaagaagtttgaaggtacagagctccacttctgctaataaaaaaagagtaaaatttaatttgtaaaatagaatggtgtagctagggttgaggtgctataatttatttattggaatggcatcttgagatccagcacagctcattgaatttccctgtggggagagtttgtggtgaagactcatcaacagacaagctgctatccccacccaaaaaaaaaaactactaacatcacatcaatttccaggttcttccaacttgcggaaggatgtgtagaccaagcttttattctattttgtgaccaaagtcttgggaaaagaagaaaattgttagcattttcatgtcaagcatacgaaaaacaaaaaaacaaagccaaccaactgaacaaagaacccaactttttttaaaaaacttggtggtaagagtgctttgttctgcttctccatagataatgatttatagaaggagaacaaaatataatttctgctactaaaacaataatagcaaaaaataaataatcaatattgagaatccaatagacagagttaacaaccagttagacatagaagagagaattagtgaattggaagacaactataaagaaagaagcctaaagagaccacaagacaaagaatgccaagctaagaggataagaggcattgatgctacaatcagagcatctaacatacttctggatttctggaagattaaaagggataaaatagggcagaatcaatgttgtggagattttcccaaaagtgataaaatgtattaatccatatatttttagtaaccatcaaaggtcagacaagataactaaaaacaaattaacataaaatgtcacaagacatcaaagaccagtagaaaatctgaaaagtagccagaggaaaagatagattattttaaaaggaacaactttctaaatgacaacctgattttcaacagaaaaatggaaagtagaattcaatggaatcatgtctttagtgtgtttcaaaagaatagaggaccttcataaacagaaatccaaatgatatttttcagataaaaaatattgaaaatacaaggttaagcatgcaagaaggaataaaaattaacagaaatgataaatatgtgcataattctaaatgaatgttgactgaataaaataatagcgtcttgctgagttaaatatattattgataagatatatgcaaatagcgataaagagactggaggtaaaggtgacaggaacaaatttagataaattattttttgcacttttctatgtctgtgaggataatttgaacaccacatttaatgaccccataataggaattgcatcaaatgatatgtgaaataatgctgatagtagtattattcataatagctcaaaaatagactgcccaaatatatattaactaaggatgattgaatgatatgaaagattacagtaaatccatacagtggaacagtatatagaggtgaaaagaaatgaatcacatgtacatgcaactatgtaactaaatttcagaaacatgatatctagtgcaagaagccatgaacaagaagaacacacaggactgcacctatacacagttcaaagcaggacagaccaagctgtggagtttagggttgtgaacctagctggtaaagtataaagaaattcaagcaaatgatcatcatagattatgaatattgcttatctcaggagatgtgaataaaggtttaggggcttggaaagtggcctggaagtggacctagtctgtttgcagtgttccatgtcttatcctgcatgatggttacataagtgtttatgatacattgctcttacctatttttgttttggcccatttctaagtgtgcattataattttatttaaaaaattacaaattgggagaaatgtcacgtaaaaattattaattgctctgctcattatatacctagggggaaaatccaccatttacgtacattcttatacaactcaagagagctaaagtgaattcttattttagttgcaaaatggagaaatttgagatgctgttacctacagcctccagatctttccaaaagttttcttctagttttagatattcacctcatattacaaaaactttgatatttccaacctatttttcctttggctcctgaatttctgacacaacaagggcgcacatatttctcaaactcttggattagcagagtacctatatcacttagctttttctgcaaaagaaacttctccaaaaccacattagatatttatatctcacatgtttttggattctgttttcttaagctggggtttggtggatggctctggtgatttgagatggtccaagttttgcctcttggatctagttagagtttggccgatttaaggctggatcaggcaggagccatatgattccatgagttactcattcttattctgggaacagtgtgttagtgtggacatgttctcattataaaccggaaaggaacaagaaagcctaatgtggaggtcatctcaaatttcgatgtaaagtgtagtaattttctgttcatcaaagcaaattacatgatcgaactcagagccctagtgcaaggttgtcactatgcctgtggtgggaggacactgcaaaattatgtgacaaaggtctggtactcaggaatgtttacaagcttgcaggtagcattaccaaaagcctaagcatgagagatatgtttcatgaatattattcattggctgaaaatctggcatgggaaaaataggactaattccaccaggacgagctcctggatactcattttccatgtcataagttacaagaaagcaattcctttcatccttgaagagtgaaagtgtgtgtgtgtctgtgtgtgtgtttatgagcttgttaatagtgatgccatatagaagtattggttaacagcaaccaaattataaggagtattggctttcctgtggtttccaagaaaatcttgggtgattttgataaaaagtttagattttgtgtatttaaatctggctttaaaaataaatccgtagtgattttgatcctagatttcaccaggctcttttaacaatatattttttgtgtcatctatgtactgggtattaaaatttccctaacaactgaagggctgaacacaaattatggaaaggtgaaacaaggaaaaaattgcaaagcaatgaaagaggatatgtctttatttgaatgctagcaaatgagaattcagctttcccttcaacatcagtatgaaaaatttcagcctatagcaagaatagagactttatgaataagaattaatttgagttgttttgggactaacagtatttcccataaaggcagcattgaactcattcattagtttaagctggtgcttttctgttgacattgttcacagaatttaaaagtataaagaatgttattgaacattcaggaatcaagtgcatatttaatttaaagtcttgaatatcagaggagtcaccatcagtgacattaggcctgaattttttacttgcttttttgtttagacatgatgagttttctacacattgttttttccattctagtagtggttgcatttattcttggaaattttgccaatggctttatagcactgataaatttcattgcctgggtcaagagacaaaagatctcctcagctgatcaaattattgctgctctggcagtctccagagttggtttgctctgggtaatattattacattggtattcaactgtgttgaatccaacttcatctaatttaaaagtaataatttttatttctaatgcctgggcagtaaccaatcatttcagcatctggcttgctactagcctcagcatattttatttgctcaagatcgtcaatttctccagacttatttttcatcacttaaaaaggaaggctaagagtgtagttctggtgatagtgttggggtctttgttctttttggtttgtcaccttgtgatgaaacacacgtatataaatgtgtggacagaagaatgtgaaggaaacgtaacttggaagatcaaactgaggaatgcaatgcacctttccaacttgactgtagccatgctagcaaacttgataccattcactctgaccctgatatcttttctgctgttaatctactctctgtgtaaacatctgaagaagatgcagctccatggcaaaggatctcaagatcccagcaccaagatccacataaaagctctgcaaactgtgacctccttcctcatattacttgccatttactttctgtgtctaatcatatcgttttggaattttaagatgctaccaaaagaaattgtcttaatgctttgccaagcttttggaatcatatatccatcattccactcattcattctgatttgggggaacaagacgctaaagcagacctttctttcagttttgtggcaggtgacttgctgggcaaaaggacagaaccagtcaactccatagattcacaagaggtgcattgtgtgttttctagcagaaaacaaattgatggtgtctggaacattttatatttcccacaagtttttccgtagtctatgtatttgagtaatttccaaaagttgacatagaaaagtcttttacctaagtttattatataaaagtatatatatataatatacatttgcgtgtgtgtgtatgtctgaatgtatatgaaaatttaatatttaccataacatacctttaatcaacttttcatataaactgttcagttataccaaagtaggataagaaatttctcagaattatgaacccatgtgtatttcacacatttttttatatgatatttcatttgaggaatttatgatctctatttataattaagaactgacagcttatatcagaaaatcattgctgtttttcgttgtaaaatcattgctgtttttcgttgtaatttgtatcacgtatatgtaccatagtgtgtttaactgtttaactatcattgtttgaacctctaattttttggatggtaaggacatttaattctaaatcgatgagaatgtgtctttggggtaggtttttttgttttttttttaatcatgaattctttttttcttttttttgagatggagtcttgccctgttgtccaggctggaatgcagtagcacaatcttggctcaccacaacgttcacctctggggttcaagtgatttccatgcgtcagcctcctgagtggctgggactccaggcatgcgctaccacacgtggctaattttttgtatttttctttttttttttagtagagatggggtttcaccatgctggccaggctggtctcgaactcttgacctcaagtgatccactgcctcagcctcccaaagtgctgggattatagacattcatgatgaattcttattttatgtttaatataaagcaaatacaattattgttagataacaatgcacaaaataaaattcaagggtgaaaaatatatctagtgtacatttttatgtgtatcaaaagcaatactgaggaatattatatttaatatagtatgttaatagcttagaaaaaatcatttctataaaaaggatgaagaaacatgatcatgagctcttttcagtgctgttataagtttccatacgcaattagaaaagtcatctcttccagtttttgaattaaacaaaaacctttttgaagttgagatctgatgttatatatttcagttttttgtctaagccacctctgagctcctgaattgtcaatttcctcctttatcttccatccttaaaattcctcaaaaagctcaaattttccttactttaaaaagaagctcaatctaaagagggtatagaaactatggcatctatgaaatctatatattaatgataggaaatgtcttaaagatatgttttattataatcttggtgtaaataatgaaatgagagaaagtgtgttgacatattcactaatagcaagttctattacaagaagaaaatgtataacctagttcaacagctaaattctgtgtgactgtattaatttctggtgttatgcaattttaacaatattatctaaaccttaagataaatcatctccacatctgatttgtttgtttatcatatatcttacctggtacaatgtaaataccataaaagtagagatcatatagatcttgcttactgtagactcccaagacataaagatagcacatagaataggtattgaaaaatgatactttgatgaacaagttaattggtgaatgaatgaatatgaactatattggggtggtgaaccaatgaaaatgtaacacatcacaaaatctacagttgggtgcacatttctgttctggtttcagattgaagttacaggattatccaagaagaagaagaatttctcagagcaaaagtttggctattccacaattctaggggaaatatcactataatatagcagtgatgcagctatatcagatgtgtgacacaaagacaaagtggaaaataaaaagatggcatttattacaatactttttactaagcatataaaagatttttgtataagtgcacatatcttttctattgcgaatgatatatttatattgtggtatttctagctggttattatataaacaaaaatgacatttcatttaaaaaatttagttaccaactatcttactaaaatataatctttatttagtatttttaatatcctttctaaatgaccactttaatcaccatattataaactgatggaaaaatgaatgaataataattataacactgaatgaatatcttatcatcaggggtctagaagtagagcaaatgtctgatattaaagtgatgacatttatttggaaggaggtccactgcagaaatggctgggacatgtggaaattgagtcaagagaagatgtgacactatgtgctgtaatgtgtgatatgactctgctgacgaccacttcacaatgatgtgagagagacagcatggtggttatcagatgcatgcacttggctcccaggactttttcagaagggctgcgagaggacaacacagccagcattagcccatggaagcaacagaggacggagaatatatctgctcagctgtcttctgtcttctatttcccactggccagggtttccctgaggcagaactaccatctctgctgttctgctttccatcatccaatcccttgatggaggttatgaaagtcagacctcatgcccacaatgtggtgatccattcaagtcccaaatggaagggtgatgtgggtcaggcaaggtgctgaccaggggaataggagacagtcaagtaaatctgaggaagcacatgtttgtgtcccatgcagtccactccttgtgccattcagatgtgctcatgccctccaatcatggctgactatgagcatataatttccactgttgcacagggtcttgtgcttagagacgcacacgcttagaagggctttatacatgggttaattttctgcacctgctgttttgtttttgagacagagggcactcctctgctaaagagggaatggtcttgcactaattggctaggggtttgctctcccctctcctgtgggcttgtgagaagcatgcacagagtcttataatgcccactatgcatgcatgcctctagcgggtttgaattctgctggattatctgtcacaatgagcacagcagcttggactagagcctacatttgctagaggcattttttgttctagttccacttgagaccagtagcctttggcaacttcattagtgaatcagagcagtatcctcaaatgtggaatacgttggctcccaaatcccagtaggcccaacaaatattgtgtctcatttttagtgacaggaaatagatgtatagagagcaacatgctgtttactttaaaagggtgtttcagcatgtggactaggagcactggacccctaaaatcatcatctatgttataggtcactgaatcttcttgttcatctttcttcttctggtatttagttctgttcaatgttatggtattttactatatttgagaaactcatcacttcctgcttatgggtaacagttaatgcaatattattaatatattgagttagcatgatgttttgcaaaatgccaattaaactgaaaacagaagtgacatagccatgacataaaacagtgaagcagtgcttttgttcttacctcaccaaaacaaatcattttgattttctctcccaatcgatgtagattaaaaagcattcaccaaatcaaacgcctcatacaaagaaccagaaaccatgttttctcagtgaaggtaccacatcctagagagcatctgcaagtgtgatttaagtttatgctaatgtgcattcatctgataatccatctggctttggcagaagccagataggttaactgaatagggatcaaaaatggacaaccacctcctggaacttttgagttttttgtcatgtcggtgaccaattctattccttggacaatgcggttagtatgttttactcattttcttgccagaagaggagaattaccgaggactctttttggtcctacttacagtaatgtcccttaatatacaggtctggaagcaatgtgagagttctgctagctgttgaaactgttaatttcatttaacattctggaagagataataaatataaacccattacatccaccttaggttgaacatgagccaaagctttatgcagcatctgactttcaaaaactcatactccaggactggtgaggtggctcacacctgtaatccaaacaatttgggaggctgaggtgggaggagcacttgaggccaggagttccagatcagcctgggcaagacagcaagaccctgtttgttaaagaaaataaactgattgtagtactgcgtgcctgtagttccaactacccaggaagttctggcagggggatcagtttagcccaggaatttgagtctgcagtaagctatgattgtgccatttcactccagcctgggctgcactctagcctgggcaaccaaacaagactctgtctctaaaaacaaaaaaaaacgaacaaccgaaaacaaagcctcccactccattctgtgaaacacagtgtctttttttagttctcaaatattattagtgttagttcaggccccatgtttaaaattctgagagtatggatatatgtcctttcctctgggtactgttatggctacaggtgaaatggctacaggtgcttgagaaagggtcaagtgaatatttcctgaatatttttgtggtgaatcttcagtgttgtttaccgagggcatgtaagctttccttcaatcattgaactctgcttctctgaactggctcagtccagagaactggctaagggtttttgattttcaatgtcaaaggctgacctcaggagtcagcttttgcaactcttgtcccctcttggtttataattatttagcaaagtatgaggcctcttcaactatcggtccatcaacccatttaaatgaggctgttactgtcaccactccattaaatctgacatttgcaagatcaccgataagtctgtgttgccaatggttagttttcatgttgcatgctctatgagcagcactgaacctggtttatttgcatttcaggatgctgccctctcctgattttatccttgttcactggcacaatttcttagtctcctttgctagttcttcctcttgtctgtaaactgaaaatatcagattgcccaaggtctaaattcttcaatctctaatcaattatgtctggtttttttggtgatctcatgcagtctccttacagataatgtagccacatggttcaatagagaggaataaggctgattattcatatatgttatttatttatatacatatagttacatatatcaaattatgtaaccctttttttcaaatgtcaaagttacatttaaaagtcacaatactaaaaatctatggagaaggtcggagcatcaataatgtttttacttgaatttctgctaaatcagagtgatggtgaccagatagctaattaagttttatttaaaatagccatgtagattgataggcaggggattatcattatagaaaaaaatgatataagtaaggaaatatacagatagaataatgattgattaacccattttgacttattgtacttggtacagttaatgtcttagtatctcagtaatctgtttttatatttttctctatgatcaattaattatgagttaatttttatatatggtatgaaataatggtctacactcatgtttttatcattctgtttttactcccacttcttaggtaagttcatctagtcataaccttagttactttctgtgtgctgttgatgccaatatttaattcttcagctcagaagtcaatcctggtctctagaatcctttctctaagaagtcatttgacatcttcatttggatgtcgtaacaagaacttgaactaacatgtccaaatcaaaatagtgatcttccctctagtctccagcgttgtttcttctatagcctttccctcttctgttaatgaccacttcagtctttcagatgcttagaccaaaaacacggagttaacattttctctctttcagaactcatctctaaggcatcagcaaattttgttggttctaccctcttgttggttctaccctcaaaaacatacagaatccaatcccttgtcatcacttttgccatactcatctaaactgctgccatacctagccaagataattgccatcaactcctaattattctttctagttctgcacatcattttctcctgatgtactctcaagatagcagccaaagagagcctatgaagatgcaaatttgatcatgccattcttcagctttagatttttcagtggcttctcatctcattagagtaaggccaaaatccttacaaagtcctataatcatttgaatgatcggattttgtctgcctgtctgtcctaaaatgcctggctatcccatgctagcaacactggactttgtgtaatttcttgaatgtaccaagaattgcctcagggacttcgtacttgtgtcccttcttctcggaatgctctttctcagaaatcaacactaaacactatcactcatcaaacatcactgaatcattgaggcctccttgatttgatctttgtatatggtgataaataggcatctagtttcatttttctgcaaatggatatccaattttcccagcaccatttagtgaagagactgtcctttccccagagtatgttcttggcacctttgtcatgagttctctataggtgtggatttgtttccacattctctattctatttcgctgctctatgtgtctgtttttatgccagtaccatgctgttttggttactatagctctgtaatatactttgaagtcaggtgatgtgattcctccagttttgttctttttgctcaggataactttggctattctgagacatccgtatattttcagaagccattaaaatttagatgagataactaaaaccaattaaaaacaaatgccacaggatatcaaagaccaatcgaaaatctgaaaagtaggtagaggaaaaactttatgtaaaaagaaacaactgtctaaatgacaatcttattttcaacagacaaaattgaagctagaattcaatggaatcatgtcttcagtgtgtttcaaaaccaaagcggactttaacaaatagaaattcaaaagaatattttttagataaaaggaaaattactaaaaatataaagctgaacatgcatgaaggaataataaataatagaagtggtaaatatgtgcataagtctaaataaattttgactgtataaagtggtggtgtctttttgggttaagtatttaataagatatatagaaatagccatatatagtctgtaagtaaaggtatcaaaaagtgaatttagttaatttaaatttggaattttctatgtctgtgaagagaatttgaaagctatatttgatgaccctgtaattatctttctatgtatatatccaaaggaaatgaatcaaatgatatatgaaagaatggtcatactagaattattcataactcttcaaaaaagaaaccccccaaatatgtatcaactaaagatgaatgaatcattacaacacattcatacaatggaataatatagagaagtgaaaagaaatgaatcacataaagatgcaagtatgtgagtaaatttcagaaacgtaaaggtgagtccaagaagccatgaacaggaacatacaggactacacctacatatggcttaaaggtttaaagtaggcaaaaccgtatcataaagtttagggttgcatacctagttgttaatgtataaagaaaatcaaggccaggcgcggtggctcacgcctgtaatcccagcactttgggaggccgaggcgggtggatcacctgaggtcaggagttcaagaccaacctggccaacatggcaaaaccctgtctgtactaaaaatacaaaaagttagctgggtgtggtggcatgcgcctgtagtcccagctacttggaaggctgagggaggagaattgcttgaacccgggaggtggaggttgcagtgagctgagatcgcgccactgcactcctgcctgggtgatagagcgagactctgtctcaaaaaaaaagaaaatcaaggaaatgatcattctaaattatggctattgctctcctcagggtatgtgaagaaaggtgtaggggcttggagagtggcatggaggtggacctaggctatttgcaatgtgacatgttttgccctgcttgatggttgcatgagtgtttatgacacattgctatgtttaccatcttagttttcacccatttctaagtgtgcattataattgtatttaaaaattattaactggaaaaatgctccataaagaatattaattattctgctcattgtataccttgcaaaaaattcaccatttatacacatttttatacaactcttagagagttgaagtaggaactttattttagctgcaacatatggaaatttcagatgatgctacctgcagcacacaaatcctttcaaacatttttttattacctttaattatctacctcacatgacaaaactttgccactccccatctatttttcttttggctcctgaattcctgacaaaacaggggcaaatatatttccccacactcttggtgtagcatagtagctgtaccagttaggtttttctactagagaaaccctccaaaactacgttagatatttttatctcatatatctttggattcaggttttctaagctgggtttggtggatagctctggtgacttgagatgggccaagttctgcatcttggagctagttagactttggccaatttaggatggatcaagtgcaggcaaactgactccattagttttcattctcattctgaaaacagtgtactagccaggtgataatctcatgatcaatggaaaagagcaagaaaccccaatatggaagccatctcaaacctcggtgtgaaatctaccaattttctgttcatcaaagaaagttgtgtgagtgagctccgagtccaggggacagataatcaccctgcttatggtgggaggatactgcaaaattatgtgtcgtagggtgtggtactcaggaatatttacaaaattgttgaacattttaattaaataataaatacttaaacattaaatagacttgagagtaagtttaccaaatgcttaagcatgaaagatatgtttgatgtttgatacatttttttggggggggtctgaaaaccctcagttttcactgggaaaataggactaatttcacgtggatggcctccaggagacttacttcccattttggaaagtataagaaaataattccttccatctcttaggggtgtcacagtctctctctctctctctctctctctttctgtgtttgtatctatttatgaacatggtaacaataaattcacacaaaagtattgggttagcagcaaccagattttaaggtgttttggtcttcttatggttcccaagaaaaccttggatgattttgatttaaaagtttggattctgtctgtttaaatgtagcataaatagtaaatccgttatggtggtgatcctagttatgactaaggtcttttaaagaacttagacatttactgtatgaacgatggactcgggggtaaaatttccctatctaacagctgaagttgctgaacacaaattacgtatcggttaaacaaggaaaacattgcaaaatattgaaagagaatatgtctttatttgcatgctggtaaatgaaaatttaggtttcacttcaacttcattatgaataattcaagcccatcacaagaacggacattgaatgaatgagttaatttgagctgttttgaaaataagaatgttttccataaagatgacatcaaactcatccattagcataagctggtactttcttgtttgacactggtcacagtatttaaaagtaaaaagaatgttactgcacattcagaaatcagatgcacataaaatttaaggtcagagtattaaagaaatcacaaccagtgatattaggcttgcattttctttctttttttctgctcagatatgataacttttctatacatttttttttcaattctaataatggttttatttgttctcggaaactttgccaatggcttcatagcactggtaaatttcattgactgggtgaagagaaaaaagatctcctcagctgaccaaattctcactgctctggcggtctccagaattggtttgctctgggcattattattaaattggtatttaactgtgttgaatccagctttttatagtgtagaattaagaattacttcttataatgcctgggttgtaaccaaccatttcagcatgtggcttgctgctaacctcagcatattttatttgctcaagattgccaatttctccaaccttctttttcttcatttaaagaggagagttaggagtgtcattctggtgatactgttggggactttgatatttttggtttgtcatcttcttgtggcaaacatggatgagagtatgtgggcagaagaatatgaaggaaacatgactgggaagatgaaattgaggaatacagtacatctttcatatttgactgtaactaccctatggagcttcataccctttactctgtccctgatatcttttctgatgctaatctgttctctgtgtaaacatctcaagaagatgcagctccatggagaaggatcgcaagatctcagcaccaaggtccacataaaagctttgcaaactctgatctccttcctcttgttatgtgccattttctttctattcctaatcgtttcggtttggagtcctaggaggctgcggaatgacccggttgtcatggttagcaaggctgttggaaacatatatcttgcattcgactcattcatcctaatttggagaaccaagaagctaaaacacacctttcttttgattttgtgtcagattaggtgctgagtaaaagacctgaaactctcaactctctagattcacaagtgggacattgtgtgtgtattctaggagaaaacaaactgatagtgtctggaacattttatactttttactgttttttctgtagtgtatgtttttgagtattttctgaaagcatacctagaaaagtcttttacctaaagttagtctaaaagtgtatctatgtgtgtgcatctgtatatgaaagacttaaaagacattgacaataacataatgttaatcatattttcacaagatgccaaattatagaaaatatggtaagaagtttttcagaatcatgaacccatgtatatttcacatatacatttcatattatcatgtttcacttgaaaactgtgtgatctttacttataattgttaagaagtgacacattatctcaaaatctttgctcttttccactgatttttaccacacatatgtaccacagtgtgcttaaacatctaaattttttgatagtaagcacactcaattctaaatcaataatgaggtttcatctttggggtagtttttatttcatcatgaattctaattttatgtttagtttatagccagcataattattttcagaaaaagatgcacagaataatattcaaggatgacaaatatatttagaacacattttgtatatgtctaccataaacagtactgaggaataatagacttaatacaaatatgtgaacatttgagaaaaaagtcatttctataataaggatgaagaaagaaacaccgtgatgacttatgttgtcataagtctcaacatgcagttagaaaagtcatttcttccagtttttgagttaaagaaaaccttttttgaagttgagatctgatgtcaagtatttcaggttttttttttctaaaccacctcagagtccctgaattgccaatgatctcctctatcttccatacttgaaattctttttaaacttcacataaaagaacttgagtcttccctaccttagaaaaatactctatgtaaaaatagtatagaaattataaaaatcatttgaattaaactttttgcaaatgttaaaatggcatctatgaaatctatgtattaatgatagaaaacatctaaaatatatgttgtattataatctagttgcaaataatacaatgagacagtgtgttgatatattcagtaatagcaagttctattataggaagaaaatgtataacatcattaaacaattaaattctataaactgtattaattcttggagttatgaaattttaacaatattatctaaaccttgggacaaatcatctctacatctgatttagttatttgt[450 bp omitted]tatctttgcatacaatttttcagttgtgaatgatatatttgtattgtgatatttccagctggttagtgtataaacaaaaatggcatttcattaaaaaaaactgagttagttaccaactaccttactaaaacgtgacttttatagaatattttaaaaccctttctaaatgaacatttaaattgccatattaaaaacccacagaaaaatgcataaataacaattataacactaaacgagtatcttagccttgggtgtctagaactagagccaatgtctgatgttaaagtgataacatttatttggaagataagtccagggcagcaatggccaggacatgtggaaattgaggcaaagcaaatgtgaaaccatgtcttgtgatgtatgatatgactctgctgatgaccacttcacaatgagatgagagagacagcatggtggtcatcagatgcgtggacttgactcccagtacttttccagaagggctgcaaggggaaaccacagccggcattagtccacggaagagaaagagaagagaaaatgtatctgctcagctgtcttctgtcttctatttcccattggccagggtttccctgaggcagaactaccatctctgctgttctgcgttccatcatccagtcccttggtggtagttatgaaagccaaacctcatgcccccagtgtggtgttccattgaagtcccaaatggaaggatgatctggatcaagcaaggtgctgaccaagaaaagagaagacagtcaagataatctgaggaaggatatgtttgtgggcaatactgtccactccttgtgcaactcagattggctcatgccctccaatcatggctggctttataggcatatgacttcacagttgcacagggtcttgtgcttagaagtgcttatgcttagaggggctttatgcttggattaatcttctgcacttgctgttttgtttttcagacagaaggtagtcctctgctggagaaggaatagtcttccactaattcgctaggagtttgctctccccactcctatgggcttgtgagaggcatgcacagagtcctataatgcccactatgcatgcctgtagcaactttgaattctgttacatcatctggcacaatggccaagcaacttgggccagactctatatctgctatagagcccgtttttgtttcgggtttgacttgagacaagcagcccttgcaaactcctttagtgagtcagagaaatatccttaaatgtggtatatgttgaattcaaaaccccaataagcccccataaaactgtatttcccttttagtgataggaaatatatatatatagggcaacatgccatttactgtaaaaaggatgttttgacaaaaggaccagaagcattggacccctataaacttcatctatgttataggtctttgaatctgctgaagtttatgtctcttcttccagtattttacttctgttcaatgttataatattttactatacttaaggaacttgccacttcctgcttatgggtaccactttatgtaatattattaatatattgaattaacatgatgttttgcaaaatgtcaattaaactgaaagcagaagtgacagccctgacagaaaacagtgaagcagtgttcttgtttttaccacaccaaagcaaattgttttgattttcctccacaatgtgtgtagattaaaaagcattagctaaatcaaaagccgcatacaaagtgctggaaaccacattctgctcagtgaagataccacatcctagagcgaatgtgcaagtgtgacttaagtttatgctaatgtgcattcatcctataatccatctggttttgacagaggccagttaggttaactgaataaagatataaaatggacgaccgccccctggaacttttgagttttttgttgtggcagcgaccaattctgtttcctggagaatgcagttattatgttttattcattttattgccaggaaagtagaatttcagaagcctccccttggtcctgcttacaataatgtcccttggtatacaggtcaggaagaaatgtaagagtcctgacagctgttgaacctgtcaacttcaattacactttcaggaaggggtaactacgatgaactcattagaacccctttgggttggacatgggccaaagctctatgtaccatctgatcttcaaaaactcatactccagtcctattgaggcagctcatacctgtaatcctaataatttaggaggccgaagtgggaggatcactttaggctgagagtttcagatcagccttggcaacatagtaagaatctgtaaaaaaaaaaaaaaaaattagttgtttgtggtagtgtgtgcctgtagttacagctacccagaagactcaggcaggaggattgctttagcccaggaattcgagtttgcagtgagctatgatggtgtcattgcactccagcctgggcaatcaagcaagatcttgtctctaaaaagaaacaaacaaaaacaacaaacaaaagcccaaaaagggcctggtgcggtggctcatgcctgtaatcccagcactttgggtggctgagtggttggatcacttgaggtcaggagttcgagatcagcctggccaacatggtgaaaccccacctctactaaaaatacaaaaattagccaggtgtggtggtgttgcacctgtaatccaagccacttgggaggctgaggcatgagaatcacttgaacccgggaggcagaggttgcagtgagctgagatcatgccactgaactccagcctgggcgacagagcgagtctccacctcaaaaaaaaaaaaaaaaaaatccagaagtaaaaatttgccaccgtatcccatggaccactgtgtcttttggggtacccagatattagtgttagttcaggctccaaacttaaaagtctcagataatatggacgtgtgttctgttctctgaggactgttttctggggaatagctacaggtctttgagaaagcaacatatgatacatcctgagtgttcttgcagtgcattttcaatgtccatcatcaagaggacttaagattcccttcaatcattgaattctgcttctctgaattggctcagccctgagaactggctgagggttttccattttcaatgttaaaggctgacctcaggaatcagctttttcaactctttccccctcttggtttataattatttagcaaagtatgaagcctcttcaactattggcctatcaacccatttcaataaggctgttgtcaccacttcattgaatctgacatttggaagatcaccagggagtctgtgttgccaatggtcggtcttcatgttgcatgctctgtgagcagtactgaatatagtttatttgcattccaggatgctgccctctcctgattttttccttatttactgggcaccacttctcagtctcctttgctagttctctcttgtctctaaattgaaaatatcacactgcccaaggtctcagttcttcaacctttaatcaatcgggcttgttttgttggtgatctcatggagtctccttactgataatgtagccaaatggttcaatagagaggaataaggctgattattcatatgtatttatatatattatttatttatgtacatctatttacatatttctcattatataaagcttttttcttcaaatgtcagttacatttaaaagtaacatgaccaaaaatctagggagaatgtgggaggatcaataatgttttcacttgagtttctgcctattcagagtgatagtgactcagtatctaatttagttttatttaaaatagcaatgtaaatattgatagattgataggcaggggataatcattatggacataatgatctaagtaaagaaatacatagatagaattatgattgattaacccattttttatttcttgcatttggtacagttagtgtctcagtatcgcagtaatcatagttcttaagtttttgctccatgatcaatgaattatgagttaatttttgtgtgtggtataaaataagggtctaaatttatgttttttctttctcttttggctcttactttttaggtaagttcatctggtcatggccttactttctgtgtgctgatgatgtgaacatttaatccttcagctcagaacccaaccctggtctccagaatcctttctctaatagcatatttgacatcttcatttggatgtctgacaagaacttagaactaagttgtctaaaccaaattactcatctttccttccatccccaaatctgtttctcctacagtctttccttttgttaatgaagacttcagactttcagatatttagacaaaaaacatagagtccacgttttctctccttcacatctcatctcagcaaattttatagactctgtcttcaaaaacatacagaatccaatcccttgtcgtcacttctgccatactcatctaaatttctgcatttcttgccaagataattgctatcaactcctaataattttttctagttctgcacattcccctgatgtattctcaatgtagcagccagagagagcctgcaaaagtgcaaatttgatcatgctgttcttctgctccagatttttcagtggcttctcaactcattcagagtaaggccaaaatccttacgaagtcctataatcatttgaatgatctgtttttgtctgcctgtctgtcctaaaacacacctggctcatcccatgctagcaacattggcctttgtgtcacttcttgaatatgccaagcattgcctcagggacttcatacttgtgtcctttcttcttggaatgctctttctcagatatcaacactaaacactaccactcctcaaatatcactaaatcactaaatcaatcctgccttatttaaagagaaatctcacttctctctgcagttttaaattttttttagattttattttaggttcagaggtatatgtgcaggtttgttatataagtaaattgcatggcatgggaacttgctgtatagattatttcatcactggggtgataagcagagtacctgataggtaactttttgatcctcacccccctcctgccctccgtcttcaagtgggccctggtgtctgtagctcccttctttgtgtccatatgtatttaatgtttagctcccacttgtaagtgagaacatgtggtacttgctttgctgtttctgttttacattcccaccagcagtataaaagcattccctttcatcacaaccttgacagagtctgtttttgtttgtttgtttgtttgtttgttttgtaataggcattctgaggggtgtgagaggttatctcgttgtggttttgatttgcatttctttaatgattcattcatattgagcattttttcatatgcttgttggctgtgtgtatgtcttcacttgaaaattgtctatgccttttattcatttttaaatggaggtgtttgttttttgctcgcaaaatcaagttccttatagattctgaataggactttgtcagatgcatagttagcaaaatattttctcccattctgcaggttgtctgtttactctgttgataatttcttttcttgtgcagaaactctttagtttaattaagtttcatttatcaatttctgtttttgttgcaattgcttttggcatctttgtcatgaactctttgccaggtcctatgtccagaaaggtatttcctaggttatttttcaggtgttatttttctttttacagttttaggttttacattttagtatttaatccagcttgctttgatttttgtatatgtattaggaaagtatccagtttgaatcttctgcatgtgactagccagttatctcagcattatttgttgaatagggggtctgtccccattgcttgtttttcttaactttgttgaagatcagatggctgtaggtgggtggcattatttctgggctctctattccatttccttggtctatgtgcctgtttttgtaccattgccatgctgctttggttactgttgccttgcagtgtggttcaaagttaggtaatgtgcctccagcttgttctttttccttgggattgccatggctatttgggctctttcttttttttttttttattccatatgaactttaaaatagtttttttctactttggtgaagaatgtcactggtagtttgtcagaaatagcactgaatctgtaaattgctttaggcagcatgggcattttagcagtattgattctttctatccatgagctcggaatctttttccacttgtctgtgtcatatttgatttctgtgagcaatgttttgtaatactctttgtagcgatatttcacctccctggtcagctgtattcctctatatgttgtattcctttgctgctattgtgaaagggattgctttctttatttgtctctgtttggatgttgttgatatataggaatgttactaatttttgtacattgatttttgtatcctgagaatttgctgagtttgtttgtaagatcaaggagattttgggcaaatactgttgggatttctaggtataggattacattgtctgcaaacagggatagtttgacttcttctcttcctacttagatgacttttatttctttctgttgcctgattgctttggccaggacttccagtaattgattaagagtggtgagggaagatatccttgtcttgttcctatcttccaggggaatacttccagttttgctcattcggtatgatgtggctttgtttgtcataggtggtgcttattattgtgaagtatataccttcaattcctagtttgttgagagtttttaatatgaagagatgttgaatttattgaaagccttttctgcatctatcgagatgataatgcgattttcgttaattagttctgcttatgtgatgaagcacacttattgatctgcatatgctgaaacaaccttgtatgttagtgataaagcctacttgattatggtggattagctttttgatgtgctgctggattcagtttgctagtattttttgagtactttttcatctgtgtttattaaggatattggtctgaagttttctattttttgttgtgtctctgaaaagtttaggtattagggtgctgctggctttatagaatgagttatggaggagtcccttttcctcagtttcttagaataggttctgtataaatcataccagtgctttgttatacatttgatagaattcagctgtgaatctgtctggtcctgggctttttttggttggcaggcttcttattactgattcaattttggaactcatcatcggtttatttagggatgcaatttcttcttagttcagtcttggaggttgtatatgcccgggaatttatgcatttcttctaggttttctagcttgtatgcatagaggtgttgatagtagtttgtgaaggttgtttgcatttcagtggggtcagtggtaatgtcccctttgtcatttctgaaagtgttcatttgtatattctctcttttttctttatcattgtggctagtgttctatctatcttaatttaaaaaaaaaaaactcctcagcccactgatcttttgtatgattttatgcattgcaatttccttcacttcagctctgatgttggttattccttgtcttctgttagctttggcattggtttgctcatggttgtctaggtctttttgttgggatgttaggttgttaatttgagatctttctaacttttcaatgtgggcatttagtgctacaaactttcctcttaacactgccttagctatatcccagaaattctggtatgttgtatcttttttctcattagtttcaaagaatttcttggtttctgccttaatttcatatgtacccaaaattcattcaggagagggttgtttaatttccatgtaattatatggttttaagctattgtcttagtatttacttacatttttatagggctgtggtccaagaacgtgactggtatattttttgttgttttgtatttgctaggaattgttttatgttagattgtgtggttcattttagattacatgccatgtacagatgagaagaatgtgtgttctgttcttttggggtgaactgttctgtggtggtctattaggttcatttggtcaagtgtttagttcagattctgagtacctttgtcagttttctgtcttgatcatctgtctaatgctgtctgtggggtgttgaattctcccactagtgttgtgtgtttatctaagtcttttcataggtctctaagaacttgcattatgaatctgggtgttcctatgttggctgcatatatattcagaatagttaggtcttctcgtgaattgagtcttttactttacataatgcccttccttgtcttttttgatctttgttgatttaaagactttttttatgaaattagaatagtaactctgtttttttttttctattttttatttgcttggtagatttttcttcattcctttacttcgagcctatgcgtatcattacacgtgagatgggtctcttaaggacagcataccattaggctacgcttttttatccaacctgccactctttgctctttaactggggcaattagcctttttacattcgaggttagtgttgatatgtgaagatttgattgtttcatcatgttgttagctggttattatgcagattgggttgtgtggttactttatagtgttactggtctatgtacttaagtgtatttgtgttgtcagtgaagatcttttctttccatgtttagtactcccttcaggaccccttgtgaggcacggctggtggtaatgaaatcccttagcatttgcttgtctgaaaagatcttatttccccttcacttatgaagcttagtttgggtggatacgaaattcttgattaaaaattctttttaaaaaacaaaactgctgaatgtaagcccccattctctttctgtttgtagggcttctactaaaaggtccattgttagcctgatggggttccctttgtaggtgatctgtcctttctcttccagttgactttagcattttttcttttattttgagcttggagaagctgatgactatgtgccttggggatggtcttcttgtgagtttttagttcagtcagatcagtttggttccttcgttgattctttccccagcttgctcaattatgccgtgaatactttccattgtgttctgaaattcttgatgttagtttttcagttctgtcagaacacttttttttcttttttaaaataaccgttttgtatttcaacttctgcatcattttattgcattccttaaaaactttggatttggtttttactttctcctgaatctcattgatcttcattcccatccatattctgaattctatttctgtcatttctgccttttcagcctggtcaagaaccattgctgctgaactagtgtggttgtttggaggtaagaagacattctctggcttttcgtgttgccagagttcttgtgctaattctttctcatctgtgtgggctgatgttccttgaatctttgaaattgctgtactttggatgggttctttttttttcttttatcttctttgatacccttgggggtttgatttcggaataaggtgggtttcatttactagctttgtttatggtagattttgggggtgccaaggatcagctcagcactcccgcgctgaatgccgtaactctgggaggctagtattgggcccctggctttgctctctttccccttaaggttgggaatctgctatgctggaagggctattgtgttcctggattgctggttacgatactctgaaggatggtgccagcctaagcactttgttgggcagtggcattgtggctcatccttgttcacacatgccagcagcatcagtagtgtggcagagtacacactcgtagactggggtggggtgcaggtggatccaaggctgctagcctctatatggacattggcagtagcctaaattcatctttatgcatgagaatattcattttgtctagcatcatttattgataaaaatgattcttatttaattgaaatggtatggtttttgaaattagctgataataaatgttgttactaatttgtggactcttaattgtgtttcattattcttgtctatagtattaaaaatgccagtgtcctgatgattagtccagcttttagcaaactttgaaatgagaaactgtaatccccccactttgttctttttaaattatttctctaggtgctcttgtcacttggcatttccagatacattttaggagtagttttttatggtctaccaaaaaagcccgccagaatttgatagagattgcattaaatatataagttgactcttcacctataaagactctccttgtgctggattttagtttagctggccctccttgtttgcacagctctccgatgaattgaaaatataattttggccttttatttatcttatcctagctgctgcagaagaatattttgcctgctggaacctgctgtatctactcaagagtggaagttttcacaggtaacttctacatatcaagtaacacaggatcaaatgaaaacctagcaacacttggtttctgcctgtatcagacaggtgaaattgcaagcagttatacaagtagtgtactaacttctcataaagcctactcaaggagggtattgttattgtgtgcgttttacagatggctatcctaaggctgatagtagttgtaaaatatagtctaagttcatatctatatgaaacagagtatctgggtttctgtcctggccatcagacttgaagatcatttcttagaaacaattatattatcaaaactgaaaagaaatacaatccaaggttggagtcttattttagcatctattaatcttaagccattaagtaatcaaaaataaattaaaaagaaaaaaatatattcaaatatcacatgtagagaagtctagtttcttcagtggaaaacacatgttttttaagtgctcaaggaatatttacaaaattgcttaatatttttaattaaataattaatatttaaagacttaatagacccaaaaggataacttacttatagacctaagcatgagagatcagtttgataaatattgaaaatgggctaaaaagcatgagtgggaaaataaggacttttcaacctacatgacctccctgaaatttattcttcattttgaaaattataggacaataatttctcccatccatgtggtgtgtgtgtgggcgggcggggggggtgggttgtggtgctttgtacgtgttaattggcttgttaccaataaggttatacagaggtattagcagcaaccagattttaaagagtactggccttcctggggttcccaaaaaaatcttgaatgcatttgataggaaaagttggattctgtctacataaatctggtactgaggaaaacaaattcactttggccatgattctagttacgaccaaactcccttcaaaaatgtagatatccaatatataatctatgtattgggttttaaaattttcctaacaactgatgttgctgaacaaaaattatggagaagttaaagagggaaaaaattgcaaaacaatgaaagagaatatgtcttcatttgcatgcttgcaagtgaaaaatcagcttttacttcaacgtcattatgaaaaattttattcaaattttttcaaaagaaaaaatagaaagaacagtgtatgaatagtagttaacttgagctgttctgagaataacatattttccataaagacagcattgaactcatctataagcatgtgctggtgctttactgcttgacattggtcacacaactgaatttaaaagcatcaaaaatattagtgcacattcagaattcaggtacacatagagtttaaggtcaggaccttaagggggatcatgcccagtgatattagacttgcctttttttaaggtgtgtttgttcagttcatgggaagtttactaccaatcatttttttccatactagtaatggtggaatttgtattttcccatgacacctatattaaatgtataaacatttttatatttcaacactttgtatgagtcctttcagggcctgttaaacactccaaatttcccttgcaacatgccaataactaatcatattttctcaaaatgatctgacataatgtttgactgaaggcatatctctggtataattctatttgctgatatcaaatgagaatttgaaacttcatgaaaaatgattagaaaatttaataatagaatacgaataagtgcataaaatatacaattcattcttgagaaatgtgtataaaatcacaatcatagaatgataaaagagtaatatgtaatttttgaactaaagttacgttttaaaattgaatagaaaaagaattataaaatgttaagtttaataatttttatataaatataaaagtgtgaaaattattctgatattactcattttgaaaagaacaagaagtaatgagaattttcaaacactgctcctagaagtataaattaatataattctttggcttagtatggcattatctgatgaagatgaaggagcacatcttaagactcagtacaggtactcttaccagaaaatgtatacacacacatgaatatcactgtgttttcatagctaaagttgagaagtttctcaaatgtctatcagtgataaaatagataaataaattatggcatacctatataatagtatagtactatacagtaatcaaaatgaaccaactagagagacatgtttacaagaaatgtatataacaaagaaaataaacaaatttgagctgattagataatactcacaagtgtaagaggatctatccatagtgaaaaacattcattttaattccatttatataaagttttcaaaaatatatctttaatacattgcaatttattacattggtgacaaaactctaaagtgaaacatatgagtgactattacaacaatatggatagtagggaggaggaaaacaagaggagaatgggatcaacagaaggcatatatggggagtgtctggatggctggaaaattctattttttgaccaagatgtggtaaacacggggagtaaagttataactttttctcttactgtgcttttaggttttgttgctttctgtctgtatgctatgttccacaataataaaaatatttaaaaggcaaaaaaagtaaaataatgaatataaaattacactgaaactacatattctcatagatagaactgtaattattagagtttttgctgaataaagtcaaatagactattatagtagttataaacacaagttaaaattttagggccgggcaaagtggctcacgcctgtaatcccagcactttgggtggctgagcgggtggatcacctgaggtcaggtgttcaagaccagcctggccaacatggtgaaagcccgtatctactagaaaatacaaaaaattagctgattgtggtggcgggctcctgtaatcccaactactagggaggctgaggcaggagaatcgcttcaacctgggaggcggaggttgtagtgggctgagattgtgccattgcactccagcctgggcaacaagaatgaaactccatctcaaaaacgaaaaaaaaaaacaaaaaaacttttctttaattttaaaaataatatataagcaagaactataaattcaaattcttaatgctaatcttaatttgaaacatcaaattttgaatattgatacattgctggacaccttttgttcttatttccaatttatttacaatgcacaaagtgacagaaattactgaattttcaataaattatggtactgtagatattaaattatacggatgattatccctaaatttatccttaaataaaataatttcagtcatattgttaccattcaaaaatcatagtatgtgcacacatatatgttggaaaaaatattttgttgctataattttttggctctctattagagaaaaaaccagaaagttaaatgtgttaaagtgtaaaacttacttagtataatctttgggtatgtttttgtatgtgtagtgctgcattgcttgctataataaaatactccaagggaccaggtgcagtggctcacgtctgtaatcccaacactttgggaggccgatacaggcagatcacctgaggtcaggagttcaagactagcctggccaacatggcaaaaccccatctctgcttaaaaatacaaaaattagccgggtgtggtggtggatgcctttaatcccagctactcaggaggctgatgcaaggagaattgcttgaacctgggagtcagaggttgcagtgagccgagattgtaccatggcactctagcctgagcaacagagtgagactccatctcaaaataaaataaaataaaatactccatatttcatcacagtagctgagaatgcaaataaccatttgaaagaatttggcttgctaatgatgctattgatacatatgataaattttacgtactgtataattgcacagagtatttgtacatgttcatatgaaaatgcaaaaaaacaaaaaaacagaaaaaccaaagagcaggtgctatttgctggaagacatgtttgctatgatttttagaatttaataaaagaaaaaaaatagctagcaaacttttggaaatatgttggtttaaagttgtcattgatgaaatactatgtgaaggtgataggagcaggaggctgggaaattctagacagaaaagggcgggtcctcagctaaagccccactctcaagccaaatagactgagactgtggcccaaagggagtacttctatccctgttttcccactcaaatgttgccttttttggcctgccccacccctcatcctatgcccataaaaccccaggctccaccggtagtgagaagtggctgaagatcgagaggagaagcagctcaatgttgtagactatggtgggacgttggagagaagtggcttgacttcagagggacaggttgaaggcgtgactttcgagaagagtctggctggagacagccggacttcaggggaagattaccttcctgcttcacattccctttccagctccccttcctgctgagagtcacttccatcaaaataaaatctccctcatttaccattctccaattcggttgtgcaacctcatttttcttggaagctggacaagagctcaggagccaggaatgcagatacgaaaagttgttacactgaacctctgcccttgctggcaagaggcagccgcctcaagcgaaaaggcaaagggcccactgagctactaacacttaagacgtctgcagatagcagagctaaaagagcactgtaacaccctccccctcgaggtttcaggggtgcgggcacccccccagatgctgctgcggggcctgcacagaatttgttcctgctggcatccaaaagtgctcctgcacctgttcacctgtgtgctccctcccatgagggctgggcgcagtgggtcccagcgagtggatttcacccctgccagccctaaagcagctggctggttctagcgtcagtgagccccagttccctcccatgaaggggtaagggaaatgtcctccatcaaaggtattatttcagtctaagccctgatgctgagaataatatgagaatcataaagccaggagaaagaataattgtgttatcccattaccctgaattgtagcacttagaaaaatgaatggtcacatttattagctagcagtctaccttgtagctatcatcatcatctctatctacatctatcccattaaataatttactttttgaaatatgtacattcataaattggataatgcctacgtaatttaaataaagaatatcattatgggcaagttacattagtaaacggtaaagttcaagtcaagctaaatacatttagatttagaaattaagtttagtttagtttaaaatacattgcttaagaaaatagttatttatggatgaccttaaactaatccaaggaacactataataaacatttagtttttaacgtaaatacaattcttcaatcagagagataaaccatttcatgatcaatctattatttttgtttattatttttattatttatttatttttcttttgagacggagtcttgctctctagcccaggctggagtgcagtggctccatctcagctcattgcaacctccgcctcttgggttcaaacgattctcctgcctcagcctcctgagtagctgagatgacaggcacgtgccaccacaccctaatctcttatttttaaaaagaggattttaggactaaacaaatcaaatgtaagtttcccctcacctctttgatctctcacttgagtaatgatgcagtttgaaggcaaagagccccatttctacattataagcaaaataaaagttaattcatggaatacaatggtgtatttgtaattgaggtactatattttatttattggaatggcattttgagatccagtgctgttcattgaatttccctgtaaggagagtttgtggtttggactcatcaagctgctatgccaaaaacaaaacaaaacaaaacaaaacaaaaagctaatcacatgaaatcaatttcctgtttcttccaacttgcaggataaggcctagacgaagcttttattgtattgtgtgacccaagtgttgggaaaagtagaaaattgttaccagatgtgaagaaacatttaggggcttgaaaagcagcatggaggtggacctaggctctttgcaatgttccacgtcttgccttatttgatggttacatgagtgtttataatacattgctgtgtttaccatttttattttgactcatttctaagtgtgcattataattttatttgaaaattatttattaggagaagtgcaccataaaaattattgattactctgctcattatatacctaggaaaaaattcaccatttatatatctttacatacaactctaagagagttgaagtgggaactttattttagttacaacatgtagaaataagagaagacgctacctgaagtacccagatctttccaaaggtttttttctacttttttttttttttttttttgagacggagtcttgctctgtcgcccaggctggagtgcggtggcgccatctccgctcactgcaagctccgcctccggggttcacaccattctcctgcctcagcctcccaagtagctgggactacaggtgcccgccaccacgcctggctaattttttgtattttttgtagagacggggtttcaccgtgttagccaggatggtctcgatcccctgatctcttgatctgcccacctcagcctcccaaagtgctgggattacaggcgtgagccaccgcgcccagcctctacctttaattatctaccttgcatgacaaaactttgccattccttatctatttttcttttggctcctctattcctgacacaacaagggtggacatatttcccacacgcttggttttgcagagtacctatatcagttaggtttttctgccagagaaacctctccaacactacattacatattgatatctcacatgtctttggattcagtttttctaagctgggtttgctggatggctctggtgatatgagatgggccaagttctgcatcttggaattagttagagtttggacaaagtaggctggatcaggcagggacaaactgactccattattttctcattctccttctgggaacagagtagtagccaggcaatgttctcataataaacagaaaaggaaaagaaactccaatgtggaaaccatctcaaacctctgtgtgaagtctaccaattttctgttaatcaaagcaagctatgtgagtgtactcagagtccaggggcaaggtagtcaccctgtgtgtggtgggaaaatactgcaagattatatgtcaaataatgggatactcaggaatatttacaaaaatgttgaatattttaatgaaataacaaatatttagacattcaatagacttgagagtaactttaccaagggtctaagtatgagagatatgtttaatatatttttatgggctgaaaaccctgagtgggaaaataggactaatttcaccaggatgacctcctggaaatgcattttccattttggaaattattttaaaagttcattttttctggatgggtatgtgtatgtgtgtgtgtctgtctatgtgtgtatgttttatgagcttgttaacactaatgtcatacaaaagtactggttagcaggaataagattttaaggtgtattggcattcccatggttcccaagaaaattttcgatgactttgattaaaaagtttggattttgtctatttaaatctagcataaaaattggtcatggtgatgatcctagttatgactaatctccctttaagatttaggcatttactgtgtgaaatatgtggcacattttccataacaaacagctaaagttactgaacacaaattatggaaaggtgaaatgaggaaaacattgcaaaacactgaaagagaatatgtctttatttgcatgctggcaaatgaaaattccggtttcacttctacttcagtatctaacaagtctctaacaagaacagacattgaatgaatgaattaagttgagctgtttgaaaattagaatgttttccataaatacattattgaactatcaattagcataaactgctactttcttgtttgacactggtcacagtatttgaaagtaaaaagaatgttactgcacattcagaaatcaggtccacataaaatttaaggtcaggatattaaaggatcacagccagtgctgttaggccttcatttattctatctttttgtctgttcagacatgataacttttctacccatcattttttccattctagtagtggttacatttgttcttgggaattttgctaatggcttcatagtgttggtaaattccattgagtgggtcaagagacaaaagatctcctttgctgaccaaattctcactgctctggcagtctccagagttggtttgctctgggtaatattattacattggtatgcaactgttttgaatccaggttcatatagtttaggagtaagaattactactattaatgcctgggctgtaaccaaccatttcagcatctgggttgctactagcctcagcatattttatttcctcaagattgccaatttctccaactttatttttcttcacttaaaaaggagaattaagagtgtcattccagtgatactattggggtctttgttatttttggtttgtcatcttgttgtggtaaacatggatgagagtatgtggacaaaagaatatgaaggaaacgtgagttgggagatcaaattgagtgatccgacgcacctttcagatatgactgtaaccacgcttgcaaacttaataccctttactctgtccctgttatcttttctgctcttaatctgttctttgtgtaaacatctcaagaagatgcagttccatggcaaaggatctccagattccaacaccaaggtccacataaaagctttgcaaacggtgacctccttcctcttgttatttgctgtttactttctgtccctaatcacatcgatttggaattttaggaggaggctgtagaacgaacctgtcctcatgctcagccaaactactgcaattatatacccttcatttcattcattcatcctaatttggggaagcaagaagctgaaacagacctttcttttgattttgtgtcagattaagtgctgagtaaaagacctgaaactctcaaatttctagattcacaagtgggacatcgtgtgtctccaagagaaaacaaactgatgttgtctggaacattttatactttccactggtttttctgtattgtatgtttttgagtaatttccaaaagtatatctagaaaagtcttttacctaaagttagtctaaaaagtatctatatatgcatgtgtatgtgtatatgaaacacttaagagagagtggcaataacataatcattttttacaaactgccaaattatagaaaatattgtaagaaatttttcagaatcatgaagccatgtgtattcacaatacagttcatattatcatgtttcatttgaaaaatttatgatctctatttataattgttaagaacttacagcttatttcacaaaatcattgctcttttccactgttatttgtaccatacgtatgtaccatagtgtgcttaaacgtgattatttgaacgtctagttttttggatggtatgcgcattctaatctaaatcaataatgaagttttatctttggggtagtttttgttgcataatgaattctaattttatgtttaatttaaagcaaacaattattgttagaaaactatgcacaaaataaaattcaaggatgaaaaatatatttggaatacattttgtatatgtctaccatcatcagtactgaggaatattagattttatacaaatatgtgaacaactgagaaaaaagtcatatctgtaatagggatgaagaaagaaacacaatgctgacctcttaactgctgtcataagtctccatatacaggtagaaaagtcatttcttccagtttttgaggtaaagaaaaccttttttgaaattgagatcggataccaaatatttccgtttctttcctaaactgcttcagagcccctaaattgccgattctctccactatcttccacatttaaaaatctttttaaaaatcacataaatgaactcaaatctttattacttgaaaaaatactccatgtaaaaatagtatagaaattatgaaaatcatttgaattatactttctgcaaattctaaaatgacgtctatgacatctatgtattgatgataggaaatgacttaaatatatgttttattataatctagttgcaaataatgcagtgagagaaagtgtgttgacatattcagtgatagcaagttctattataggaaaaaatgtataacgtcattaaacaagtaaattctacagactgtatcaattctcggagttatgaaattttaacaatgttatctaaaccttgagataaatcatttgatttagttatttgtttgtttattatatatctttcctggtacaacgtaagcaccataaaagcagagaccctggtcggggtcggtggctcacgcctataatcccagcactttgagaggccgaggtgggcggatcacgaggtcaggagatcaagaccgtcctggctaacgctgtgaaacccggtctctgctaaaaatacaaaaaaattagcagggcgtggtggcgggagcctgtagtcccagctactcgggaggctgaggcaggagaatggcatgaacccaggaggcggagcttgcagtgagccgagatcgcgccactgcactccagcctgggcgacagagcgagactccgtctcaaaaaacaacaacaacaaaaaacagagatcctgcagaccttgcttattgttgactgccaggacctaaaagatcacataaaaaatagatagccaaaaatattttgaagaacaaatgagttagtgaatagagtaataaattacatgtcttggggtggtgaaccagtgaaaatgaagcatcacaaaatctacagttgcatgaatttgcctattctggtttctggttgagatgacagaattatctaagaagaagcatttttcagagtaaaagtgtggttattccatacttgcaggggaaatatcgctatatatagccttgatgcagctatatcagactaaaaacatggagataaggtggaacatcaaaatcacatggcacccactacaataccttcaaaacagcatataaaagacttttggatatttgtatatattttctcgattgtgaatgatatatttgtattctgatatttctagctggttattatgtaaaaaatgcatttcaattttaaaaattgagttagttatgaattaccttactaaaatgtgatttttatataatatttttaatatcctttctaaatgaacattttaattgccatattataaaatcacagaaaagtgagtgaaaaataaattataccactgaatgaatatcttagctttggaggtctagaactagagccagtgtctgatattaaagtgataacatttctttggaaggtaagtccagggcagcaatggcagggacgcgtggaaattgaggcaagagcacgtggaaagtgaggcaagagcagatgtgaaagaacgtgttgggatgtattgtaacaatgtgttgtgtgtatgtgactctgttgtggcaacttcattataaggtgagagagacagcatggtggtcatcagatgcatgcacttggaccccagtacttttccggaaaggctacaaggggaataccacagccagcattagtccatggaagcgagagaggagggagaatgtatctgttcagctgtcttctgtcttccattttccattggccagggtttccctgaggcggaactaccatctctgctgttctgctttccatcatccagtccgttggtggctgttatgaaagacagacctcaggcccacagtgtggtgttccattcaaggaaggatggtaggatgatctggatcaggcaaggtgctggcctagagaataagtgacagttaagggaatctgaggaagcacatgtttaagtccaatactgtctactccttgtaccactcagatttgctcatgtcttccaatcatggctggctttatgggcatatgatttccactgttgcacagggtcttgtgcttagaggcgctcatgcttagaggggcaatcattagtcttcctgttgcatgctgtattagcagcaatgaacctggtttatttgggggatgctgccatcttctgattttatcattgttcgctgggcacctcttctcaatctcctttgctggttctttctcttgtctctaatcttctgcaactgctgttttgtttttgagacagagggcactcctctgctgaagagggaatggtcttgcactaattccctaggagttttctctcccctctcctgtggatttgtcagagacttggacagagtcctgtaatgcccactatgcatgcctctagcatgtttgaattctgctggatcatctggcacaacgggcagagcagcttaggccagaccctatagctgttatggaacccttttttgttctggtttccacttgagaccaatggcctttggaaactccattagtgagtcagagcaatatcctcaaatgaggaatatgttgactccaaaatcccaataggcccaaaaaacactgtgcctcttttttagtgagaagaattatgtatcaggaaacatgccgtttactttaaaaaggatgttttgacacaaggaccaggagcatggacctgtaaaaacaccatctatgttataagttcctgaatctgctgaggtttatgtctctcttcttctgatattttacttctgttcaaagtaatactattttactatatttaaggaacttgccacttcctgcttatgaataccaattaaagtaatattattaatatattgagttagcatgatgttttgcaaaatgccaattaaactgaaaacagaagtgacacagctctgacataaaacagtgaagcagtgcttttgttcttaccccaacaaacaaattgttttgattttctctcacaaagggtgtagatttaaaaacattcgccaaatcaaaagccacatacaaagtaccagaaaccacgttctgctcagtgaaggtaccacatcctagagagcatctgcaagtgcgatttaagtttatgctaatgtgcattcatctgataatccatctggttttggcagaggccagataggttaactgaatagggatataaaatgtactaccacccccagtgttcattatcaagaggacttaagcttcctttcagtcgtttatctctgcttctgtgaattggctcagtcctgagaactggctgagggtctttgatttgtcatatcagtgcctgacctcaggactcagctttttcaactctgttttcctcttgatttatagttatttagcaaagtatgaagcctcttcaactattggcctatcagcccaatccaatgaggctgttgctgtcaccacttcattaaatctgacatttgttaagatcaccagtgagtgcgtgttgccaatggttagtcttcatgttgcatgctctattagcaacattggacatggtttactggggggatgctgccctcttctgattttattgttgttcactgggcacctcttctcaatctcctttgctagttctttctcttgcctctaaactgaaaatgtcacactgccgaaggtctcaattcttcaatctttaatcaatcagacttgttttgttggtgatctcatgcagtctccttactgataatgtagccaaatggttcaatagagaggaataaggctgattattcatctatatattcatatatatcattttaatatagcattgcagatattggcagattgatatgtggggaattttaattatatgatgatctatatataattagataatgatataagtgaagaaatacatagatagaattatggtttactaacccatttttgatttcttgcgttttgtacaatgtctcagtatctgttagtatcttatttcttaagtttttttctctatgatcaattacttatgagttaatttttgtgtacagtataaaataagggtctaaatttacgtttttttccttctcttttaactcccacttcttaggtaagttcatctactcatggccttacttattttctgtgtgctgatgatgccaacatttaatctttcagctgagatctcaacgctggtctccggaatcctttctctaatagactatttgacatcttcatttggatgcctaacaggaacttgaactaacatgtccaaatcaaaatactgctcttcccccaattgtcagatttgtttcttctacagtctttccctcttctgctaatgaccacttcagactttcagatgcttagactaaaaaaaaatggagtcaatattttctctctttcagaacctatctttaaggcatcagcaaattttgttgactctaccctcaaaaacctacagaatccaatcccttgtcatcactctgccatactagtctaaactgctgcatatcttgccaggatatttgccatgagtttctaattattctttctagttctgcacatccttttatcctgatgtattctcaaggtggcagccagagagaacctgtaaaaacgcaaatttgatcatgccattcttctcctccagatttttcagtggctttcatctaattcagagtaaaggccaaatccttacaaagtcttataatcatttgaatgatctgattttgtctgcctgtgtgccctaaaacacctggctcatcccatgctaacaacactggcctttgtgtcacttcttgaatatgccaagcattgcctcagggacttcatacttgtgtcccttcttcttggattgctctttctcagatatcaacactgaacgttatcactcctcagatatcattgaatcattgaggcctccaatactaccttatttaaagataaatctcatttcactttgcagtttttttttctttttttagcttttattttagattctggggtacatgtgcaggtttgttatgtaactaaattgcatgtctcaggcactttgtgtacagattattttgtcactcgggtgggaagcagagtacctgataggtatctcttttatcttcactctcctccttctctctgttcacatagaccgtggtgtctgtcgttcccttctttgtgtccatctgtactcaatgtttagcacccacttataagtgagaacatgtggtatttgttttctgtttccatgtttattggcttaggataatggcctccagctccacccatattgctacatcatcttgtttttttctaatgactgcatagtattccatggtgtgtatgtaccatattttctttatccagtctactatttatgggcagttaggtttattccatgtctttgctattatgaatagttctgtcatgaatattttcatgcatgtgtctttatggtagaacaatttatatttctctggatatatatccaataatggaattgctggtttgaatggtaattctgtgttaagttctttggaaaattgccatgctgatttccacaatggctggactaatttacctccccaccagcagtgtgaaagcattccctttcaccacaatcttgccagaatctgttgttttttgggggttttagtaatagctattctgactggtatgagatagtatctcattgtggttttgaatcacatttctttaatgattagttatattgagcattttttcatatgtttgttggctgagtgtatgtcttcacttgaaaattgttcatgtcctttatcaaatttttaatggtggtatttgttttttgcttgtaaatgtaaattccttatatgttccggatattacgcctttgtcatttgcatagtttacgaaatattttctcccattctgcaggttgtctgtttactctgttgatagtttcttttcttgtgcagaagctcttcagtttaatgaggttccacttttcaatttttgtttctgttgcaattgattttggtgtctttgccatgaaatctttgccaggtcctatgcaggaatggtgtttactaggttatttttccgttttttaaaaaaatagttttaggttttacattttattatttaacccagcttgcattgagttttgtgtatgtataagaaaggtgtccagtttccatcttctgcacatggctatccagttatcccagcaccatttatagagcagggagtctctcctcatggcttgtttttgttaactttgttgaagattagatggttgtaggtgggtggcattatttctcgggtctctattctgttcccttggtctacgtgcctgtttttgtaccactaccatgctgttttagtctctgtatccttgtagtatggttcagtcaggtaatgttatacttcctgctttgttctttttgtttggtattgccttggctatttgggctttttttttttcattcccagtgaattttaaaatagtttgtttctaattttgtgaagaatatcaatgataatttgacaggaatagcattgaatctataaattggtttgggcagtatgggcatttaaacaatattgattcttcccatccatgcacctggaacgttttcccgtttgtccatgtcttattggatttaattgaacagtctcttgtaatactctttgtagagatatttcacctccctggtcagctgtattcctatgtattttattttttgggactattgtgaaagggattgccttcttgatttgtctttgcttgaattttgttgctataggaatgctactaatttttgtacattgattttgtatcctgggaatttgctgagtttgtttatcagaccaaggagattttggccagaaactgtggggatttctaggtataaagtcacattatctgcgaacagggataatttgacttcttctcttctattgggatgccttttatttatttctcttcctgattgctttgaccaggacttccagtactgttgaataagagtggtgagagaggacacccttgtcttgttcctgttttcaaggggtaatgcttccagttttgcccatttagtatgatattggctgtgggtttgtcatgggtggctcttattattgtgaagtatatatcttcaatgtctagtttgttgagagtttttaatatgaagagacattgaattttattgaaagccttttctgcatctattgagatagtaatgtggtttttgttagtttcacttatgtgatgaatcacatatattgatttacatgtgtttaaccaaacttgtatcccagtgataaagcctgcttgattatggtggattagctttttgatgtgctgctggattcaacttgctggcattttgtggagtgttttttttaaatctatgtttattgaggttgttttcttttattgttgtgtctctgcctggttttggtatcagggtgatattagccttgtagaatgagttagcgtggagtttcttttcctcagttttttagagtaggtttagtgtgaatagtaccagttctttatacacatggtggaattctgctgagaatctatcaggtcctaggctttttttgtttgtttgtctggtaggctttttattactctttcaatttggaacttgttattggtttgctcagggattcaatttcttactgattcagtcttgaaaggttgtacatatccagcagtttatccatttcttctaggttttctagcttgtgggcatagaggtgttgacagtagtttgggaggattgtttgtatttcagtggggtcagtggtaatatccactttgtcatttttgattgggtttatttggatcttctctcttttttttctttattagtctggttaggggtctatcatattaattttttaaaaacatcaaatcctggattcactgaccttttgtatgttttttttaatcacaatttccttcagttcagctctgattttggttatttattgtcttttgctagctttggcattggtttgctcttgtttgtttagtttctcttgtgaagttatgttattaatttgagatcattctaactttttgatgtgagtgtttattgctacgaactttcctcttaacactgccttatccatatcccagagattctggtatgttgtatctttgttctcattatgttcaaaaaatttcttgatttctgccttaatttcaatatgtacccaaaagtcattcaggagagggttgtttaatttctatgtaattatatggttttaaggtattttcttagtatttatttatatttttattgtgctgtggtccaagaatgtggttggtatggttttctttttttcatatttgctaggaattgttttatgttaggttgtgtggctgattttagattatatgccatgtgcagatgagaagaatgtgtattctgttgttttggggtgaactgttttgtggatgtctattaggttcatttggttaagtgtctatttcaggtcctgaataactttgttagttttctgccttgatgttctgtctagtgctgttggtggggtgttgaaatctcttgctattattgtgtgattttctaaatcttttaataggtctctgagaacttgctttctgaatctgggtgttcttttgtcaggtgcatatacatttagaatagtaatgtcttcctggtgaattgagcctttttcaattatgcaatgcccttctgtttcttcttgatctttgctggttaaagacagttttgtatgaaagtagattatcaaggtcaggtgccatggctcagacttgtaataccagcacttcaggaggctgaggtgggtggatcacttgaccccaggagtttgagaccagcctgagcaacatggcaaaatcctgtctctatcaagaaaaaaacaaatacaaaaattagccagtcatggtggtgcacacatgtggtcccaggtacttgcaaggctgagttgggaggatttcttgagaccaggaggtagaggttgtggtaggctgagattgcgccactgcactatggcctgggcaacagagtgagaccctgactcaaaacaaacaaacaaacaaaaagaagttagaatagcaaccctgcttctattttccatttgcttggtagatttttctccatcttttaaatttgagcttatgggtatcactgcatgtaagtgagtctcttgaagacactataccattgcgtcttgcttctttatccaaattgcctctatgtgccttttagttggggtgtttaacctgtttacattcgaggttagtattgatatgtgggaatttgatcctttcattatgttgttagctgcttatcatgcagactggtttctgtggttactttatagtatactggtctatggccttaagtgtgattttgttatggctgataatgatctttcttttctatgattagcaatccattcaggacctcttgtgaggtgggtctggtggtaatcaaatcccttagcatttgtttgtctgaaaaagatcctatttctccttcacttatgaagtttagtttggctggatatgaaattcttggtcggacattctttttcaaaaaatttctgaatatgagcccccatctcttcctggttgtagagtttctgctaacaggtccactgttagctcaatgctgttccctttgtaggtgacctgccctttctctctagatgcctatggcactttttctttcattttcgccttggagaatctgatgactatgtgtcttgggtatattcttcttgtgtagtatttcgtaggggttctctgcatttcctgaatttgaatgctggcctctctaacaaggttgaggaaatttttatggactatatcctgaaataggttttccaagttgtttgccttctattcctgtatttcatggatgccaatgagtcatatatttagtctgttaacaaaatattatatttcttggaggttttgtgcattcttcttcattatttttctttatttttgcctgactgagtaatttcagaggactactcttgagctctgagattctttccccagctttgttgattctgttgttaacacttgcattagtattccaaaattcgtgaagtgatgttttcagctctatcagatcagttggattttttcttaaaatgaccattttgtttgtgtcttctgtatcattttatggcgttcctcagaatctttggattgtgttttgactttctcctgaatttcattgatctttgttcctatccatggtctgaatcatatttctgccttttcagcatgggagggaactagcgtggtcatttggaggtaagaagatactctggctttttgagttgccacagttattgtgctgattctttctcatctctgtgggctgatattcttcagtcttcgaagttgccattctttggatttttttttttctgtttttatcttctttgacacactttggggtttcactgtggattccatcaaatgagtttgtttctggtagattttaggggggaaaagatttctaactctaagtctggggtctagttttggacaccggactttgttctctggcacctcaacattgggaatctgctgtgctggaagggacattgtgttcctgaattgctggccacaacactctgaaggatggtaccagccaaagctcttcattgaatagtgacagtgtaacgcaagcttgttaacacatgccagcagcagcagtgtggcagggtataggctcttggaccgggatggggtgcaggctggcccaaggctgccagcttccatgcgggcattggcagtagcctaaattcatctttatgcatgtggatatttaattttcccagaatcatttgttgagaaaaatgattaattcctattgaattgcaattgtatgattttaaaaatcagctgaccatgaatgtcattactaatttctggacagtcaattgtgtttcattgttctttttgtctctcatagtgcaattaccacagtgtcttgatttagtccagtaaacttgcagtaaactttgaaatgagaaactaatcctccaactttgtatttaaaaaaaaattattttattggcctaatcacttggcatttccaggcatatttttggagtagttttacattttctgcagaaaaagctttctgtgacgtgatgagggttgcattataaattgctcttcacacgtaaagactcgccttgtgctggatttcatttcaggtggtccttattgcttgcaagctctttgatgaatacaaacataattttggcccctttatttatcttatgctagttgttgcagaaggacatcttgctttcttgaacctattacatctattcaaaagtggaagttttcacaggtaacctctctgtatcaagtaacacaagatcaaataaaacacgagcaatccttgtttcgtgcctgaaccagacaggtgatattgaaatcagttatacaaatgtgtactaactcttcataaagactatccaaagagggtattattatcatctgcatttaatagatagctatcctaaggctgttgtaaaatagattctcggatcatacctatatgaagcagagaactggatttcctttcctggcagtctgactccaagatcctttcttagaaacaattatactgtaaaaactgagaatgaataaaacccaacattggagactgattttaacatctgttaatcttaaaccattaaataataaaaataagttaaaatgaaagaaaaatatccaaatattcatatacagagaagtcaatattcttcaatcgaaaacacattttttaagtgctcaaggaatatttacaaaaatgctgaatatttaattaaataattcatatttgtatatcaaattgacttaagagaatgacttccttaaaagcctaaggatgcgagatcagttcgataaatattgaaaatgggctgaaaattatgagtaggaaaatagggccatttcaacctgcatgtgacatccctaaaatttattttccattttggaaactgtaggacaaaaactattcccattcatgtggggtatatgtatatgtgtatgggtgtatatgtcttcccaagaaaatcttgaatgcttttgataggaaaaatttagattctgtttacatgtatctggtattgagaaaaataaattaacagcagtcatgatacaagttatgatcaagcttccttcagaaatttagacatccaatatatgatctatgtattgggtttaaaaatttccatagcaagtgatgttgctgaacacaaattatgactacacgaggaaaatattgcaaaacagtgaaagagaatatgtcttcatttgcatgcttgcaaatgagaaatcagcttttacttcaaaattattatgaaaaaagcctatagcaagaagagacgttgtttaaatagtaggtaatttgagccgttttgaaaattacattttttccataaaggcagcattgaactcatccattagtatgccctagcgctttcctatttgacattggtcccagaattgaatttagaagaaccaagaattttactgcacattcagaaatcaggatcgcagagagtttaagatcaagaccttaaaggggatcatgaccagtgatactgggcttgcccttttttaatgtgtgtttgttcagacatgggaagtttactaccaatcttttttttttccaaactagtaatgatagaatttgtattttcctatgatgcctatattaaatgtataatcattttaatattttaacacttttttaatgagttctttcaagggttgttaaacaatctaaacaatctaattttcccttacaatatgctgatagctaatcatattttctcaaagtcatttgacataatgtttgattgaagaaaatatctctggtatgactctacttgctgataacaaaagagaatttgaaacttcaagaaaaaagattagaaaagttaacaacataatacaaataagtatattaaatatataatttattcttaagaaatgtatatgaaatcagagtcgtagaatgaaaaaagagtaatatgtaatttttaaactacagttacatttcaaatgtgaatttaaattgtaaaatgttaagtttaataatattttatataaatataaaagtgcaaaaattattctttgatgtttctaattttgaaaagggcatgaggcactgacaattttcagacacttctcctaggattatcaattgaaagaattcctttggctgagtatgacataatctgattatgatggaggatcacctcataagacccaatatttgtactcctactggaatacatatgaaaaaagtgtgtatcactgtgttttaatagctcaagttgagaagtctcccaaatgtccatcagtgataaaatgataaataaattatggcatacttatgcggtagagtactatacagcaattaaaaagcaaaccagagtgacatgtttacaaagaatttatataacaaagaaaatgaacaaatttgagctaaatagctaatacagatgtgagaggaattatcaatattgaaaaaatattcaatataattcaatttatatgaagtttgcaaaaatatattttaatacattgtaatttattacattggtggcaaaactctaaaacgaaacatataagtgattatcataacaactgggatatgtgggaggaagaaaactaaagagaaacaatatcaacaagaaggtatatatggggagtgtctggatttttggcaaattttattttttggccaagatgtagtaaacatgggagataaacttataattttttccctaactgtgtatttaagttttgttacttttcataactatgttatgttcgacaatagtaaaaatatttaaaaatcagaaaataaagtaaaataataaaaaattaagccaaaactacatatgtgcatagatacaatggtattataattatcatgtttttcttaacaaagaagcatagtgcattatggtagtaagaaatacaagttaaaattataagcttttctttaaattaatttttaaaagaaggtataatctagaaatgtaaatttaaattcttaatgctaatcttggacaaagcctccaggagcaactgaaaacctctctgccactggcctctgcagtagaactgcccttgccactcttggactaatgaaggagcaaagatcctaagtgccttatccatacctccaacaagatgcagtcaacccaaggagagaaacccagttagacttccatgggtcccacaaatgcacaaaccctccatcttgggctgactgcactgagtgtttgctgacctgcatctctctgggatggaacccccagaggttgactcttggccacaaccactactaagatctcttcagtgctacctctaaactgggaaaggaatataaacactgagattccaccagggctgcagttggcagctcaggaatgccaagttttgaactgtagccaggactgaagggcacaaggaacctacatcttcagaacactgagagggaacatggctgcaactgtgaggaaacataggggaaacatataattgagcaacagtctatcaactgaccaataagcataagtgtcacctgctggattacaccccaaaacttcaacaccaaaaatgcctcactaacataaccccctttgaagccagagacacaaagtcagcttcaaataaataccctacacaaaggctctccctggtgaaaacatccagaaaggaagtctatttactgtgcctaatatacactgcagttaaagaaacacccacatacagagatgagaaagaacaaatgcaataactcaaatggccagaatatcatatttcctccaaaagactacagcagttttccaacaagagttcttaacaaggttgaactggctagaatgacagaatacagtatatggcagaaacaaagattattgagatttgggaggaagacaaaacccaatccaaggaaaataagaatcacaataatgtgatacaggagctgaaggatgaaataaccagtattagaaagaatttaatgggtctgacagagctgaataacgcaatacaagaatctcacaatgcaatcacaaggattatcagcagaatatactagtctgagggaagagtttcagaacttgaagactggttttctgaaataatacagtcagacaaaaataaagaaaaagcataaaaagaaatgaacaaaacccctgagaagtatgggattataaaaagaggttaaatctgtaaatcactggaatccctgaaagggagagccagaaagcaaacaacttggaaagtatatttcagaatatcattcatgaactctttcccaaccttgctagagaggccaacagacatattcaggaaatacagagaactcatgcaagattctacacaagatcatctccaagatatataatcatcagatttcccaagattgaaataaaagaaagaatgttaaaggcagccagagagaaagggcaggtcacgtacaaagggatttctatcacggtaacagcagatctgtcagctgagttcttacaaattagaagagattggaggcctatattcaacattcttaaagaaaaaaatcttcagccaagaatttcatatccaaccaaattaagctttttaagtgaaggagaaggaagatttttttcaggtaagcaaatgttgagggaatttattatcaccagaactgccttacaagagatcttgaaagcggcacttagtatagaaaagaacaccactaccagctaataaaaaaaaccctgaaacacagagaccagtgtcactgtaaagcaacaacacaaacaagacaacataataacaagctaacagcacaatgacaggatcaaatccacacatatcaatattaatcttgaatgtaaatgggctaaatgacacaattaaatggcacagaatggcaagcaggataaaaaagcaagacccaatggtattctgtcttcaagagacccgtctcaaatttaatgacactcataggctcaaaataaataaatggagaaaaatctaccaagcaaatggaaaacagaaaaaaggggggttgcaatcctaatttcagacaaaacaagtttcaaacaaatgaaagttttttaaaaaaaagacaagcaaggatataacataatggtaaagtattcaatttaacaagaagacctaacaatcccaaatagatatgcacccaatacaggaatgtctggattcatgaggcaagttcttagagacctacaaatagacatacactcccacccaataatagtgagtgacatcaacactccactgacagtattagatcatacaggcagaaaattaatgaagatatttaggacctaaacttagcattggaccaaatggatctggtagacctttacagaagtgtccatccccaaataagagaatatacattcttttcatagccacatggcacatactctataatcaaccacataattggatataaaacaatcctcaacaaatgtaaaataaccaaaatcataccaaacacactctcaggccacagtgcaataaaaataaaagtcaacacaatgaaaattattaaagcatacaattacatggaaattaaacatcatgctcctggatgacttttagataaatttaagtctgaaatcaagaagttctataaaaataataagaacaaagatacaacaaaccagaatctctgagacacaactaaggcagtagtaagagggaaattcatagcactaaatgcccacatcaaaaagtttgtaaggcctcaaattaacaatctaaattcaaaattgaaagaattagagaaaaaagaacaaatcaaccccgaagctagcagaagataaggaataacacaaatcagagctgaactgaaggaaattaagacacaaaaaaccattcaaaagatcaatgaatttgggagttggaattaaaaataattataaaataggccactaggtagactaattaagaagaaaagagagaagatccaaataaacacaattagaaatgatttaaaggaatgttattacttaccctacagaaatggaaacagccatcagaaccactgtaaacacctctgtgcagacaaactagaaaacctagaagagatagataaattcctggacacatacaccctccctgctgctggaagtcagagaccccaaacggagggaccagctgaagccatggcagaagaacataaattgtgaagatttcatggacatttattagttccccaaattaatacttttataatttcttatgcctgtctttactgcaatctctgaacataaattgtgaagatttcatggacacttatcacttccccaatcaatacctttgtgatttcctatgcctgtctttacgttaatctcttaatcccatcatcttcataagctgaggaggatgtatgttgcctcaggaccctgtgatgattgcattaactgcacaaattgtagagcctgtgtgtttgaacaatatgaaatctgggcaccttgaaaaaagaacaggataacagcaatgtttagggaaaaagggagataaccttaacctctgactgctggttagctaggtggaacagagccatatttctcttctttcaaaagcaaatggagaaatatcactgaattctttttctcagcaaggaacatccctgagaaagagaatgtgtccctgaggggaggcctctgaaatggccgctttggggacggctgtcttttacagtcttagctgagggatgaaataagctctggtctcccgtagcactcccaggcttattaggatgaggaaattcctgcctaataaattttggtcaaaccggttgtctgctctcaaaccctgtctcctgataagatgttatccatgacaattcatgcccgaaacttcattagcaattttaattttgccccggtcttgtggtcctgtgatctcgccctgcctccatttgccttttgatattttattaccttgtgaagcatgtgatctctgtgacccacaccctatttgtacactccctccccttttgaaaatcactaataagaacttgctggttttatggcttagggggcatcactgaacctgccaacatgtgatgtctcccccagacaccagctttaaaatttctctcttttgtactctgtctttttatttctcagactggctgacacttagggaaaatagaaaagaacctaagtgaaatatcgggggtgaatttcacccgatactcccaagactgaaccaggaagaaatttgttccctgcacagaccaataatgaactccaaaattgaatcagtaataaatagcctatgaacccaaaaaagcccaagacctgctggattcacagccaaattctaccaggtgtacaaagaagagctgttaccatttttacagaaactaatccaaaaagtttaggaggacttctctttaattcattgtatgaggccagcatcatcttgataccaaaacctggcagagacacaacagcaacagaaaattacagaccaaaatccttgatggacatcgatgcaaaaatcctcaacaaaacctttgcaaactgaatccacaagcccatcaaaaagctaatccaccatgatcaaataggcctcatcctggcatgcaaagttagttcaacatacaaaaatcaataaatatgattcatcacataaacagaactaaagacaaaaaccacatgactgtctcaataaatgcagaaaaggcttttgataaaaattcaacatcccttcatgttaaactatttcaaaaaattagatattgaaggaacatactaaaaataataagagccatctatgataaacccacacccaacatcatactgaatgggcaaaagctggaagcattcctcttgaaaaccagcaacaggaaacgattccctctgtcaccatttcttttcaacatagtattggaagtcctggccagagcaatcaggtaagagaaagaaataaaggacgcccaaaaaaccatagagtatgtcaaactgtttgcagttgacatattctctatctacaaaaccccatagtcttggctcaaaagctccttcatctgataaacaacttcagaaaagttgcaggatacaaaatcaatgtacaaaaatcacttgtattcctataaaccaacaacaatcaaatcaggaaggcaatcccattcacaattgccacacacacaaaaaatacctaggaatacagcaaacgagggaagtgaaaaatttacacaataagaattataaaaaaacttcccaaaaagatcagagaagacacaaacaaatgggaaaacatcccatgttcatggatacaaagaatcaattattaaaatggctgtactgcccaaaggaatgtacagattcaatgttattcctatcaaactaccaatgagattcttcacagaactggaaaaatttattttacaatttatatggaaccaaaaaagagccctaatagttaaagtaatactaagtgaaaacaacagagctaacaaagctagaggaatcacattacccaacttcaaactatgttacagagctacagtgaccaatatagcatggtactggcataaaaacaggtacatacaccaatggaacagaatagagatcccagaaataaggccacacatttatgactatctaatctttgacaaaactgacaaaaacaagctatgggaacaagacttcgtatttaataaatagcactgggataactggctagctatctgcagaagatcaaatctgaaattcttccctgtaccatataaaaaaatcaagtcaaaatggattaaagacctaaatgtaaaaagaaacctgtaaaagccctggaagacaacctaggcaataccatcctggacctaggaatgagcaaagatttcatggcaaagacatcaaaagcaatcaaacaaaaacaaaaattgacaaatgggatcctattaaacttaagagcccctgcacaagaaaagaaaatatcaacagagtaaatcgacaacctacagaatgaaagaaaatatttgcaaacaatgcatctgacaaaggccttatatccaacatctataaggaacttgaatttacaagagaaaaacaaccacattaaaaagtgggcaaaagacctgaacagacacttctcaaaagaagacgtacatgtgaccaagaagcatgtgaataaaaacttaacatcactgatcattagagaaatccaaatcaaaaccacaatgaggtaccatctcacaccagtcagaatggctattactaaaatgtgaaaaacaatcagctccatcatggtggatgggaggcaggactaaattgcagttctgacttggaaagacagaggagcttgtgaaggcttgcatcatgaattttagctccagaaagactgcagaaaaaaatcaggaaatgcgagaggacccacaggttttctgaagaaagtgggctgctcctgcagaacctgggagacaccccaaatactgtgaaggcccaaattgcagaagtgggaaagggagatcctctgcccccaaacacaacctcccctgggaaaactgaaggtctattttatgggaaaagattacaaccttacctggagctgagttaatttagagagctgagcaaaatacaggaatagagggagcagtagaaaaggccctgtgagctcgctgggtcctcaagcaggctattcctgtgtggcatcacaaagatcctttgggagggtgacaagagggaaatgccacagagagaaggaaatcaccagctgaattttggaacaatttgaagtcatcaagaagcctcctggccagaactgagggaagagttcaaatccattgtgcagactaaataggcaggggaagaactaaagtcctactttctttcacagctaggaggtgggtagcctgtggcaagttctcagccctgcttgccgactgtctggaaacagacagggtgccattggggaggcatggtgggagtgagaccagccctttggattgcatgggagctgggtcaggcctgtgactgccagcgttctctcacttccacgacaacctgcatgactcagcagaggcagcttccttctaggtgcataactccattaacctggaaacctcagccccatcccccctagcagccacagcaggagagagtgagtctgagctcagacatgcttagctctgccccacctgatggtacttccctacccaccctggtattctgagcacaaagggcataaactcttgagagttctagtgacttacccactgccggtgcctcttcatactatcacagctgatgctctctagaaagaactacctcctggtaggaggccaaccacacaaaaatagagcattaaactcccaaagctaagaaccctcacagagtccatttcacccccctgccacctccaccagaacaggtgctggtatccacagttgagagaccaacagatggtttacatcacaggactctgtgcagacaaccccaatatcagcctggagcctggtggactttcttggtgactagatccagaagagagataacaattactacagctcagctgtcaggaagccacatccataggaaaaaagggagaatactacatcaaagaaacaccctctggaacaaaaaagtctaaacaacagccttcagccctagatcttttctctgatagagcctacccaaatgaggaggagccagaaaaccaactctggtaatatgacaaaacaaggctctttaacactccccaaacatcacactagctcaccagcaatggatccaaaccaagaagaaatccctgatttacctgaaaaaaaattcaggaggttagttattaagctaatcagaaaggcaccagagaaaagtgaagcccaatgcaaggaaatccaaaaatatgatacaagaagtgaagggagaaatattcaaataaattttaataataaataataaattttaataataaataaataataaattttaataataaataaattcaaacatttgatacagttagtacataaattttgatgcataaaaaagttaaaatgaaacacactaatctgttctgtatacacctaaatgtaactttgacactgaaatggattaagacactgctcttctctgaggaactgagtttttattctaatttctggatgtagtgtgtgggaattattatttttgctgctctttttctgaaaaagattgcctttccctaagagctgttgttccaatgaaaacctagtgttttcaacccagcatgaatgatgcaagtgctgaggtcctttgggcgagaccctctggggttattgtagctctcactggagacgtgagctctgctctcttttcaaagtatccatgaagtctcaacagaacccaccacacaaccccccacccaccatggtagtttgtctttctctttgtcttctttcccaacctcatctttattgcctggatatagcgaggccagggtaaccttcttgtctctatgtggatagtacgtttgtacttctagccttgggatttttccttaatatttgtccatgctagctgagtttgccttttcaatagctctcttgactaaatatacggtaatttccaagatattttggttttattttattttatttttgcttagctttgcttcaggggactgaaggtgagggatcagttcttcatagtggaacaccttacatctttctctgccatctttgacgtttatgaggcatatttttctactttgtttggtagctgttgctgaatttgtttcattggtgctttgctcactttacttacttttttagctattgaagaagaatgactgtatcatgctgctgatttccccgtcttggctagacagtatgtcatcctttatctacattggtccctgtagtgaggatcatggagtagatgttgctgggagagtgagtatatgtgaaaaaaatgtgaaggtatttggtgctgatgaagcaatatgccctactgggcaggggagaggcacagaataagaattcttgccatgtggatgaactcattcaaacacaatgactgctttatgagacaatagatagatttctacctcttctcacatgtacagagaaaatatttccaaagtctccggaatatttacatgtattactatttaatataaacttgcaagtctttttaaatgtgtttaaaactatcacagtactaaacatgaactagatgcataataaatgctgaaagtaaaaagcctgaattatttaagtgaaaagagaaaaagatttagatcccaaataaatgtatgcgtttgtgtgtttgtgtgtgtgcgcgcatgtttgctgggcatgtacttgtaaaaagtaaaataatagaaaagtattattcttggtacccagcattctaggaataatgtcttccacaagattattagaaaactctgctactttgtaggaggagctttggataactatgaataagtccctttacagacttaactttaaaaaaccatctgatttttctttattttctttatttttattgtaaattgacatattttacttgcatacatttatgaggtatcaggtgttgttatgatttatgactactatgtggaataattaaatgaaactaattaacgtattcaaatgataataaatataacagataacaggtaacaaatatttttttatggtgagaatatttgaaagttactttttcagcaattttgtaatgtacaatacactattattaaccatattcacaatgctgttcaatagatctcagaaaagcagaacaaaacttattcctcttgtctaactgaggttctgtaaactttcaccatcatctccccatttttctccacccaaacacggaagtatgtaaaaattctcagtgcttacaaagtttcatataccaatttttgtaatgatacttccccagaactcaatttgacagactgaagtatgtagataagacaaaaaaaaaaaaaaaaaacacacaaaccaatgaaaataaatatgtccttatttgcatgtttacaaatgagaattcagtgtttcctttctcaccagctacaaaagacttcagcctactgtgtataaggcacacagcatctggatgaagctcagctgagctgtctggggaaatacagagatttttatgaagagagctttaaacccagccattagcaaatctggatggttgctggtttaacattccctttttaaagggaatatattattgaattttcaagaatcagatatacatagcattttagatgaatgcattaagaagtcttcagcagtgatattagacattggggcatgctcttacaggcaatgggtggtgtcataaagagcatatttacattcgttttaattgtggaatttataattggaaatttaggaaatagtttcatagcactggtgaactgtattgactgggtcaagggaagaaagatctcttcggttgatcggatcctcactgctttggcaatctctcgaattagcctggtttggttaatattcggaagctggtgtgtgtctgtgtttttcccagctttatttgccactgaaaaaatgttcagaatgcttactaatatctggacagtgatcaatcattttagtgtctggttagctacaggcctcggtactttttattttctcaagatagccaatttttctaactctatttttctctacctaaagtggagggttaaaaaggtggttttggtgctgcttcttgtgacttcggtcttcttgtttttaaatattgcactgataaacatccatataaatgccagtatcaatggatacagaagaaacaagacttgcagttctgattcaagtaactttacacgattttccagtcttattgtattaaccagcactgtgttcattttcataccctttactttgtccctggcaatgtttcttctcctcatcttctccatgtggaaacatcgcaagaagatgcagcacactgtcaaaatatccggagacgccagcaccaaagcccacagaggagttaaaagtgtgatcactttcttcctactctatgccattttctctctgtcttttttcatatcagtttggacctctgaaaggttggaggaaaatctaattattctttcccaggtgatgggaatggcttatccttcatgtcactcatgtgttctgattcttggaaacaagaagctgagacaggcctctctgtcagtgctactgtggctgaggtacatgttcaaagatggggagccctcaggtcacaaagaatttagagaatcatcttgaatatattagaaaaaaaatagctcctaagaaattcttgtatgttatataaatttatacttccttaagattctttcattgtgtataactttgtgaattttacaaagatatgcttggaatcaacaccatccaaacatatcacaaattaggatatatgaaagtatgtatattaccatacagagaagaatgcgaatactataaagagttcttatacaaacagataatatagattttgtatcaatcattcaccttttttgagatttttaaatgagaaaacctataatgtataaaatacatgtgtgtatgtatgtatgtgacacagttactaaaaataggcttcttaaacttacatctcaatctggtagataaagtacataaaagaatatggaattttagtacctatattaagtgtttttaatttttgtataatatttagtacctgattagcgtgtatgcaaaaaagtaatttgcttcgtttgttgaattagaagccagctgccttactaaactaccacatttgctttgctcattctcttggctttgcagatagaaaattatatcatctgcatatagtgacttataatgattattttacttctccattttactacttgtaattcttttttggtatcagttgtataatgaaatggtttgaacattcaaagtgttaagtaatcctgatcgtaactgctgtctttgcaaatggagtgttttctagtgttttaacaataaacgtaatactgactctagctttgagataaattcttttaaaaatattcttcagggagaatatttgtttcctatcttcctgtgtatagtattgtaataaaatctctgttaaaaactatcaaattttttgctgtttattaagatgatcatattttccctctcctctgaccaattaaaataatgatacttgttaatggtggtacataaaacaatgacatgtcttctagtctatgcattctagatttaataaaatacaatatacatattcatacacacgcacgcacacacacacacagagagagagagagagagagagagaaataaaattgcaaccttagaggcaaatgggaattcagaaagcagctgcaaggtagtgagaggtaatctccaaaaggggaagataatcccagtttgaataacatgaaaaattgtgtcaaagaactgtatgccagaagacagttgattcattttttcaagggctaaggaatgtaaccgtaatcctgaattctttgctaaaaatttgttctggggtttgaattaaataataacattcccctctccccttaaaaaaagatgagggctgtttactaaacatacgtccttactgaaaatgctaataaccaatctgcttcagaaagactgttatggactgacttgtttgtctccaaaatccatgtgttgaagcccacactctcaatgtgactgtatttggatataaggcttttaagtaggtagttaaggttaaattaggccatacagtgaggccgtagtacaataggactggtgtctttataaaaagaggaagaaacaggcatctgtgggcacagagaaaacacaatgatgtatgattccatttatataccattctagaatatggaaagtaatctatagtgactgaaagcagatccatggttgcctggtaactgggggtttgataaagaatgggcagtggtaagttggaggaataacacaggaacataaaggaaagttttgggggtactatatatgtttgttacctgattatagtgatggtttcacatgtgatgagtatcacatggtgagacactcatgaaattgtacactttatatctgtacaacttattgcatgtcaagtatacctcaagtggcatattagaaacaactcaggaggaaaactgcacataagtatgcattcttagaaagcttctctttgcaactttggaagaatcaaatattattatttcctattcttattttttgatcttagcctgggccttatgtttactggaataaaatat

SEQ ID NO: 14725 - DNA, 51062 bp, Human
atttatgtaataaacgcttcgcacagttcttacaatgtgcctgccaaccttatttaggtaggtacaattaagacttccactttacacaccagaaaataaggcacagagtcgacacagccactgagtgtcagagcaagaattggcactcatcccgtgagcgcctcagttctttttttttctttatatatactttaagttctagggcacatgtgcacaactgtggcacatatacaccacggaatactatgcagccataaaaaaggatgagttcatgtcctttgtacggacatggatgaagctggaaaccatcattctcagcaaactatcgcaagggcagagcgcctcagttcttaaaccactcttctatgctgcggcagaatcactggaagtctcagggagtcctgagtgcgcaattctaggaaaagtatctatatctgtaagaaagaaggggcagggaatctaacggttctcagctcttgaaggcacattagattcattcaaggtcctctctaaaaatacactttcttgggcctccacgagaaaaattctattcaattagtcgtgggcttgcatccgtatttttagtctgtaaaagtggaatgttatctcaaatcagtggttttcaaactttttatattctgcggaccttgacacgggcccccaataccctgacacggttacttacaatccgggagagagtgggagaaagggggagagagggaaggggagagggggaggggagagagagagaatgaatgagaatgaatcttttagagaggtagagggggttggcccgtgccacaaaccacctctcaggtttgagtgaagccttcgttctctctcgtgcagagaccatgccatccttccagaaaggagcattttaggacgttttaggacgagagacctgtaattggcctaagactcaggtgcaggtggaggaagcatcggatttacaacagtggtcctgccttcttcgatgtgacttccagttttaaattcaattctaatttacacaaatcccacccactatgtaaacttgttggaaaatgtcctgcactctgcacttcgtggcatttaaaacttccacacacgcgcgcgttctttctcgaagccccgtgattgcttagcctcgctgggcagcttggcactgctgggagcttggctcgccctgccggggccgacgccgcccgtcccgcaggagcccgcgcggggctcagggcactcaggactccgcatgcgtcccggctccaggtgggccccggcaccgccaaccgcaggaaacccgccgagccctaaacgtctcccaagcggctgcagtctgcgacagagagtgtccctcggtggagcgccctgtggctgcccaggctacagccgtggccgaggcgaggacacacttctgacctggggctccagcaaagactgtccgcgagcggcgactccatgcccgcagccctccgcccagctcagccgcccggccgcgggcaccagcagccgcgccacgaaagggcgcaccgcgcgggcgccgtctctcctaggtgcgaaggcggctgaggccccgcccgggaggcacccgcgcggctccggagtgggccggagggacgtccgggggcggggcccgggcgcgcccgccctctgaccgggctataacacccggccccgccgggcggccgcgggtgggtagaggtgcgcgcctgggacctggtgaggctgggggtgcgcggggccgggcgcagctgtggcagctgccggacggcggaggcgccaggaggaggaggagagggaggcgcgggcggctgggtcgagggcaccgaggctgcccgtgctcccggtctctggttgcacggctcactcccgaaggtgttgcttccagcttttgcctccttaggaggcagggagcgtcagtgtcgggagaccctgagaccggagtaccgagacgtagctggtgatgcccccgcctgccctcatgtgttctcaggttcttcttatttttattcatctctagaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagggtccgtctcgtgaacactttgccaaaccctcagtcctccctttcagtattcattaaatatgccccagcttcctgtctgctcttccacgcacctactctgagtggcacagaacaagtcaaccggtaccgtgcgtgttggttgttttctgcttttgttgggaggaatagtaggaagaactgaattttactggacttgtccattgtaattcagtgtcactgagtcctttccattattggagttcttctgtctttttggatcttgcagacattggttatttgggatgtatgttttagttccttttcaagataaactcccaagtaagtccgtttatccgtttcagttcccctttgtgtgggcttctttatatatgacttggactgttaatgtcatttcttcatgtctcttttaaactgaaataatgcagttttgttggtaagatttctgtgtcatctgtagttagccttttatttaaagttatgcaaaactatcatttctgcaagtttcttttaatctaagtagtacagttctgttggttagatttgtgtcgtgtataattagccctatggcttaaagttatgcaaaaaagtggttctatgattaaaggctgtttttaaaatgtatccatttgaagaagacaatgctagataatgaatatatattagtagtgattgaaactcttcccagcattttcatatttatcattaataatttattgttctaagttagaaactacataaagttattttcatttttatagacagcaagtttgaatcagataaattaaataatttgttcaaggtctcccagatggtgaattttatagccaggactggcacccatccggccaaggcaaataatttgatcagatatcgttatttcatctttctttctttctttctttctttcttttttttttttttttttttttggtcagagtctcgctctgttgcccaggctggagtgcagtggcgtgatctcggctcactgcaacctccggcttcctgagttcaagcaattctcctgcctcagtctcccgagtagctgggattacaggaatgcgccaccacagctggctaatttttttgtatttttagtagagatggggtttcaccatattggccaggctggtctcaaactcctgaccttgtgatcctcctgcttcggcctcccaaagtgctaggattacaggtatgagccaccgtgcccggccgagataccattattacttaatcatcttttattatcctgatgttcccaaagaggttaccagaaaacttagtccttaaatcaaaagtttcataaattttatgcaatttggatctcaactttttgtaaggtgtgttcaaactctaccttgattttagctctgaacttttgagtcaattgagagtctcataattaccatattcttcatcatttttcaaaaaaatcaaggctatggcttctatattaaagaaaaagtattatataaatgtatttatgtgcaatgcgaagtcaatatcctgggctgtgtgtaatagtaactttgtttttaaacagcattgccaaagagatggtgccagaattactctatattgctctataatccaaaattatagaggttgggtgtgtgagaaatcatatcttgaatcagcatacgtattcagccttctgaaatcatttttccctagggctagagtagagcaatttaaaaagatctaggaatactaattatattaattaaaaatatatagaacacaactagcttgagttattgttcagtcatcatttcaaccacaagatgatgaggatgttgttaattttaagtactaagtgatttggtaaggttttgtattttcaaacacaatgtgcttgtgacagttgggggctctctttcctaatatgaatcagcagttgtgatctatcctgcatgatatcaaaccacaatcacagtgaaagtcagcaggcttaattttgtttttaattttaccttgtatgcactcttgcggttaaaggcttgaggagttatcatgtaaaaataaaatctgacactagtggttaaatatttgtgttgaatatgttgttctgaataataactcggattaagaaaaatcccaaatctgccatttggctccaactggtagatgaaactgtatgccagtaactgggagtcagttgccaaagtgtcactgcacattagtgtgacaattgagagatggtgctcctttgttggtggtctttttcactagatattttccctaaccattctgccctctgatgtaagataagtttgcttagaaaacagaatttatgaccaggcccagtgactcatgcctgtaatcccagcaccttgggaggccgaggcgggaggatcacctgaggtcaggaatttgagaccagcctggccaacatggtgaaacgttgtctctactaaaaatacaaaaaattaaccagacatggtggtgtgcacctgtggttcccgctactagagaggctgagaccggagaatagcgtgaacccaggaggcagaggttgcagtgggccaagatcatgccactgcactccagcctgggtgacaagagtgaaactctatctcaaaataaaagaaaataaacagaatttattatacacgtgttatttatttatttatttatattacatgtattaacgtgggcagtcttacccagaagggaaagtaatattcctaagtaactaaatacatgtttagtttttgtaaaaacttaaatatatgtgctatgcctatgtaaatatatgcatatcacatattttctttgttgtaattgtggattatattctgcttgttttttcatttcatgttatttccttagatatttccatgaattgacaaagtcggtagatgtgaattcgttgctgtttagtattctatcctcttgattatgtgaattttcttagtcattcacctctttgagcatctgtatagtttttggttaactctgttataaacagggatactataaaaccattgatacatgtcatgataattaccttctattattattggtgatttttaaaaacgtttttattttgaaacttttaaaatccacacaaaagttaaacacatctatacccagcttcagccatagtagaccatatttcagttgagccttttgaaggaaatcccactgcctagtgacatagtaaagaaaatcttaggtgaaacaagagaagcaaaaaagtactgatgacttagttcagaaaaatcagaaaaggtacagtgttcatcagttcgttcgttcaatcctccgttcaattaaggaagcacctcccattttttgccccaacccctttgtctagaaggatgcctggcacataatcaataatctatatctatttatttaatggatcaaatatttgctgagcaaaaggcatgggaagcaaacaaacgtgtgtgtcattcattccctgccattaggtagctcattttcaaatacaaatgtatttactgtgaatttctcagggtagtctctccacacacaccccaaaattagtttaggaacattttattatttttttaaaaaatgaacccttgtgttgagggttgactatcaatagatagcaatgaaagaactgctctgctacatacaaaaccccaaagggccattttaaatgagatttcctaccatctattttaagaatcttgcattgactgggtgtggtggctcacgtctataatcccagcacttcaggagaccagcctaggcaacatgggagactccatttcttaaaaaaaaaaaaaaaaatttaattaaccaggcataatggtgcatgcctgtggtcccagctacttgggaaactgaggcaggagaatcacttgagcctgggagttcaaggctgcagtgggccatgatcgtgccaccgtactccagcctggcctacagagcaagaccctgtctcaaaaaaaaaaaaaaagtatcttgtcttgcctcctgctaagtctgatcatcattgtatctgaatacagtaggcgggataataacaccttccttactagtgataatactattagagattttttaaagccagccaaatttagtagtctctgttatcaagtactttccatgtagtaaatagtttaagacattatttcgatctcagcaactcaaagtaggccttatcctcatttacaaaacaggtaaaatgaggcacagagaggttaattaacttgctgaagataacatagctaagtattagaagattcaaactcagatctgcctatttcccaagcacctctctattctcttttaaaaagcagcttgacatttaagtctttaatccatcttgaattaatttttgtataaggtgtaaggaagggatccagtttcagctttctacatatggctagccagttttcccagcaccatttattgaatagggaatcctttccccattgcttgtttttctcaggtttgtcaaagatcagatagttgtagatatgcggcgttatttctgaggtctctgttctgttccattgatttatatctctgctttggtaccagtaccatgctgttttggttactgtagcctcgtagtatagtttgaagtcaggtagcatgatgcctccagctttgctcttttggcttaggactgacttggcaatgcgggctcttttttggttccatatgaactttaaagtagttttttccaattctgtgaagaaagtcattggtggcttgatggggatggcattgaatctataaattaccttgggcagtatggccattttcacgatattgattcttcctacccatgagcatggaattgttcttccatttgtttgtatcctcttttatttcattgagcagtggtttgtagttctccttgaagaggcccttcatgtcccttgtaagttggattcctaggtattttattctctttgaagcaattgtgaatgggagttcactcatgatttggctctctgtttgtctgttactggtgtaagacttaaacgttagacctaaaaccataaaaaccctagaagaaaacctaggcattaccattcaggacataggcacgggcaaggacttcatgtctaaaacaccaaaagcaatggcaacaaaagccaaaattgacaaatgggatctaattaaactaaagagcttctgcacagcaaaagaaactaccatcagagtgaacaggcaacctccaaaatgggagaaaattttcgcaacctactcatctgacaaagggctaatatccagaatctacaatgaactcaaacaaatttacaagaaaaaaacagacaaccccatcgagaagtgggtgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctggtataaagacacatgcacatgtatgtttattgcggcactattcacaatagcaaatacttggaaccaacccaaatgtccaacaacgatagactggattaagaaaatgtggcacatatacaccatagaatactatgcagccacaaagaatgatgagttcatgtcctttgtagggacatggatgaaattggaaatcatcattctcagtaaactatcgcaagaacaaaaaaccaaacaccacatattctcactcataggtgggaattgaacaatgagaacacattggacacaggaaggggaacatcacactctggggactgttgtggggttgggggagcggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataaataaataaaaataaaaagcagcttgacacagatggggatgattccatggaagttgaggtcattagtagagggttttaggaccatggtttgggcacatttgacctgaaggtatagctctaccaaggatctagagctgttcaattcagtagccattagccactaagcaattgaggagttgaaatatgactagaccaaactgaggtgtgctagaaagtgactttgaagacttaatacaaaaaaggaaaatatttcactaataatgttttatattgattacatgttgaaatgataatattttagatatgttaaataagaaatatttttttaaattaatttcaaggccaaaagcagtggctcacacctgtaatcccagcactttgggaggctgaggcaggtggatcgcccgagctcaggagtttgagacccgctggggcaacatggcaaaaccccatctctaccaaaaatacaaaaaattagctgcgcatggtggcatatgcctgtcatcccagctacttgggaggctgaggtgggaggattgcttgagcttgggaggtggaggttgcagtgaaccaagattgtaattgtgccactgcactctaacctgggtgatagggtgagacccccatctcaaaaataaataaatatataaataaaaattaatttcacctgtttctttttacattattgtaactagcagaagattaaaattatatatatgacttgcattatattttgatcggactgtgctgctatagagtgcaatttgttattattaattttttcctgcgtacaaaaggaattctagttcatttagaaaatttggatcatacaacaaagcaccaaaaagaaaattaaaatctcaccatccaaaggaaacatttagtagactgcaatcatactacacagttttgagcctttttacccccctgagtcaaatatcttattttgtttgtccatgcaaacatgttatctctaaaacttgatttttaatttctgttttgtgtcctgtcaatagatattttattgtttaacttatgccccactggtgaatatttagtttgtttctaaactttcgctgttatgatcaatgctgtagtgaacatccttgtagctaagacagcaaaaatctgagcacaggctttggaatcacctgcccaagttcaaattccggattctcagttttgtagctacgtgaccatgggtctttagaataattcctggcacatagtaagtgctatgtaaaagctgctattattattattattaatacatacccaaaaaggaaattactaagtctaaagctgttttaagtatttgatatatataccaaattgccttccaaaaagattgtgttgatttataatttcttgggaaatgcatattaagaaaaataaaacaactcttctaaaacttacactagtcataaatcaatactgtcattagtgctttgaaagatgattgtagtatgtatttctcattgttatgttgtaagtatgagggagaatttatttctcttgcccctttccctaagaactctcaccttcccatcattaacagacattcactgaattcctctactaggagtcctataccatttcagatgttcagaaatctccctaacattggttaagattcttgctcctaagaggaaagtactatgttcacatacacagatctctcatgatcacttgccctcaactggatagattttagccggtgatttaccctcagaaaacagcattgtatataaaattttggcacaacacttggtcatccgtcacactctgctcatttcccaaatatgctcgtaaaaccagtttgcttgagatcctgtataaaatgcctattgtgatgcaaatactgacatattgaggatgaatatgaagaaaaccactaaaatctaggaaattcagctataatatacatgtttgtgatttaaagttatatgggtttagtaagcctttcccctttaacataatacgcagagtacctttctgagacatttatcagctatcagccttattcttattcttgaaacattcagggtttcttaaagacattgccttttttttttttctatatggagtctcgctctgtcgcccatgctggagtgcagtgtcacaatgtcggctcactccgcctcctgggttcaagcaatgctcctgcctcaacctcctgagtagctagggttacaggcacccaccattgcgcctggctaatttttggtagagacagggttttaccatgttggccaggctggtctcgaactcctgacctcataatctgcccatctcagcctcccaaagtgctgggattacaggcgtgagccactgcgcccttcctatcacttatcttgtcatgcttacattattccccacaattttaggttttttttttttttttttttaagtagagacaggtgtctcactatgtagcccaggctggtctcgaactcctgagctcaagtgatcctcctgcctcagcctcccgtagctctaggattaaaggaatgagccactgtcccctccgcccacaattttctaatgtcctccatagggtaagatgagcttacaattatctgagcctaaaaccaaaatcttttttgtatacaaatacaaaatatttccccccaacagttttaatatatactgaacttttcagggatgccactatatgtaaattgaggggaaattatattttgttttgctcttaacgtgactgagagatatttcatattcagagaatcctgacaacagtgaacaaagagccaaaccaatctgcatttgtaatctatatgttcacggtgactctcaagtatagatacaagcatgtgatttctttgtcttctagtggagtacccaagttattgcatatggataccatatcttatgtaaattgcattctttttttatttctgctttatatagtttgaacactatattgatcttttgaaattatgtatgtaaatgtgttagaattgtatgccagcatgataaaatagaagttgcaaaatattggatatgaaagcaagaggcatcatctgatagagttaagaactattggtgtaaaagcacaaagagagctgttaaggacccacttgaagctcatgtggccagcatccaaaaggtgcttagtttctgttcttaatccctgaacgtgtgtatctgacggtaacactgtggttacagcagtatctacatttgagatgtgataactgccattagtcctgattcctcctttcagtttgtgtgtttagaacacccctttctctaagaatgcaaagtaagaaagtaagatgtaaaaaaaaaaacaaaagaaaaccttaaagtgaaattactcaaaacacacacacacacacacacacacacacacacacacacacacacacacacacactctatatcaaataccaacatgcatttgggttaagggaaggagactaagtcaaatttagtcaaatcttcctgtttggagctaggcttggtcctgtagtcccagctacttgggaggtttacacaggagaatcacttgaacccaggagtttgaggctgtactgcactatgatcgcacctgtgaacagccactgcactccagcctgggcaacacagcaagagtctgtctctttaaaacaaacaaacaacaaacaaaaaacacttctgtctagtgatttaaaacaattgacattcttcctagcaattaaatgtaatactgtatagtagtttgtgaagaggttagtaagtcctaatttgaatttgtgttaaaataaaagacacaaaatgcacattaaaaatgtttctcatctctgttttctgaggactgctgcatgtcacaggttttaaaaatacacattttctatctgtgacctttcacatacatacctttgtcaagctcaactggagggcttaatctccactgcatcaaaaaaaaaaaaaaaaaaatgctgccaacttcaaacaaattgccttggagctggcttcacagagttatcacgcacttacccggagttgaagataactaccttgacagtggggatacaaaggcagtaatgatagtgcctactaccccagtctttagtctatcacagaattcaggagaagccaattaagtaatccttctgtttgtttaaagaactttcaattagttgcttatccagtttttaaattattctgatgcaaatccgtgaaaactagaaccacacttaaaaatcacaactaaagtatcatgaattgacagttattcaaacacataactaagcctcctttcccacataatacacacgcacatatacaaatacaggcaggtgaaatttagcataacatcatgtttttagagcacgaataaatgttagagaccatttgatcattcattacgttaattgaaacttagttcaaaatgttgcttcctccaggaagcctttttctattccctgggcagagtcagaatctccttccacacctcttctcctcttgagcgtcttccagtaactctatgttcacatagaggccaaggaccaggctttgttcagctttgtatcctaggcactaagatgtgcttattacatgtaacagatactctcaaggacaaagattaagagttattatgtgcttattaaatgaaacatatgaatgcaaatatattgtatgtagtatattaaataatacataagtatataggatgtacatttttaaatatacttttatattgttacatatattatatgtaactttatacacttttatatagttacctatattgtatgtaagttcttcagtccctcaagaaaatgacattgttttcttatgaactttttgttaaaattagttttatattagtagtaaataatatgataacttagagaggtagaattgggggaccacaattatgccccagttcaagataagtcactggcatgtaggagaaagcctcagagaagttacggactttcaggcagtaaaggacacagttgaattattcactggctagcctaaaatgggtctacccccaccccttgccttcagccccctaaaacactgaccaaacatgtaataagaaaagagtaattataggaggttcaccaccatcacactcacccctgccttcattaagaagtgtttaggctggttgcggtggttcacacctgtaactccagcactttgggaggctgaggcgggtggatcacttgaggccaggagtgcaagaccagcctggccaacatggtgaaaccccatctctactaaaattacaaaaattagccgggcatcgtggcaggtgcctgtaattccagctacctgggaggctgaggcaggagaatcgcttgaacccgggaggtggaggttgcagtgagctgagagccgagatcacaccactgcactacagcctgggtgacagagcaagactctgtctcaaaaaaaaaaaaaaagtgtttaaataaatgcctctggctttatttgaacagtccaggaataattcaagggtctgtcacagaattttgacaaagaaaaaaggtgggagggatcatgtgaagaaggccttttttcccccaagagttaagcaggggccaggcacagtggctcaggcctgtaatcccagcactttggaaggccaaggcaggccgattgcttaaggccaggagtttgagaacagcctggccaacgtggcaaaaccccgtgtgtactaaaaaaatgcaaaaaaaaaaaaaattagccaggcatggtggtgcacacctgtaatcccagctactctggagtctgaggcgggagaatcacttgaacccaggaggtggaggttacagtgagccgagactgtgccactgtactccagcctggcccacagtgagtctctgtctaaaaaaaaaaaagaaaaagaaaaagaaaaagaaaaaaaaagcttaagcagagatatgaaacccttccattttaagtgtcttttcccccctctatactcagaaatgttgtacttattttaggtgaaggcagatgatatgtctaactattcttgctgtgagtggtccagaagggcacagttttggaaatacacagatgaactgttgaaggtagtttcaccttaatttttagtccttgttaaatatttattcccttgtccattgttggtgactcagttgagcccactcgttaaaatccttttcacggggatagtcactcttatgaaaacatagacacctagagacatgtgggaagcgtagggtcatttaacatgtggcgattctacagcagttttcccattgtttaactggagagatttatttacagcttgtgttaggctgttcttgggttgctagaaagaaatactgggtaatttataaagaaaagaggtttaattggctaagcgttctgcaggctgcacaagcgtggccccagcatctgctcagtttctagggaggcatcaggaggcttttactcatggcagaaggtgaagcaggaccaggcacgtcacatggtgaaagcagaaacaagagaaagagggggtgggaggtgccacacgcttttaaacaaccagatctcgtgagaactcactcattattgtgaggacaacaccaagccatgagagatccactcccatgacccaaacgtctcccaccaggctccacctctaacatgggggatgacatttcagcatgaaatttgggggaacaaatatctaaactattcacaccttactaataatactaaatgtgcacagttaaatttcagataaagattgttcaattggggcagacacgtaattttttccattgctctttgggactcagatgaataatcttagtgtggtagagataagcctagctggtttgtcatgtgttactgtcagttcctttcaatttatgaagaaacagaaagataaattgggaaatgtcacattctagccttgacgaactttttagttggacttggccatctttcgagttgtaagaacatgtacttctaagggtacaaaatgtgtttccaaactctatggcatacagttctagcataacaccatgtcagtcaattgcagaaacttccaaacattttttacactgagagctctttggtcaaataattcttgcttggaagtaaatcccagtctgtgtgtgccaggcactgtgttaggctagagacagagtcatgagcaaatagcatctctgctctgatgtttcttacatgtgctagtgagggaggcaaacaaaaaacaaggcgagttcagattttgatcattgctatgaagcaaatacatagtttagtataatggagagtgacagttactgtggaacataggttccatgaaagcatggagcctatcctacttgtcactgtattttcagtgcctaaaacatagcagttactgtttgagagaatgttgtatggaaagaatgacaggaggcctgcctgaaaagatggtaggttaaagtggagatctgaaaggtgacagtcagctagatcttatagcctgattacaaagtgcacaaagtgcaagtgatgtgcaaaggcctcgaggtggaaagagtagaacagaagtgagaccagggtggctggagcccagtgagcaaggggaaagtggtctttgagcaagttggaaggtacacaggggacagagcatagagtgccttctaagccaattctaaagtggagagtttgaattctgttctgagaataatgggaaaccattgaagggttttaagaagagagtgatgcaatctgatgtgggttttagaaagataactttagctgctgaatacagaaaatggccagaatagaagcagggagactaatccagttacagtagtcctggcaaatgttgatgatggtgatttggagtaagatgctctgttaggaatggaggcaagtgaaaggattggaaatctgttttggaaataaaaccaagagtacttgctaatgggttgggttgggttgggttggattggattggattggattggattggattggattggattagattggattggattggaggaggaaggcgtgtgagcagaagaggaaaatcaaggatgatgcttaggttttgtgctcgactgagtgtatgaagtgttcttatgttagatggacaaaactggaagaggacagatttgggatgaaatcaagggctctgattcagacattttctttagaaattgtgaactcctcaggaggtatccagtggagacggttgggtatataagtggagctcaagagagaagtttggctgcagaaagaaagttgggagtcatcaacatagaaatggtattgaaacctgcaggactaataaaataatctagcaagagagtagagataaagaaaagaaggccagaatcgagctatagcaccgtcacacagttagtctgatagagtagaggagccaagaatggagatgggaaaaaatcagtaatgaggtagaaggaaaattaagagtgatgtcacagatgtcaaaaaggggagtggctcaagaaggcagttgttttggggagtaccatgaccacctactagtgatttgctggaaggactcactcacgactcaatatagaatcatattcaaggctaagatttattacagcaaagggtatggtgcaggaacagcaggatacagatatatggtggcaaaactagagaagtcgtagtaggctttcttgtcctctctctgtagggattccacatgtttctcaggaatgcatgtttctctccagctgtaaactgcagagacatatgcaaaacgcctccacccaggaaagcccactcaagtcttaggggttcagagctggtcaagggagctggtcgtgtagctatgtaaccagccaggatgcagaccccaaactaggtactaggatgcatcaggaatcttcatgtcaactttaaacaatgatactgtcttgatatattttgaccactgccttgagggcacaaaaataacataactaattagtaagcatttcagggagtttagtgctcaggatttgggtcagggtcattgctgtgactgcaggtgttcccaaagacaagcaagaactgagtaaaacatactggctatgttaactctttcctctagaggtcatggttaatgttgaatgcaggtgaaagtcaaaactgagagccataaagttaatttctatatcccaaagtatagttagtgaaattatatttctctccagatagattcattccacttatttagtaaacatttattgaatgcctaatatagttcatggcatgtgctagcatgagactataggggtaaataagttagacatggcacctgccctgaaggagttgacaaaccaataaacgcagatgtcattagctgtgtgcgagaatatgacagaggtctcacggctgagacctgaaggataagagatcagccaggtgaaaagggaaaggcgaggcaataaatagcacgttcaaaggcctggaggtgaaggagcatattgactttgaggagcaaaagaagttcagtgtggctggaggggagaaaggagaaggtgagtgtggggtagattatggaggaccttatacaggctgttaaacacgttttgcttcatccacggggagatataatcctaagggtttttgcttgataggaaaatgacagatttgttttcttgattgaaaaatttctgataattttacagttagttttgcattgcaacagagattctctctctctctctctttttttttttttttttttgagacaagagtctcgctctgtcacccaggctggagtgcaatggtgcgatcccagctcactgcaacctccgcttcctgagttcaagcgattctcctgcctcagcccccgagtagctgggattacaggggtgtgccaccatgcccagctaatttttgtatttatagtagagatggggtttcaccatgttgtccaggttggtctcgaactcctgaccttgtgatctgcctgcctcagcctcccaaagtgctgggattacaggcatgcaccaccgtgcccagcccagagattctctttaagaaatttggtgcaacagtcatttctgggacaaaaagtagtgagaaaatacaaacacaccagggtaaataaaccagagcgccacaaaatgtaatattaagtgtgtaaaaataataatccctgagagctatcagtgtgaaaagtttttatttgaatgccgtaattgaatggaattgttcatttaaaccttcaagtgaatttatttttatgtctaaaacttattagaaatgtttcaatggtgattatatgtagtttcttttttgccttcaacagagcacagatcacacagaaaggaatgattttttttttaatcagcaattttggagacaaattctatgaatgccaacctatacagaaactgacaagcattaattattcagaatgtaaagagaaatgccagagtattaaggaacagatacctagatttaaacataattttggaatattataattattatgaattacaaccacttatatttgaggcagtatgtaacagctgtgtgcgtgagcaggaacatgagagggaacgtaacctggtctcattttctagacaagccattcaagaggagcaaagagagtgggaaaatgaaagcaatgccactactgattattgaacatctttatctgccatgcactgtgctaggccctttacacattttccttctttaagctatttaaaaactgcgataagttccttacattcccattttataggcaagagcaaatagattttacagatgaagaaattgatgtcccaaaatgatatcttggtaggtgatagattcggttcggtaacccaaatgtgtcttttagcgatttatgtattcattcaacaaatattcattgagttcctactgtctaccagaacttttgtaaggggatgcaaagaagaacagacccaggtctttccctttatgaactagggcagtgggccttacacccaactgccgtaatgggaaaagcattgtaatggggctttgttcgttacagtcaacagtgcagtgtagggatgctttgtaagctggcctacagggtgattggtaaagttgagaaaggcttatcagggaggctgacatttgaacaaaggtttggatattaccaggcagagagatggaggtggtaggaattccaggtaaagcgactgggaaaacacatgctgtgcttgggtggcaggagcagtccagggaggacatggtgggactgtgctgcaagaagccttgtatgccaaggagatgagacttcccttgtacatacagccaaggataagaatttgatgacgatttctaatgtatcttagcatctaagttcccttaatttgtgctcactggaaaccacagagttttagaaggcttttgtcattgtggtttaaaagaaaaaaatagattgttcaaagaacagtgatacatagggaaaatattttgactcaggaacgtaatttctcactaaaattggcaatatttgtagccccatgggaactatgtttccataggacattctgttcgctgtccttgggaagctatctaaaaaaagaagaaaaaaacacaataaaaagaggtatttggggatcagtaataaaagttgtatactttattgaatgtgttactgtgtactagctacttatccatattattttaaatcctgacacctattaaataataggtagtattatccctgttttacagataggaaactgaggctcagaaaaaagtgacttgcctgagactacttagctagtaaggagcagagctgggaattcaaacccaggtctgtcaggattcaaaaccccagttcttccagtctctagagcctggtctctagagcctggagacttctgtggaggtgacctaggccacttcaataggtgaggagacagaggaccgcttggggatgcattccttaaatcagagcagctgattctatgaatgccaacctaatacagaaactgacaaacattaattgttcagaatgtaaagaaaactgccagagtatgaaggaacagacatctagatttaaacataattttggaatattgtaattattattaattacaaccacttacatttgaggtagtgtgtaacagctgtgtgcatgagcaggaacttgagagggaacgtatcctggtctcattttctaggcaagccattcaagagcagcaaagagaatgggaaaatgaaagcaatgccactgccgattattgaacacctttatgtgccatgcactgtgctaggctctttacacattttcctcttttaaattatataaaaactctgtgataagtttttttaagtatacagacttttgtgctaaattggaaaacccgtactggaacctgggggtgggggcggggcagaggtcttctaatgactggccttgtgctctttaagctgcactagctatcccactttgaaaagaatgtgtgaaacacagttgcagtcatgcatactccatctccaaagaatggattcattcttcaggccatagtatactgactataattttctgtttgtaattacccagattccaagcctgtttatagcatttatacctgaggaatggaatagtgaggatttgaagaggccgcagtccttgaggttttctttgataataatatctgtgtagctgcatcaaacacaaatttgatattctgtgtatctgtagcacaggtcatgtgactgtaaattcttttgatatcttgttgcatactgaggtcaaggaactggctcttgatgtaattccccgcatcctcatgggagttgttaccatcatactctggaaaacaaatgctgagatggattaactttttacactgggtttccgcatgggattttataggaataaaggttccactaccagcagtgagtagcctgaagtctgccacattgaccaggaacctttgcaagaataaaccgaggatgtgccctctgcaggtgaatgtgctaggctctctggggttgccaaggagtttgagtccccatccttgagtccccatcaactacatctagttgatgtacacgtgatcctttgcaaaggttctgagccctctaaaactgatcaaaattgcatctgttagaaaatattaaatatattctatatatcaagccaaatactaggagcttgtgtaagcaacagagtatcttggtggatcacgtgggtgttgggttaggcaaaagatcccactgttggccctccccacacccacatccttactatgctctgggcagacagagttactccaactatctcaaaatgcccagaaacccttaaccacctctactgatttgcctgtattcaggagcctccttcttcacagctgagattcagacttcattgagggacaaggtgaatgagagggtaggggacagtagggggcagaatctggtcatcaggaactttggactttccagtgagcacagactgagatacctcaggtgctaagactgcagcacccctggaggaagactgtacactagacaacaacaaggctggttggcaggacagcatctacccagcatccttaacatccgggaggagatgatggtgccgtgtagggacacttgaccctgcccatagcagcctcagcccctgtgcatcctgggagtgaagtgatcaggtcatgcaagtaactacatcagtcctcaccactgggatcattgctacagaggggaaggcttttccctgtgtgttggagatggagatagaagtgtattaatggaggaaaacaaaataagcttttacatctgctaaattaacagaatcccaggctgccaaaaccctgaggcttgctcaatcagcagtccaaactgtatttcctctaagggacaaattatgagctgctgtaaaggtacacacagtctagtgagaaaccattcaattttgagggggaaactctagggaaatagagtaagttaaaggagtagagtgtgccagtatgagaaggcaactctcctggagtttgagttccaaaactcagtgggctcataggtcatggtgtgatcttagaagtcataagtgaccaacaaggagtttaataacgccttttcttatactccctctttttacatagcctttataccaagttatcatctggcagtcattttagatataggtttctaagttagacggtagggtccaaatgaagtgtttggcaaagtcatcttaattttttaaaacttgatatgaaaaagatggtggtatcaggtattgaaattgaggagctatcagaatagggaaaaattccccatttatgcccatactcacaaatacacaaatatttataaacaataatgatacaggcaggcatggtggctcacacctgtaatcccaccactttgggaggccaaggcaggcagatcacctgaggtcaggagttcgaccagcctggccaaaatggtgaagccccgtctctactaaaaatacaaaattagccgagtgtgttggcgcatgcctgtaatcccagctacttgggaggctgaggcaggagaattgcttgaacccaggaggtagaggttgcagtgagctgagatcgtggtattgcactccagcctaggcaacaagcgcgaaactctgtctcaaaataataataataataatacaacttatttttttccctttggggggctttccagcaaaaaccagaaagcctattagacaaattttaaaagagctgtaacactataataagactgtttaataatggttgagaacacagagcccgaagaacacagattgcctgggttcaaatcctggttctgctgttcagtggctgtgatcttgaactactgtcttaccctatctgtgcctagttcctattttgtaaaatagaaataatagttctacctcgtaggttgtcgagagggctaaataagttaataaacataaagtgctcagaatatgattggcacataagtgctatggaagtatatgctactcttactgcagttacataaattgtgatatttggcagccttgaagcgtggccctgccatatgctttgtgtttaaaaccctcaaactactgtttattgagggcatctttgatgtcaggcacagggctaggcaatgttcctgctgtatctcaatgaatctacacaacaccctatgaggtaaataccaatttacagctttagatactgacttgccagtggttaagtaacttgcccaaggccacaaagcaagtacctggtagattcaggactgaagcttcaagtctagagagcttggctccagccgcagctgcagtttgggctgaccttgttcctgccagcacactttgggacctgggccatacaagttatagcatcctggacagaccctctattttatagaaaaggaacctgaggccctaggattaaatgaattgccagaggtcactctccaaagagactctgaggtccagattaggaaacctgaactaacattgaagccgtgtctttctgtataagatccaactgcttgtggtatgtttggccaaaaagactcaggttaaagtcagataccaaataatatattgacatctagcatatttatgcccagatgccgtatagcaaatcatccttcactttaattagcttatagttatatactcgacaatgtgaatgaacagagaaaaacaaggtatttttttttcatcttctaaatttgcttgggaaattcctccgtgtcttttacaggtttaaaaatcatgtttaacgataatgtagttatcttaggaaaaagaccaacccatttttatcactctttatcattgggccatcacagatgagagctttctatcttatagaatcatttgcacaaagtatatatgaggatatacagcattgtatttgtagcatttcttataatagtaaaaaaatgaaatgatacagtcatctagttaatgccactgagttgtacacttagaatggttaaataacaaattttgttatatgtgttttgccatattttaaaaaaataatagtttaagaaactagtgacttgtatacttaaactgagtggattgtatagtatgcaaattatgtctcaataaagatattttttaaaacccatacatttatccatagagaattggtcagattatgccaaacccagtcaatggagtattttacaacctttattaaagaattaggtagatttatatgttttgacatgggaggatgtccagaatatattgtgaagtaaaaaaaaagttgatgtgcatttccatatgctgtatacacacgtctacagttttgtcttatgagtaacactcttgtaaatgtcattatgcaacttggctttttcacttatgtgtgttatgttagaggttagtacatatagagatacctcatttttttaactgtttcaaactattctgtggtataatcttatcttagtttatttagtcatttccatattgatgagtctttaggtcatttataacttttagatatttcgaagaatgctgcaataaatactgttaaacaagcacattagctccataatttcccaagataggcactactaaatcaaaaagtacatgcatttttttcctcaagtttctttctttcattgatgatgctcttcttcctcctcttcttcctcttcttcttcttcttcattattattattattattatacttttaagttctgggttacatgtgcagaatgtgcaggtttgttacataggtatacatgtgccatggtggtttgctgcacccatcaacccgtcacctacattaggtatttctcctaatgttatccctcccgtagcccccccaccccccaacaggccccagtgtgtgatgtttccctccctgtgtccatgtgttctcgttgttcaactcctacttatgagtgagaacatgcagtgtttgattttctgatattctgatagtttgctgagaatgatggtttccagcttcatccatgtccctgcaaaggacatgaactcatcctttttatggctgaatagtattccatggtgtatatgtgccacattttcttaatccagtctatcattgatggacatttgggttggttccaagtctttgctattgtgaatagtgctgcaataaacatatgtgtgcataaaaggtatatgcatttttgtgcttgatggatactgacagattaacctacaagaggatgtattatttacactcccagccccacgtgagtatgtgtatttccccacatcctaaccaacactaatttttttccattctaatgggtgaaaaaaaaaatctccattttaagttgcattttcactgagcatggtggtacacacctacagttccagagacttaggaggtcaagatgggaggattgtttgaggccagggccaggagttcaagactagcctgggcaacatagcaagatcccatctctaacgaaaatttttttaaaaactagccaggcatgatggtgcattcctgtcattccagctacccaggacaccgaggctggatgattgcttgaacccagggccatggtcccaccactgaactatagcctgggtgacagagcgagaacctatctctacttaataattagtagcatttacatgattgaaaatcagaatgaacatgttttcacattaattcaacattagataaacattgaggtactgccccagatgaacaaacacaaacccctgcccctgtggaacttctgttaaactctattggtcatttctatttcctcatgccatttgcctgtttttctatttattcatgctttgttatgtgtgtggcaaatattttcacctcttctgtggcttgtcttttgagctccattttcagtatctttggccttacagaagtttttaatttttatgagatcgtattcgtcagtccttttctttatgcttttatgttccatgcctcacttaaaaaggccctctttcccccaaggtcataaatatattctatacccttttcaatatttttatggttttagtttttatgtttagcacctaactccatctggaatctatttttgggaatcgagtggtatgtagatagatttcatgtctgacaatatatatttttgagcactcaaatttttaaaaagtatgtatgactttggtaagcagaaagagccaagaggagtttgaagagacactcagaaagtggatgtccattctgggtgggcccaggagtttgcaattttagcagatacctccagagaaaagagaaagtgatgagaaaaaaaaaaaaaaagctgtgtcctgtggagtagattcaggtcataatggctgtaggtagagacacagcagaaagagtagccccgggttggccttgtatcctggtacctacagcaccttaggaaatacataaaatacatgaaatgtcacagctttgcaagaactagaagaccagccagaatgaatcagagaagggattcttcagtgtttctacttgtaatggaatttttaatccctcatctggtacaaaaatgagtttgagataatagtccatttaaaaataacccaagccggtgtggtggcttacgcctgtattcccagtactttgggaggccgaggcaggggaatcacctgtcaggagttcatgaccagcctggccaacatggtgaaacctcgtctctactaaaaatacaaaaattagtcaggtgtggtggcgggagcctgtaatcccagctacttgggaagctgaagcaggagaatcacttaaatccgggaggcggagattgcaatgagcccagatcgtaccactgcactccagcttgggcaacagagtgagactccatctcaaaaataaataaataaataaataaataaccaacccagccctggattaatgatgaattttcattctggctagcaaaggttagcaaaagtggatgactacatgtaggcatgttaattaacactttttagattctggaaaaagaatgttgtgtggcagaaatatgggtacaaatgtgcaagccttctgtagatgattctttaaaggcaggtggagtgggagccgctgggctaacctaccccaaatcactgcacttcctttcttcccttgtcattaaaaccatatgacccctttagtgtctgtgttgcactcatgagttcagaagttccaatgcatctatcaaacacatgtgtttgcctactgtgcatgttgttctaagtgctccttcactgcttctgacaaccctatgaggtactattataagcctccttttacacatgaggaaactgaggctccagagagttaaataagttgcccatagtcccacaggcagtggtggcattgggatttggactcaagttgtctagctccaggttcgcagaatcaccctaataatgtgccctccaaattggctatttcagcaactgcagtgttcaggaaagaattatactctgatgagccttcatgaggcagggttgaaaaacctgtgtcaggaaaagatatgacaccttactggttatcagaccatgctagaaggagcctctttaaaatcgaacaacagagccactgctctggtgcaagcagcactctcacccagccctctgacctcagtcacagtgtgagctctatagttcctggcaaactttagccatggggtcaaaaatggagaagcgtgccttcaggtataagatgtgatgtgttcatgcagggattagctctgtttaggcttaattctggaagccagggttcttaatttggttcccattccctgacggaatactatgcagtcctgataatgaatgatttacatttatacaacagtatgcatggatgcaccacaggggacagtgcctggaaataggcacaagggtgctttgaggctgctgtctacacaaatgtgtgtttagtttatgaaaatccacagtggcgcctgtaatcccagcactttgggaggctgaggcgggcggatcatttgaagtcaggagttcaagaccagcttggtgaaaacccgtctctactaaaaatacaaaacaattagccaggtgtgatggcggatacctgtaatcccaggtactcgggaggctgaggcatgagaatcacttgaacccaggaggcagaggctgcggtgaaccaagatcgtgccactacactccagcctgggtgacagagtgagactttgtctctcaaaaaaaaaacaaaatctacagtgagctcttcagcatatagctttctctgcatattgtattccatgtattcattgtactggattcaatgtacagtattctatgtatattgttatttcactgaagagttttttcttaatggcgtgaattagagtcagctgaggtatttgtgaaaaatgcagactcctgaactcacgcctcaagattcctgttctggatggggcccaggagtttgcagttttttacaaatacctcaggtaattctgctgcaggtcatctgaagatatacctgtaagaacatagcaaagctgcagacctggtctgctgttgatgtgcttaatactgggcatcaataggactctataagtagagcaaaagaatgacttgagaatgactaggctcacacattgggatggtaggaaaacagcctggtgcactgcaagggtaacaccatcttgaagcgaaaccaccacgatgaccgatgcttgagtcctgcatgccaaggtgttcttgcagcaaggccaagaaacaatgcctgtagcacagataacccctcataaacatgcttatctgacttccccagtggtcaccagtgttccccaggaggatctgagacatgaccagctgtctttactctaaacacttgctatataaaggatcatttctggtgggtggacacagggactcactttctggagcagcccaagacatcgcttctatttgtaagtccctattaaatattttttctgaagaactggatttatcagcctctttcttaagcctcttagttccctctgcctttgtgggtaggtttgcgtagacctactcaccaagaaacaaggctatatcttacatgtatccatgattttttttaatgcacaaaaatgtaaaaagactatataaaatacctacaacaagatttctgttggccaggtacagtggctcatgcttggaatcctagcattttgggagggtgaggcgagtggatcacttgagcccaggagttcaagaccagcctgggcaacatagcaagaccctgtctttacaaaaagtacaaaaattagctgggtatggtggtatgtgcctgcagtcccagctactcaggaggctgatgtgggaggattctttgagcccaggaggtggaggcagtggtgagctgagatcacaccactgcactatagtctgggtgacagagtgagaccctgtttaaaaaaagagagagagagagaaaaaaaaagatttctctgaatccttctcatgcgtatcatgagagatgttttaaaatgtttctatattttggccgggtatggtagttcacgcctgtaatcctagcaccttgggaggctgaggcgggtggatcacctgaggtcaggagttcaagaccagcctggccaacatggtgaaacccccatctctactaaaaatgcaaacattagccaggcgtggtggtgcatgcatgtaattccagctactcgggaggctgaggcaggagaattgcttgaatccgggaggtggaggttgcagtgagccgagatcacaccattgcactccagcgtgagcgacaagaatgaaactccatccccccaaaaaaaccacttttctgtattttaatgcacagtttaaaaatgccagacctggctctattctacttaggtttctgttcattagataggagtcattcatgtatgactgaatcactatgaggatcctcctctctctcttcttccccttccacccacatgccaggctgtggttcagactgccttctgctttctcacgggtctctgttgtgtgatcttgtgcccacctctctgtgtgttaaatggagagagtggcttgaacagtaccctcatggttggtcttcaagagctcatctaattctgaatggtagttgggcatgtctgaaggtattagcaattctgttgctcagcattgctgatgtattgagcaatgtgaaaaccttggcgaatcttgttgccatcttcccctaagaatctgcctcatcctgaagcccaaccatttgactctgtggtaaaatgaagtaacttcagtaaggtccatgtctaccaatttcttaatctcatttgaggtaaatagatgcacattatcagaaaggactggccactatgtactgcaaatgatgggcacagagttgtgattgtcccagcagacttgagatgagctagggatacatcagtccattatgagacggtatctgttatagtcaagagtgtctctggaatggcttcttgtaattatttggactttctaccaaggtttctgtgccatagcctatggaaaagtagattcctttcaagagacctgacttgccaagcatggtggttcacacctgtaatcccagtgctttcaggggccaaggcggtgggatcacttgaaaccaggagtttaggaccagcctgggcaacaaagtgagacccccatctctacaaaacattagccaggtatagtggcgcatgcctgtggtcccagctacatgggagggcaaggcgggaggatcacctgagcccaggagttccaggctgcagtgagccacgttcacaccactgcattccagcctgggcaacagagcaagacccagtcaaaagaaagaaagaaagaaagaaagaatgagagaaagggagggagggaagaagggagggagggacggagggacggacggcgggacggacagagggaaggagagacagagggagggaggcctgacttgtatatttatgtgcacgaaatccgttctaggcctctgaatatggcacctggcccactctttcttgagaacagtttgccagtgagcaatgtgcctcatgtcctttgtgaaactggcagagcataaattattaatttaaaatacacaaactaagatcaagataagatgtgctttaatgaacgggtaaactcaaatggcttattaacaccttcatttcctcatgctgcttctgaaatgggcatttctcaacttacattttaaggtaggagctgatctgagatgcaagttaattatacagtttgtcgaagccaaagagttgggtttgggagattttctgacctgaaaatgttcagtggcggtgcccatgtaatcttgggcctactctgacagacagttcagagccttaacattcagtgttggtcctttggatatattgaacataagctacagtttacgggtatgagaggacattattgactgagacttcaatagttccaaagggggaaaaaaagagaaagatggcttttttaaagctactgtcttcagctcaggaaaaaacatgtgatcagccgactgtaaatgcacagcttgagaaatttagcaattcccaaaataggttcaagtttctttgtgagcatgtaggcctacttgcaggtaacattgactttgttaacaacgtttgttaacaataacattgtaggcagttaatgtctcagagctcttatagatacaaaagaaaataaacttacaacttccagaaagcatcttctcattgatgagtctaaataatgctcatctattggagaagcaacttgttaatagtgactttttgtcacttttgtagagtggggagagggacatgggagatgaagctcttactttatttgggaagtgagatgtctcaagttctttattctaaaaaaggtaaacatcagttgcctctgaggtagtaatagaagaaggtctgttttactttggaggaacattaaccttagagtaaaacaaacgaaaacacagttcaaagcccaggctgtctgagcccatctcgtcatttgtaaaatgaggataataatacctgccttacttatctcatggtgtttctgttgaggattaaatgataaagcactttggaaattatgtaaaatatctgtattttaagcaggtatgatttcccgaaatccttgagtttttcctctgattccatgattatgacatcacttaaatatgccacccctctgctatcctaataccccaaatctcagtgaaacactggaaaagtccgaaaccaatagagatttctaaagcagatccccttattatgcccctcaattagtgatcattgttagtgggtctgctcagagcatcattgccaagtgctttgataagctgaagaaatctgttgataatttcttgaggcatggtatttcagtgtgtggaatacttgggtactagttcttgggagttttttaaagtaaaatacttatatttgtgttgactttgcaacagcaggtacagcaaatttcacatggtaccttgctacagaaattaattagtaccactcatggtttaaattatgtagaatgatagtatgctcatattcttcttggctgtcttaaaaatgaatagaaacaaaaaggtaaacaaagctcatatttacctctccttggaaagaggttgagtgattgtcatgtagcttctcatttatcaagtatgtgttatgatttcgttaaaggataaattgaaaggattcttaaagcaacaaaggtttggtcctgcattgatgcatattaagtaaagtagagctcctcagttggcattcccaggctgggtgacacagaggtgcctctttctgatactctccttcccagctcctgtgccatcccctcccctctccccttctctctcctctctccccttcttctcctgtaatacttctgctacttgctctgttctacccagagactgaaggaagtgagtggtgatctaattgagactgaataagtccgaacatttattttccttccccttcactccatccaaagtccaatcctgaggaagacatggaggttatgattaaacttgcccaacactcaaactttactgactgcttattcttatgttaatcacttggcctttgctagattaatgactgagtgaccagaagtctcaatgatcccataaatcgtatgattttaaactatttgtgtagcttttgctagttgtaataaaaattttcacatgattttttttccaaatagagaggtttaataaagctaatgtgcttgaccaggttttggagagtttacatactaatttcttaacccctttctaatatggttagtatagctctgtgttttcatcagagagaagcagactgtgaattcctcaccttggggcttccattctccctccaggtggcctcacctttcaggtgaacaacctgacctctctggctcctaaatcccacccttacaagccgcaggagccggtgcatgggggcatagtttcttacctttacctttttcaaacctttccctcctcaccagcttttttttaagactttattttcttagagcagttttagagcaaatttgctgtacctactgtggcaaagtcaatacaaatataaatatttacttaaaacccaagaaccagtacccaaaagcaaaattatctaaagcaaaattgagaggaaggtacagagatttcccacataccccttgtccctatccccacacgcgcatagcctctcccatgatcaatatcccccaccagagtggtacatttgttacaactaataaacctacactgaagtaggggtttggacaaatgtataatgacattgtagtatcatacagaggagtttcactgccctaaataccctatgtgccatcttttcatccttccctcctcactagcctttggcaaccactgatctttttattgtctccataatttcgcctgtttcaaaatgtcatatgcttggactcatatagtatagccttttcagattggcttcttttacttagtaatatgcatttaagtttcctccatgtatcttcatggcttgatagatcatttcttttcaacactgactcgtattccattgtctgagtgtaccacaggttatttatcccctcacctactgaaggacctcttggttcctttcaagttttggcaatgataaataaaaatgtaaatagctgtataatttttatatggacgtaagttttcagtttattttgttaaataacaaggagcttgtttgctggatcatatggcaagagtaggtttagttttgtaagacacttgcaaactgctttccaaattggccattttgcattcccaccagcaatgaatgagagttcctgttgctccacatcctcgccagtatttggtgttgtcagtgttctgaatttttgccattctaataggaatgcattgatatctcattgttgttttaatttgcctttccctgatgacatatgatgtgacatatgatgacatcttttcatatgcttatttgccctctgtttatcttctttggtgaaatgcctgctgtttccatcttttgtccattttttaattgagttgtttattttcttattgttgggttttcagaattctttctgtattttggataactctttcatcagacatgtcttttgcaaacattttctccaagtctgtggcttaccttttcattctcttgatccctccagctttttatttagaaaattttcagtcctatagaaaaaaatacaaaaatagtaaaataagcactcacacattattcatatacatccaccagttgttaatattttgccacatttgctttatctctctcatgagctccatctgttgattttactgaaccattagaagtgataaatggcatgtcacatcatcccaaaaaacaccaatatgcatctcctaagcatgacttcttactgcctaatcatgacacatcattattaaactaaaaataataactcagtaatatccaacaacatactgcatttttaaagttctccagtagttcccagaatcaaatcaagcaaggctcacccatcgtctacagtctcacaatctaggacagttcccctgcctttttttggcattgaccgattcatattgaaccaattttatgtcattggttgattcctaatgaaccatttccttgtctacaagctcttggcttgccctcttacagtgatgagttggagtctctccatgacagcaccagactggaaattcttaacatgctttccaggctcattaacattgagatagtcaaaatctacacgatgtcctcaataattttgagaacaggccatgaaagaaaatgttgtgaaaaatgtgtttatggttaatgattcaacacagttaacagaggtgacttggctttctgccctgccctcatggcaacatgcggcttcccagttcagcactgtcctctgctgttagggcctgggaattctgaatgagattcagtccttggagttgaaaaagtaatttacctgatgcttggtggtgtgaatgtttgtgacagtttttgtgctaatacattttgaaggacatgttctctcaaaatagccccttccactttctgaatccacactccagttttctttttaacttcagtgagtggtagtctatttgacctgatgtgcagatcttctggcacatacatttctgctgtctcttggcataacaaattggcagtctatccctatgttatgtacactgtttatattgaaaatttgtctttaattggtctgatactacatcatctgctagggccagtagtttgtcatcagccaatttgtacacctgaggccctcaaacaaacacgtgcttacaatgtttctggcactatttttaaagcttgtaagaattaaatgagatagcacaacaaccccatgagggtaagtaccgttaatcccataatatggatgaggaaactgattcatttagagggattaagcaatttgcccaataccacatggctagtaagtgacagagctgggttttagctctgacactttgattctggaacctgcacatttcatcattatgtcagatgccctgaagaggatactgtatatcatctcatctcacatgctgtgttcaggcaggtgacgtgctgctcaatgctggttttgatgtctttactaaactactgatctatttttgagatttaaatctcaaaacagtgatactagtgagaagtagtccacctttgttaatccaccaaatgttccggttagggaacctaattttggtaacttcaaggcctctcctgctattgggagctaagcatccttcactctggactctcacttgcttcactttagaatgagagctttttagggtaaaactcaggaagtaggatgactgaaagaaaagcctttcttctccacagtagcttatggggaaactagtaaattaattgccattattccttgccactaaaggatgagttcttatggtagcaataaatagacaatagggctgtgcagacctccaacaaactgtcttttctggggtcaaaaggggtctgaattaacctcttcttaaattacagctctgtgacacctgcaggcactcataacaaataagaacaccaggccaggcacagtggctcatgcccgtaatcctaacatcttgggaggctgaggtgggtggattgcttgagctcaggatttcaagaccagcctagacagcatggcaaaaccccatctctacaaaaaaaaaaaaaaaatacacaaattagccaggcgtagtggtccatgcttgtagtcccagatactcaggaggctgaggtggctgacttgagccctgggaggtcaaggctatagtgagccatgattgcaccactgcattcctgcctggctgacggagtgagaccaatagggcagcaagaaacaaaacctcaacactgaaccggaatgtccatgacatactgtaaaaaaagaaacctcaaatggacaataactgtatagtgctagttgtaatgattgtgcctttttttttttttttttttgaaacggagtctcgctctgtcacccagactggagtgcaatggcacgatctccactcactgcaacctctgcttcccgggttcaagcgattctcctgcccaagcctcctgagtagctgggattacaggcacacaccaccacgcccggctaattttttgtaactttagtagagacgaggtttccccatattggccaggctgctctggaactcctgaccttgtgatctgcccaccttggccaagaaatctctttaagtattcatttgtactttaaggtaatgctcgatctcgctcttagtacagctgaattgtccttcaaaaagatgatctggttatgtttgacctcttcctcaagggaccaaaaagggaagttctcagctttttatagtatgaggtccctagaggttttcactttggggatttaaaaacaagtttcctgtagctatatggaggaaaaaaaaaaaaaaacctaaaggggaacatggaagaattataatgattggggcatgataattatgtccagtttttaaaactccattcttaaaaatgtcttataatttataggttaaaaatttaaatgtttagaggaagcaggacaggtttatgagtctctgacctgggaatggagtgggaggaatagagaaggtggggttgcaagaggagaaaggcagaggaatttcctaccgtcttcctgttttttgttgatggttagtgattaatgagacaagctgttctgtttctctgggagtcttgactgtcttgaagaaaaaaaagaaaatttattgcaacccaatgcagcttcagatttttcctctatttttttttttcaattaaaaacgtaactgtccctaatttaggaactgaaattcccaaacctccccattcacctattcaggaagaaatgaaatggaacctaacatctacatttcttgggtataatatcaaaactttaatactatggggatgaacatgtaagcaaatgcaactctatctccccataatgttggaagaatctaacttgaaaccagacatttggtttggatcttggcactttcttgcatggaaatattccaagaaggtgcattgactcttgatttgatctagaaaactgggttctttccagagcccacccaggatggcacctcatagactaactatggacttttccatcaatactggaaaacagtttcatctaatccccggaccaaaggtgactcggactccaagtgagcttcctcaggtttgtttgttaatttatccaatcatccattcactcagcaaacatttatcaatcatttgctatgtatatgccagacactacaccagattttgcaagcacagagatacaaaatcccttgcttgcaggaaaacctttggtttcaataaatgataggagaggggttgcaggggtactatctatgaaagttcaaaggaagcatctaacttagggtggtaggggatggggctgagcagaaggatcaggaaggtgttggatggcaggaggcttttagctgagccttgaaaaggcaaggggaggttggccgctttgatggggtgggctaaggactatccatgcagaagaaagagcaggtattaaaggtgtcaaggcagggagttacctcctttgggaactacacataaagaagaatggctagggcctggtgtatgggattggggtgggaaacccaaggcaggaagaagacagatcccaagaggtctggtgtgcatgctgaggggatcaggtgccatctcaatgccatggggagtcattgaaggaaaagcagttagagccatgggatccagttcacatatgatcaatcacccaaacaaaggaaagtttactcaacaacatgttttcatttggacttcattttgtcaaagcatgaaagtgatgtcagaaatagaaatgagtgtattcatggcacaccaccacacccagctaatttttgtactttttgcagagaactcctgacctcaaatgatccacctgcctcggcctcccaaagtgctgggattacaggcgtgagccactgtgtctggcctaaaacacattttctaagatttctttacttctgggccacctccacaaaattttatggttctgggaacccctatctgaaaaagcacaggtatcagcaataagtataatgaacactcactagagggaaagtcattttggtttgggttggttatggaagcagtgtcatatgaaaagggctggactgtactgcagaaatagaagacccacaaattgctatggcttataacagaaaaataaagatttagatgtcactcatatgtccattattgaacagttgtgactctgctccctgtcaccttccctccaggaccgaagctgacagagcaccctctatccaatcattgcctgtcttatgtcagagggaaaggagatggcaaatcatgcatcagcccttaaagctctgcccagaagtggtacattaccatttctgcccacatttcactggccagagcaggtcacatgatatgcctgagttcattagggcaccagatgttgggcaaccaataatacaacccaccactgaggtctttactaagaagatgacctgggccttagggaatggccatgatttacctggtagacacagcaggggagcaaaaggaaaatatgacaatatttttatgaaatcaagacttggccacatgaaacttttttttttttttttttttttgagactgagtctcgctctgtcacccaggctggagtgcagcggtgcgatctcggcttactgcaacctccacttcccaggttcaagtgattctcatgcctcagcctcccaagtagctgggattacacgcaccaccatgcccagctaatttttgtatttttagtggtgacagtttcactgtgttagccaggctggtctcaaactcctgaccacaagtgatctgccctcctcagtcttccaaagtgctgggattacaggcatgagccaccacacctggccgtgacacccttagaaaactaacttcaaggcagaatgcttcacagtgacaaatcttaggatgccactttatagaaatattctgaagagagaaaaacccaggtgagtcagagcagcctggggaaacttcttagaaccaggattttgtggaattcagaggattttaaaaggcagaaaatccaatgaagccattttaagctaaaacaatgtaaataaggtggggctgtgcctagggtactagggtgcagaaaggaacctgcctcctgtgggcgcatttgtgttagcaggtagtgggaaattcgggtggagggcaggtgatggaggaccctgaacaccgagggaagactctggatgttatgtgccaatatttatcaagaaaacgcagtcctggagatacaccaataatttttgaaatgttacagtagatactaattgaaacctacagtgcgccaggcaccgttaggttagcagtgaacaaaaccagcaacctaaacaaaatggtgaacacaccaggcagtgcccttgtgggttacattttggtgagacagatagtatatagataaacaaatatacaatctcaaagagtgaaaaagttgtgaagaaagatgacacaggattagagagtgactagggtgtatatggtggcagtggtggtggtggtgcagccaaggggtggggtggaggacaagacagctgtgaagactggtgagcatgaggtagtccctggtaacaaccagcgctccacaccctaccctcagagtgccattgcagggttagcatactccactgagtaaagcttccttgtccaggcaatcagttagaagagccaggaatgctgggcccaaagaggttggccagagagaaaagtgcaggggacatggttcccagatccacgcagaacccctggggaccactgagttccacaacctcaacaaggcccagggttatactaacacagcaggtggcctcattttagaccccacaccagaatctgtgcaacgggaaattccagtgcagcagaagttggagtcaaatgcctgcctatttctcattccattttgggaagcctaaacagggaagccttctgtgttcctctcattcccatattaaactgaactgcaaaactcatggctctaagtagactttagaattgacctaggcagaagaaatagcccagccccttcattacttcagagcagaatagagcacttactcttatcacagcagcacaagacccctgggacacctgactccctgagacccttccttgacaggttcccctgtccataaacaaagtcaggaattcccagcccactacacagaatatgacagttaagcttcattgggatcctgtggctgacctggggcaggctagagggcatcacatctgtacaggctctcagctttgcgagttcagaaacagactgggtgttcatgtggactggcccaaacctgaaactctacagaaatcgcagtgcatgccaggtggtttgccatgaaaaaaggtgtgtgtcccagagacagggtgtgtatggtacaaatggattttgtccatgtctttccttcccttgccagtccagccaccctactgtctttttttttttttgtcagtttttgtttttttttaatttaagttctgggatacgtgtgcagagcatgcaggttcgttacataggtatacatgtgccatggtggtttgctgcaccttatcaacctgtcatctaggttttaagccctgcatgcattaggtatttgtcctaatgctctccctccccttgcccccaaccctccaacaggcccaggtgtgtgatgttcccctccctgtgtccatgtgttctcattgttgaactcccacttatgagtgagaacgtgcttaccctactttcttttcggtttgtttttttgtttgttttgagacgagttttgcttttgttgcccaggctgaagtgcaatggtgcaacctccgcctcctgggttcaagggattcttcagcctcagcctcccgaatagctgggattacaggcatgtaccaccacgcccagctaattttgtatttttagtagagacagggtttcgcgatgttaggcaggctggtctcaaactcccaacctcaggtgatccgcctgccttggcctcccaaagtgctgggattacaggtgtgagccaccacgcccggcctacctaccctactttcttagcctatttgctgactagcattcaaactgagtgcagggagaacacctagcagcctgatcccagaagtgcagctactccacattccacagctctggggcagagtgactaaggctcacctgtagtccttaaatggagagcaatttgggatgtaccagctaatcaaataaaaccaaggcagcaaacaatagccatcacttctcaaaccatcctcattgtgcccctcgactccctccttccatttccagttctccccagaggggagacagacaataacctcaacaacagaagccagtacacagcaagcttgcttcacacgttcacgtttcttttgtttttctttgatgttttttctttgatgttttccattttccatctctgaggtgattagcagtacagcatagtggttaagaacagagcagggactccacggatagactacccagtcttgtcctttgttacagtggttcttaagctttcaggtgactgggaatcacctggagagcttattaaaacgtagatttccagccgcgtgaagtggctcacgcctgtaatcccagcactttgggaggccaaggtgggcagatcacttgaggtcaggagttcgagaccagcctggccaacatggctaaaccccatctctactaaaaatacaaacatgagttggccgtggtggcacacatctgtagtcccagctactctggagactgagacatgagagtcgtttgaacccaggaagtggaggctgcagtgagccgcgattactctaatgcactccagcctgggggacaaaacaacaaagcgagactctgcctcaaaaaaaaacccaaaaaaacaaaacaacacagattactgctccccaaccccagagtttctcattcagcacatccaggatggaacacaaggatgtgcagttctaactagttcccaggtgatactgatactcttggtaccatgaccacactttgagaacctctgccttatgaagtttccaaagactgttgacttgtgtgtgaaaggataaccctatacctaccacttgtggctattagggttaaatgagtgaatatacgtaaaatgctttgagctgtgaataataaaatgcaagcatagctagtctggaaacttcgcccatgccttttgtctctgttttgtttgttaacctccatttgttttgtttgtaataaaccacttagccaggtacctcttcctctccttcaaatacagagggcgtgtgaactttggagaatgagtgtttaaactgacctaaataatatgtgattttcaactcttctgtggattcactcattattcaatgtgggctttgcgtgccatatgtgataaacttcttgtgtgtggggtatagtgggaatgtgcatacgtgaaattgatgtcagatctttggatcgttgttagggaagataaaaggaactcacactacagtgcagccttgccagtagggctgttattcccacttacgtggaagaaactgaaactcagttcattgaggaaactctctcaagcttggacttaggtcagaggtgacttgtaaggatacacacagagaaacatccaagcctgggaaaccagctgatctattactctgtgtaccagaactttatgtatcagaccaaacacacaacaagcctcacgaaaaactggaatgtgcttcacatcactgcagctttgtcccaatgactgggccacccaaggtctctgcttctccctaggcatgtcccattgagactctccacatagagatagtctgatggagttgtgacattaacacccaatgtggaatgtcccggtggggtggcctcggattcagttgtcttgttctgtaatcagtcatagccaggaagaaagcccagtcttgctccaggagcaaaccgtagcagcatgctgctgaaagaactgcctggggactttttccccagagtggggttggctttggcctgtctagtactttcagggacattgaggcagccttagatcctcagaagagcacagatctttggaatcagacagacttggatttgaaccctgtttctgccacttaagtttcctcaactatgcattgtggctatcacacacctcacaggtgtgaagatcaaataacataaagtgcttagcagagtgcctggcacatagtatctgcacttaatgaatgatagggtttggtttttttttttttaaattaaaaaaactggaaagatggaaaggtgaaaataattactcagctttatcatcctatcatttagcctcttatccctgacagtgtgccattttcaatcctgtagggatgcattcattattattaattttttaagagacaggtcttgctgtgtcccaggctggagtgcagtggcacaatcataattcactgtaacctcaaactcctgggatcaagggatccttgcacctcagtctcctgagtgtaaggttcttgtattggttggaaccctgagagcgcgccaacagaaaacacgaggcggtgtgaagcaacatgctgttttaatgagcacctgggtacaggcaggctgaagcctaaaatggcatcagccccaagtgaggacagggcagaggttttatagtctcttgtaaacaggaagtgtcctagtctgacgtaactgctatgttgtacccaggtggcctgtttctcgatcaggggtacatgtcttcgtccagggtaggtgtcttcctgccggctctcttcctgcttctgctatcttgctgacacacgctgctgacacaagtggacttgcgccttgggactgggcctgagaagggaggagttattcatctccttaagctttcaggccccggggagaatcttataccgcgtagctaggattacagacacatgccaccacacccagctaatttttaaagtttttgtagagatggcatcacactgtgttgcccaagctggtctcaaactcctggcctcaagtaatcctcccacctcagcctcccaaagtgctgggattacaggcatgagccaccacacctggcctcatccattatttaatttaaggctttatatgctacgaagctataggtttttaatagaaagtctgttttacatggttgtaattatataattttgcattctttttccatactataaaatattttaatgttataaattctgtacgtaattttagtgaacatgctataatttacataaaattccttatcattggacacctaacaatagagaattgattgaataaatggtagtgcattcatataataaaatattaatcagccatttaaaaaggtggattagaagtatacttcttaacatataaacatgttcacgattatgtataaaatgaaatgagtgtacctaaatatcaactacctctcaagtctgtctggacattttcctacctcagtctcagcaactttcaaactttaatgagcctcccaatcaccaaaggaacttgttaaatgccagtttcacgctttaccccaagagtttgactgagactggggctcaggaattggcacttttacaaggatcccaggtgcctctgatgtgggaaagacacctcacctatttctgcctgttgaagctatacttaattttccaagcttctccttcttctttctcctgaagtcctgtagtattttgtagcacttgtctgctttcttgtcttagagatcttagcaaatgcttctaaattgtaaaacttttcctgatcctccaaccaaacctagttatgcacccatgtcacagccccagaatttgtgttaaaccctgtgtgagttgctgaatataaatactgaaatctctggaatccaaacttcatttactttgtggtggagagagagtggctgagtacttcagaactctttagaacacctgttatagcaggaacttttgggaataaaggtggtctttctaaccttgatttaaaacaaaaacaaaaacaaaaccttgtttagattacttttacttacctgacagtcaggttgtgaaaagtaaatagtttgtcctttgtgcatttgctctggtctaggccagagatagccagtaagctggagagggcagttaaaacccttcaagaggcctgtcattccaaagaatagttttcttcaggtctgttggttggttttcattctcagactgtgtcactgaggttgttcaaggtaagattcttatcttgcagttcacttagggaccacttatgctaaaattgagactgagttactcatcaaagtacttcttcacttagatttttatcagtgtgatttccctccttctttaaataatattggatatccatatcaagtcaggtttatgtcatcttacattatcttttatgtaataggccagcttgcagatgcatagttataaataactattgataaatattatattgagatgacactgaaattttgtccttgcttgtaagagaactagatcatattctgtataattagttaacacaaaagaattcctcagaaacaaactttaaaagccaggtataacagctcactcatgaaaagttccttgtttcatatgaaaatggtaactttgtagaagtaaagctccagacaacaaagaattgacagggttggggaatggaaggttaatgaaattggttaatcaaatgcttctgatggggaatcaccacatgtagtgtacttgtccacatggcaaactcggaatcactcttcagaaccttgtgtagaggcatcatctataaaaccctgcatctgtaaggctttttcatcagccccctccttggaaaaaatttctttttttattctatgcccacaacagtacactacacacacatctatcatatgtcacactctagtatatgcttgtgtgttactattatccaatagatcagaaattcattgggcatagagcatgtggcttatttgtgcaatctgacccaggttcagtgcctggatatagtagtattcattaaatagatgtatgaataagaattctgcactgaacagggtacataaatcatataaactgcattttgtgggtgttttctgagaactcctgcagttaaatttaaagcatcaccttatgacaaatttccataaaatattgttataataaattatgaataaatgttgaaaataacaagcccagtatctgctgttccctgagtccctgatggcaactgcatgctccccagtctgtgggactcctgatttaaagagctagatctgaacttctgcagaaacctgctcaacatttgcccattggttgctgtgaaattcctctcctgggctcttaaattccacagaggcttaattattacagatatttaaactttgtacatacatgacggatatcaaacatacccacatctctaaggtaaactgtattaaaagtgccagacaattttaaaattgaaagggacttcgtcatttttactggttaggaaaccaagcctcttaagagacaagcagtttttgttagtgggaggagcactagaattgaagtcaaatagaccagagttcagttcttggctcaggggctcaaatcacagcctctgatcggcagtgtgatcataagccctttacttaatatttttgaagatcagttttttcatttgtaaagtttggttaataatccgtctcagtgggtcacaacaagggattacttgagattacctgagccagagcagcacacataatatctgcacaaagcaaatcctcagtgagcttttgtctctgccctttcttgcccagatcacacagagctaagacttagacgctttctttgggttgtggttcccagttcacctgacaggactcacacatatcaaggatgctcccaaggggctgtgtcacatcagcatttaaatacagaattcaggatctcctgctttaaaaacaatctcccttctgagttactctttttaaattttatttatttatttatttatttttgagacggagtctcgctctgtcgccagggctggaatgcagtggcgcgatcttggctcactgcaagctccgcctccggggttcacaccattctcctgcctcagcctcccgagtagctgggactacaggcgcccgccaccacgcccggctaattttttgtatatttagtagagacgggatttcactgtgttagccaggatggtctcgatctcctgacctcgtgatctgcccgcctcggcctcctagagtgctgggattacaggcgtgagccaccgtgcctggccctgagttacttttattgctgttgtttttttttctttccttgtactgcgagttatgacaccctcccagtcaaccatcaactataatttaactttatataattgtgtgaattagcaagatcctaggaggctccaggatctcaaaggctccaggatctcagggtaatgtatatacacattttagaagagtaagatctacatcgcctaataagtcttcagcttttaaaaatcacattctaaaataataagtgaaatatttgtgctgaattgaaagggtttccataaattctgacggtaaacgatgagtgttttaagcatggagatgttagtcatacaaacttaagtcaccatgaaacaggcgatcaagtgggggaagcagcatcctgtttcctagtcttaccagagttcatttgtcattttaagagacaacttacttttccatcttttcttcttttcctgtaaaggtagaaacctgtgggttcttgttgtggggcggtttccaaaggaacacagaattgggattccagagttcaaatacgtggcaaatatgcatggagatgaggtacgtatgtggcttgaatttctgaaatgtcaccagagaagcttcccctagggtctcttgagctctgtataaatgctaccgaggaagcctggagaagtctccagcatgcattgtacaaagaagcaaggcccagagaggtcttcctgtgaggcctgtgggaggttaaggaatcagggtccaacaaccaccacagctgtatggttgtgtacccagcaccctgtcagagtagctggagcttgttttgtgtttggggccggaagaacaacagttccccagccctgaacttctgccagccaatccctgcatctcctttctgggttaagttttcccacctcctggtcagcatgaaggtgacccagcaaaggagctgtattgtatccgaacccacaaccatcagaaactcccaaatagctacccaaattcctgagatctggcttttcaaatgcttttgttactctctcttaaatctaacactcattgtcttcagtgctccagtttagacaatcacacttatgattctctcctactcaccattcaacaaacacttggctgggtgcagtggctcacacctataatcccagcaatttgggaggccaaggcaggtagatcacttgaggtcagtagttcaagaccagcctggccaacatggtgaaaccttgtctctactaaaaatgcaaaaaattagccaggtgtggtggcgcatacctgtaatctcagctagtcgggaggctgaggcaggagaattgcttgaacccaggaggtggaggctgcagtgagccaagatcgtgccactgctctccagcctaggcgacacagtgagactccatctaaaaaaacaaaacaaaacacaattttaaattccttaataatatcttgcctcttttccaacttagcagggataaactctccttttatttttaggttctacaaaataccatttaccactgttacctacccagccattcttgccaggcagttgaagatgttcacctctgtttctcaccttgcttcctcagaatattttgagaccatgacaactgaaatattttctgtttaccaggactctataaaactgagcgatcaaagagtccccagccatcccagtaaggaaactttgcacaggaatgtgggtattaccctgtaaaacacaacttataactttagggactttctcatttacatacatattccaataagtactacctgctgacttgttaaaacacttctggatttgcaatagtatgggtggcatgctctaatcagtgctgagcttcctgttctggcttaagccctccccaaactctataggaactggatctacccttcatggtacactccgcctgcccttgccaggcatgctgcccaacctgtcctgctgagagaggatacttcttgcagctgcagctaagatgcaagcacctgcccctagcaaaggaataagtttttgaacccgattttggggtgggtgcaagtttagcccatctgtgactttttgagcatcacgggcggcttctttaaaaaagactacgttgcaaggagtctgaccaaagttagttttaataaaacaactgttcgttatagacagcagctcagactgcgtttcccttttgctatcttgtctattgatcgaggtcccttgatcaaggtccctcagaatgcttttttttttttttttttttttccgatggaatttcgctcttgtctcccaggctggagtgcaatggcatgatctcggctcactgcaacctccgcctacaaggttcaagcaattctcctgcctccgcctcctgagtagttgggactacaggcatgcaccactatgcccagctaatttttttttgtatttttttttttttttagtagagatgggggtttcaccattttggccaagctggtctcgaacccctgacctcaggtgatccgcccgcctcagcctcccaaagtgctgggattacaggtgtgagccaccgcgcctgactcagaatgcatttgtaacaagag

SEQ ID NO: 14726 - DNA, 49220 bp, Human
catataccacagtctattgcatcatgaaaaaccagtgtgcaataggtctttttgttcttagcaaggtaaagacatttgcaatactgacaggagaaatgtcacctacaaatactctaaagtgtgaagtgacataaatgtttctgcacagctaaaactttggtatatgtggaacagtatggaaaatgaggccagaaaggtaaaatagtaagctgctttttgtcataaagagagaaatggaacactcattgttcaaaaataggtacataattgagagattttattcagaataatgcctgattaatataaatttagtcactgtaataatgtagctacataatttatatatatgtatatatattcgcacattttttgctttatcaggaatttttgtatattctactaatgacttttctgtatgatagcacaaattacaattgttggccactgccacaaagtgggggaaaatgcacatttttaagcatttctttgcttcatctatgaaaatttcatctttgtggtatgaattatggagcattgtcctgagttgcccttataggtgaccgcagtttgtgtgttgtatgctggagtcccaattgaggacattactgcatataaaatgattataagtaaaaggcagaaaatgttctgaagggtcataacttccaagggttctctaccctttgacctctggattggggttcccagtgactgccttaatatccttctctacctactgccttaaggccaactcaatgtatccacgtaaagagtaccctaaagccagtaaaagattatcacgaacacccagagatgtttatggccatcattccagatcctctttgctttttcttgacttactccttttttgataaagttattcatatggtttcaaatccagaattcagctattcacttcatggccctagtttggattaaaacaatcagctttcttttgctctgtagatggccttggacagtacatattaacagtctatggggccccttttccactcatgaccacatcctgcttgcagatctgctgctgggttaacaccacatcatctgctagttgatgccatttatttgacatcctggggttacagcacgctaaagggcacccactgtccttaacagagaaaaatacactgctgagcagaggattaaacagactcctcacactaccggaagttcagtgcattttccaggattttcaagtcttcgatgctgtcatgttgagagtccactatccacgtttgtttatccaggaataatgcagaaaatctgagcattcgtgaatctaatcattgaggtaaagtaacctagtcatggtcaagaggacagctagtgttaaactccttcatataaatttaaggaaggatttacatattcataatgactttctgatctggaaagcccaggcttgtcagttattaataattggatgaatacttcaggtagtatttaaacaaatagcgatttcatagcagacatttccccaaccaggagatgcagtaaagtattggtagcaatagatgctcctaccaagatctcctcctgccactgccactctgtgcacaggaaaggaggggagaagaagccatgttgcttctcttatatttgagcatcatttaagggaatataagtctctaatgactcacatgtaagtctgctgggtaagaaagttctaatgttggaactcctttcagctatcgaattttgtaagaaaaaaaacttatttgtgtttatatacatttatgagatacaagtgtaatttcgttacatggatatatgccatattggtgaagtcagagatttcagtgtgcacatcacccgaaaaatgttaactgtacccattaaagtaatttctcatcccccatttcccctcaccacatgctccagcccttgccaggaaactgttcattttctctgactaacagaaacgaaagctaaaaacactggtgggaggagtctccacattgtttcctactccattttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggtgagtactgttcctgattttgtaaatatgatcttgttccttccttgaagtccccagaatcacaaggggacaatcagtattggttattcagggtcatgggatgatgggagtagggctgagtattcagaaaagtgaaaactgagttgcttgatatgaatccttcatttacttaggaagataacaggcatcttctattccaccacaactgaggactgaacaagagaaaatgcattttgaccgttgcagattttaaaattaattatccgagtgtatattggcataagttggtacttagaagagggcttctgttattttggctggaagaagtgttggaaactcggtagctgtggtgggttctcaagatagtgacatgaaaaaagtatcatgaaagaatattaagtaaaaaacatatctgagcatagagatgtattatatgacatcatcccaattttacaaaacataagaacaaatgtacacagagtagaaaatttttttcagtttcacaaacacagttactcaagcacatggtgtcttaatattttcataagtatattgatcctttactttagctccattctacactgggtgctagcggcagaatttcaatcattttggaattactctctgccctcctgaaagttaatgattttttttttccttgtggcaaggtataggggagtggaggggaaggcaattaggaaaaggttactattgtttacttttcaaatttttaaaagatgttttctatagcctggtacaatatttcatgtgtgcttaaatggaatgtgagattcttaaatgttgttttcagaattttattagataaatgttgttaattacgttgttcaaatttattatatcattacagattttttcaccttgttcatttagtaattgaagcataaactgaaatctcctattataaagtttgcttttttggccgggcacagaggttcatgcctgtaatcccagtacttttgggggagaccaaggcgagcggatcacttgacgtcaggagttccagaccagcctggccagcatggcgaaaccctgtctctattaaaaatacaataattagccgggtatggtcatgtgtgcctgtaatcccagctactcaggagactgaggcaggagaatcgcttgaaccaggaggcagaggttgcagtgagccgagactgtgccactacactccagcctgggtgacagagcaaggctctgtctcaaaaaaaaaaaaaattttttttctttgtagtgctctcacaatcacatacatgttatgtgtatatataatatacattcacacacaaatatatgtatatataatcatgtatacaaacaggtacacacatatatgtgtgtagtgatgtctgtacatgtgtgtatatgaagagaaatatatactaattatagtaccatgaagcactataaaataataaataatatcattagataaattagataaattcataactaaaacataattttctaggagttgaaacttttatcattatgtggtatctgaagttacttttgggcttaaggtatatttaaaattacacaaacatagataaactggctttctttagttattccttgcaagataatttttaacaatttttttcaccttttgttaacaatatatatgtagatttcttaaatcaaatttgatgaaagttgtcacttaacaggtcagaccttttaggtatatgctggtaattaacaatctgctgtctttacttcaatttatgacacttctatatcatctcactatctaagacaattgctttagtgaattgtcatgttctttttcttccctccctttaccatgctgttgtaatttctgtttctcttatctttgatcagggttttctttgtaagacattaggaacacctaaaaaagtttatttttcactcttcttatcttttggctggcagaatttttaattttattcattgttttcctattaaatattattttcaatagatgttttcttgtggtatgagtctttgtcttgcaaaaagactgaggccctgagtatcacaaaatagtttttgagactcttctatttaaatatcattttgcctaaattaaaactctaaaatgtaaaattatattttcccttaagacaagatgaaagcacctcttctgtgctgtggagctagatacattttgaagttaagaatctggaggcttcagaaaggctatttagtgtatatattctaaatagtgtcttactagaaactccattgggatataaataattactccaaaatcaaaagcactaatattgcaaaacaaaacatgtgagtgttcacatttcagtgaaataaagattatacatagcctactgtcatcccaaatctggttttattttgcaaataaattgtgctgtcacacttgttggaaacaagtgctcagtgccacaaagaaaaaccagcacttaaacaggaaatttctcagcaaagcatatttgcttctacagaagggtgctgcctgcgtcagtcacaatgcacattctaagctgaccggattggctactgctttaaattctataggggtaattaggcgggaaggaagacactgtcctgtaccaattaggcgggaaggcatgtctggggcggcaaaggaaggaagggttgtttacagaacaggaaagaacaggaaagtttgaagacgaacttattgtttctagcacactcacaaaataagtcaaaactttccattgaaaattttttttggttttgcaattgatatggaactttggaccaacattatataaaaataactccattgtcctgcttcaggcagttttgatatagagattcactttcaatttgattcttgaatctttgtaggtgatctattcctcattaccgaaggcttacagagtatttttgttcattatattcttcagtttcactataatgtgtttttgtatagattttcccttcattctctggaccttttcagtccaaggatcctcatgttctcgtaagaaggaagcttttttttttttttttttttttttgacggagtctcactctgtcacccaggctggagtgtagtggcacgatctccgctcactgcaacctccgtctcctgggttcaagcaattctcctgcctcagcctcccgagtagctgggactgcaagcgcttgccaccacacctggctaatttttggtatttttagtggaaacgaggtctcactgtgttagccaggatgcttttgatctccggaacttgtgattcgaccacctcggcctcccaacatgctggaattacaggcgtgagccactgcgcctggcccaattaatagcccctgaaatttagatatcttggttatacacaaagacatcattcctaaaattaaaaaattcattaatttaaaagttttggaatccataccttgcactgtcatcatggaagtgtacaggtgttaagaggtcaagagcagtgacactctgtccatagggagactctgaaatctaccaggagacaaagcctcagttgagtcttaaggttgtatgggaagtagtcaaagaaagaaatgtgggaatggctttccaggcagtaagaaggaactagcaaagtcatgaggcatgaagacacaaggtgtccggcatctttgtgaagcatagatacaaggagtacaaaggtactagaagtaaaaaagatgcagcttattcaacactttctgagacagtataggaagcaaggaattttggggaagaaaaaggagaaatattgaaggatttcagtggaatataaatgtggcttatcgagagaaaactgattgtgcgaaaagaaataattagacaaatcaagtctgaaagaagaaaaataaaacaaccaataaaatcatttcagtgaataaatactgtgatgctgcactagaaagcatgcagattttcagcaaagttatggttttatgggtacagagaacagaagccatggtctagcaccaaagaagggaggatgctaatgaaagccaactagggaagagtcaaggagaatagggtcagtgccacagcatgaaactgtagcgctgtagcagaaagttattcatataaggtgggaggctgcagcccatttacacctaggccgctccagtcatactgggtgtgggaagatttaagaaacaacaggcaggatttggggaataggcttcagccccagtaaaggataagaagaggaaccaagggctttgacactgcagagctcatactcttaacactgaggcaattgcttgttctcagacctccctctaacaactggacccaactcaactattctcattcaatgggaataatttcttagacattcctaacccagcagttcttcactcaatttctacagtaacacatttggtcgttgagtccttctttatcacacatattcatgaacaactctttcatatgggccactcactcacataggcatacatcttttaaattgtctgtatacatgtgtaacactgtatataccattttctcttgtaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaaggtaattgggaagagggaacacccactccctgcaaccatccccaaaccctccccaacattgattagagccccacctcggacatacttgagatgtgttttccccagtttgtgactcaacagctgagacaatgttggtacttcagaggccaacaagttgacaacttagtgcattccattactggtgtagattgaagtatttcagaatgtatatttgggatcagtgaaagaacaaaagtgagagggagttgaagggggactgagacttccagtacattagaaagattatataataataaaatcataaaaactgtttaaattcaagatatgtacatttagccaatgaatgtatctgttctattgagaccatttaacccatcactaccctttataatttaaaaaaatgcaatacttacatgtgagcctgcctctcagaagtgtgatctcctctcttgttatatcaagttaaaaaaaaggatttgaaaaagtctaagtccaaaatcagtatatccttcctcatggaaacctttggctggtttctataatttgaatatctttacctggggaatgtgacctagcagtctccatcatgaaaacattagtttttaaaacaaaatgatcggagaaccgcattgggaaagggttaactgaagcacatggagttcagagaacaggaagcatgtgctcagtgcacaggggaggagtgaggaaagtgctgaggagcatgagtcagtgcttgttcctgtcttgtgactgctggtctccttaaggccaggctgggctaatgcagtagagctagactaaagcacagctgaaccctcaagcaggaactgagagcaaattgtattgaaactgcttcagctgtcggagatcgtttatatgtcttccttttttctgcattggttgggaataaaattgaatctattccagtaaaaggaccagccctatcaagaaagaggaagaaggaagtggatgctacttcacctgcaccctccacaagcagcactgtcaaaactgaaggagcagaggcaactcctggagctcaggtaagcttcaggaagaggagcaggcttcaagtcccacagaggaagctctgctacggctcttccactcaatctctccagcaggcagttatttcttcatgtttcccatcaagtttcagatttaccaaattgtatgataattgatcatcttattgatgctcaaagcaatgcaccaaacacatgagtaaacataatgtaaatatatataacataaatgtgataccttcattctagtagagtggagtgtcaacgtgagaatcaggtaagtactttgtccatgtgtataaaaacctagtttctctaatcccaagtcagcacatcccataacagaaataattagagaaataatgtgtataacattctcctctttcttcgtttaatgaaaccatctatgcccatctcttaaactggcgagagatgggcagcaacctctcaagtttccaagaaacatcttcttaggaataataaaactactatccaataatgaaaatgtgctctacttcatttggcactgaaaacgaataacaggaaaatcaaaccactttcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgaggtacactcttcctggtcccattttgctttgtttttttcaacccaaagtaaaggactgatttcaccggttacttaaaaattgcatcgataatttgctagttaatccaatgtacatattgagaaaccactacattttgatcttttgctttcacagggatacttgatgaacttgacattatctctgactgcaggaagttttctgttctgtgttgtttggggaagggagagagagctatgcagtacagaactgtcagctgtgggctcactgtctactgctcccatgtccttcatacctcttcccttggttcactatagtattccatgtcagacctctccagcacctgctagtttgtgaatgaggttatccataccctcagctctttttcttgtagattaaacaacctcccctgcattaaaactgttctatcgcagtttaaggagactgggatgttaaagagtaaagatgttaaagaaaaccctttctgagccccaggtttctgttagcatgctacctgctagagccctgacactgagaaaggctatggtggtgggaatgacactctgtagagtttctgcagcctgaacctactgagatgatggcattctgaggggtttatcctacttgtgttctcacctgctgtaagcaaactgaatcttgggtaggaacactatgaaatgtgctctttaaattgccctgtctacactggtgataactgaacactctttgtgtctatagtttgtggtgggcaccgtttttcattttttttttatttttatttttttttagtatttattgatcattttaaatgtcatttaactttgtctatttttaggctctggcactttaagctggtaagagaaatagtataagaaattatttcattctaaaatttatttatttatttattgttgttgttgttgttgagacagagtctcgctctgtcacccaggctgaagtgccctggcataatctcggctcactgcagcctccacctcccgggttcaagtgattctcctgcctcagcctcccaggtagctgggattacaagcgcctgccactacactcagctgatttttgtacttttagtagtgccagggtttcaccatgttggccaggctggtctcaaactcctgatctcaggtgatccacccgcctcggcgtttcaaagtgctgagattacaggtgtgagccaccgcgcctggccctaaaatttattaagttacttcatgacactggctttcagtatccactggtcttatgttgctcttatgctttatttcttaaggatgattctgtttacagaaaggtcatcttttcactatatggtctcctctgttacttcatcttgctattgtaccagtttaagatatcttctgccctggctcgcaatccctctctatcctgactccagctctaaacatctgtgcaagttttggggccctgtgttgtactgaggtcactgaatagcagttctgtatttctcaattagacatttttctttgttctcctgtgctatcatacacagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataaggtaagtcctcaaaattgtttcgtttcatttttccaccaacacctgaaattaaaagtcttgatgtgtgagatgaagctttgcctataaactggatattagaatccaggactctgaagactaatgacaggtggataaagacttctctgaagataagactgggattaggggacctgttaatatttctttcccatgttctccttcccagagcattaaactgtagtctttacaataatgttcactgagaaaccttaagactttatcagttgttattatctatgctaagtgatcaaggacattgtgaggtctacatccatacacacatgatactaagtttatccctttgattattatctctactgtcataaaaatcacattatttttattttgaatgaagtattgtcctctgaggcttgagttctggttgtgacagtcagaataagaaataaattgactactcatggctggaaaacaaatgcagaaagtagataggacaatgttctgaccaaatgaaactaattcatcataaagaaatggaacaattgggaaatacgaatttggatgatacttggaaaatcaggtaatctaaatttgtcatttatatataaataacaaaaaaaaaaaatagagtacagagtgcttttcctgatatgttcctgtccaaattcataaccagttagcatgagacattccaccccgcaaaaaagcatctatcctctgctattgattcaagcaatttatctgatcaatacttcattacccattatatttgtttcctagaacaactcattaacctgcgttactttctgtacacagtcttttttttttttttgagacggagtctctgtcgcccaggttggagtgcagtggcgcgatctcggctcactgcaaccttcgcctcctgggttcaggcgattctcctgcctcagcttcccaagtagctgggactacaggcgtgtgccatcacgcctggctaatttttttgtatttttagtagagacggggtttcactatgttagccaggatggtcttggtctcctgacctcgtgatctgcccacctcggcctcccaaagtgctgggattacaggcatgagccattgcgcatggcctatatacacactcttaaagagatgattcttacaaatccagttctaggatgatgagtaatgagcaaaaagctggaatgtttgagctcaaggacttggtttcaggagggggtacaaatattggaagagactcagtaaatgcagaaagtagaaaaagtaattagagagttaccagaagcttgctttttcttacagattcctcataagtcactgaataaatagttgtagcagatatccattctttttgcatggggccagagacccagaaaggctatcagagatttcagcttcctctgtatcaaggtgctttgggaagcaaagctgccctgtaggtgaaagcagtagaaatttggaagaaaactcattgttctagaactgtcatagaaatatctcagatatgaaagacttaaacaaaaaggatattgagggacggctttctgcaaagatgtggcctaagatatgtgcatatctgtactaggagttgctgttgtgcatcttgtttaactctcttagaagggacttcagcctatatgtggttgttattaattacattctcaggaacagaatattaattttctgttacagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccaggtaagaattaaataggcaaatattagttttccaaagtggaaatgatttgctttaagttttggcaaaaacaagtttgtaggttttttttacagggttcagcgggaggcatgagaaaacagatattctccttgtattcacatttactttttttaattttttttttctggatggaatgatgtgataggatacaattttaaaaagaaagaaatctgaactttatcaaaaaaattgaactctgaattttatgtaaacttttaagtgattgtagggttgggatttaaaattacatgttctccatttgtgaattagaaaacgtcgtgtgtgtgtgtgtgtgtgtgtgtgtgatactttctagtttgtaacattacaatacacatatgtgtgtatttagtccataaaaatacctaatttgaaacttaaaattatttgcagtgatcaaaattatgtcccactgacaaagttttatacagaggaagctctccaatttgttaatttgaattcaaatattcacgtgttaagtttccttacagtacatgattttacgctgttgccattttgaatgttgtaaattattttttatttcagtaggtttttgggaaacaggtggtgcttcgttataggaataagttctttagtggtgatttctgactttttgatgcacccatcgtccaagcagcgtacactgtacccagtgtgtatgtagcattttatccctcacccccctcccactctttcccctgagtccccaaagtccattgtatcattcttatgcctttgtgtcctcatagcttacctcccacttatgagtgagaacatacaatgtttggttttcctctcctgagttacttcacttagaataatggtctccaattccatccaggttgctgtgaatgccgttattttgttcctttttatggatgagtaatagtattccacggtgtatacataccccatttctttatccatttgtttactgatgggcatctgggctggttccatatttttgcagttgtgaattgtgctgctgtaaacatgcatgtgcaatgatctttttttgtatactgacttcttttcctctgggtagatacccagtagtgggattgctggatcaaatggtagatctgctttttagttctttaaggaatctatacactgtttactatagtagttctactagtttacattcccaccagcggtgtagaagtgttccttttcaccacatcgatgccagcgtctgttttttaaaattttttgattatggccattcttgcacgagtaatgtggcatcattttgtggttttgatttgcatttccctgatcattagtgatgttgagcgtttttccttatgcttgttggccatttacatatcttcttttgagaattgtctattcatgtccttagcccttagccctttttttttttttttttttttttttgagacagagtcttgctcttttgcccaggcgggagtgcagtggcgctatctcggcttactgcaagctccgcctcccgggttcacgccattctcctgcctcagcctccagagtagctgggactacaggcgcccgccaccgcccccggctaaattttttgtatttttagtagagacggggtttcaccgtgttagccaggttggtctcgatttcctgacctcgtgatccgcccgcctcggcctcccaaagtgctgggattacaggcgtgagccaccgtgcccggcccttagcccactttttgatgggattatttgtatgtgcaatgcttgttccctggtgccataaataaatagcatttgaatatcaatttaattttttcagcaaggccatttttatactttttgtagaaagggtacactcgccagcggttttgccacaagagtatacggaacaaaggagacaggctcatttataatctgacgcggccaccctcctgctgcgttcggtttccattggctgggacgggacctcaccttctgtatttgtcccgactggctagcacttagaactttttaaaagaggcaaaggcataggagaacaaaggaaggaggaagtaacttgtggaatattgagaaaggtaaaaacacctttaaataaggaagaggaacaggctatgacctaatgcttgtttggatcagtataagcatgttagggcaaatatttaggctaaattgtgggagctaagaacataaagtatattgattttttattatggctagcagatatttaagaatgtttgtacaggtctttgaataaattttgcttttaagagaagttactatttatttctaattagatggggaggaaagtttttgaagaggaacctctactttttacaatttcccctcatttcataattcttctttaaacttgtttaatatgttttgacttaatttttttttgtccttttaagagaagtaatttttcagaatagggtggaggagaattaggagttaactctgcaagagtggcagagataagtttttgtataaaatttcaaaggcagggaataatataacagcctacaagaataagtacaccaataacaagagcaaacgaggtgagaattgaagttaaattttttttttatccgctgaaccaatgttttattattttagaaaaagagttatttattttagaatttttggcaagtttatcggatagggctgttaatccttgtagcacttttgttatagttctatcaggggcagtattaggaataaaggtataacattgagttttaattatgacacaaacttctttttttgctaatattatatttaaagctattttatttttctagaccatctggctggtaggtcctaattgcttagctttctctttgatggcgtcctcagtgtaatttatgaatcgttgctgattatagtagatatagtttatttagtctacttaaaaaaaatttatagttacttaacagaacaacatggatttaaactctgcagctatttgattttgtgctttaaacttatttggcacttctcataggaccttaatagcatttatgtaaacctaacgtttaaaggactcatgaggagtttcctttggcctgcagtgtcttgtttttacctttttttttttaggttggtgaaatgccagggtgcaggggatagccagttggattagagcataagtactgctccaattatttggcagagtgtctagtaaaagtcctctacaatatcaccatacatttgcttggggatggctaagcgtggactgatgggcaagctcttggaaaggcttgagctccttgcatccttttatgcttctaaggaacaccaaattttactcttgccgtgagaggcacaaagtaaacttggcattcagaggtggaagcaggcttgccctcgggggcggacccccggggtattgagtttcaggaaataacagatagagagctcagcatgatggattatcctaaactgtgggattttgcaagagagccaccatatgtccatttctggtcaatgaggagaccgtccgagtggaaaggggataatctggacctctgggctaccatgcgtacaagcgtgataataatttttatttaaagtgcgaagggaatatttaattcattccagccaggcatttgcatcttgatattttgtcttaatggctaaggtctgtcttagatgtcttatttttacaatagacaacctagttttattattagatgtaggggcaactggtgtgggatctagaaccgaggctactgaagaaggggaagatgggggaataatgcgtgttttaaaaacacctagggggtctttttcatttatgtcaatccccatgccatctaagcgaccaagggcaggtctagagttagttaaggtggaggtggtgataaagagaaggacagagttacattgataagggctgacagttagaaggggtagcccttttggtgaaatagatgaagggttttagatctgcacaaaccttttttgtggaagtctaactttgctcttgagtagtttaaaggatgtagtcccatttactacaaggttgccaggctgtaggagcagaaaatcgatgccttggctgcaggtgctcacaatgatgagtgctacgggtaattgtgtcaattagagggccgggacataaatatttgtgtgaaaaggctagctgtcgttaatctttttttatttccacaaagtatgagaaaacaagcattaaagacaatggtctaaggtgagttagacttagttatatttataacaaaggagctaataacaaaagaaaaaaatatataaaagatgtattaaaatgaagctttctttaacttagaagggcttaatcttagtacagtaacccataattctaacgaagaagatgttttcttgactcaaatatgatgggtccattctttctcagctgtgcggacggcagtctcagtggttaatacataaaatagggtccttcccaggctcgagtttttttttttaatcttttttcatcttttaataagaacatggttttcaggctggtgctggtgtactggaaattctaggggtggtacctgtgctaaaagacttttagttctgagggaaaagaaagtggaaaataagcatataatttttgttgcatatcctggggcttgaagccccatggtgacgcctcccgctccattcctgctcagcgccgcccaagggatgctgtggccctggcccctcttgaagtcttggccttcttgtggccttcaccacccccgcgtgctatggccttggggatgaggggcattgtgacttacctggccaccctcgggacttaaaaaaaaataaacaccattttatatttgactattttttgtataattttatactaaataagttaaattttacctttatattaatgtgctattaatgttaaatttaattttagtaaaatattgtagacattatttatccaattttaatgtctgaccataaagtaaaacttttatagactcattttaattttttatatttgtttttttcttgatgatttgcttgagttcctcatagattctggatattagtcctttgtcagatgcatagtttgtgaatattttctcccactctgtgggttgtctgtttactgattatttcccttgctacgcagaagctttttagcttaattaagttccatctattcatctttgtttttgttgcatttgcttttgggttcttagtcctgaagtctctgcctaagccactctctagaaggtttttccgatattatcttctagaatctttatggtttctggtcttagatttaagttcttgatccatcttgagttgatttttgtataaggtgagagatgaggatccagtttcattcttctacttgtagcttgccaattatcccagcaccatttgttgaataggatgtcctttccccactttgtgtttttgtttgctttgtcaaagatcagttggctgtaagtatttgggtttatttttgggttctctattctgttccattggtctatatgcctatttttatacccagaaccatgctattttggtgactatggccttatagtatactttgaagtcaggtaatatgatgcttcctgatttcttccttttgttctttttccttagttttgctttggctatgtggtctgttttttggttccatatgaattttaggatttttttttctagttctgtgaagaatgatgttggtatttggatgggaattgcattgaatttgtagattgcttttggcagtatggtcattttctttatttctttctttttttttttttttgagacgaagtctcgctcttgtcccccaggcctggagtgcaatggcgcgatcttggctcactgcaacctctgtctcctgggttcaagcgattctcctgcctcagcctctcgagtagctgggattacaggtgcttgccaccacgcctggctaatttttgtatctttagtagagatggggtttcaccgtgctggccaggctggtctcaaactcctgacctcaggtgatccacctggcttggcctcccaaagtgctaagattacaggtgtgagccactgcgcccggccaatatggtcattttcacgatattgattctacccatccccgagcataggatgtgtttccatttgtttgcgtcgtctatgatttctttcagcagtgtttttagttttcctttagaggtctttcacctccttggttagatatattcctaagtgttttattttatttattttattatttgcagctattgtgaaaatggttgagttcttgatttcattcttagcttggttgctggccgtgtatagcagagctactgattttcatgctttaattttgtatcctgaaactttgcttgaaactttgctgaattcatttaccaattctaggagctttttgaatgagtctttagggttttctaggtatacaatcatatcatcagcaaacagcaacagtttgacttcctctttgccgatttggatttcctttatttcttttgtctgattacctggctaggacttccattactatgttgaatagaagtggtgagagtaggcatccttgtcttgttccaatgcttagggggaatgctttcaatttttccccgaccagtataatgttgtctgtgggtttgtcatagacggcttttattaccttaaggtatatcacttctatgccaatattgctgagggttttaatcataaagtgatgctggattttgtcaaatgctttttttttgcgtctacttagatgatccggtgatttttgtttttaattatatttgtgtggtatatcacatttattgacttgtgtatgttaaaccatccctgcgtccctggtatgaaaccgacttgatcatggtgcattatcttgacatgctgttggattctgttagctagtattttgttgaagatttttgcatctatgttcatcagggatattggtctgtagtttttttgttgttgttgttatgtcctttcctgcttttggtattagggtgatactggcttcatagaatgatttagggaggattctctctttctctatcttgtgaaataatgtcaataagactggtaccaattattctttgaatgtctgatagaatttagctgtgattccatctggtcctgggcttttctttattggaaattattttttgttaccatttcaatatcactgcttattatcactctgttcagagtttctatatcttcctggtttaacccaggagggttgtatattttcaggttttctactttatgcacataaagatgttcatagttgcattgaatgatcttttgtatttgtgtgatatcagttgtaatatttatcattttgtttttaattgaacttattttgatcttctctcttcttttctttgataatttcactaacggtctatgaattttgtttattttttcaaagaaccagctttatgtttcatttatcttttgtgttgttctttgtctgtcacaatttcatttagttctgctttgatctttgttatttcttttcttctgctgcattcgtgtttggtttgttcttgtttctctggttccttgagatgtgaccctattatctatttgtactctttcagactttttgatgtaggcatttaatgctatgaactttcttcttagcatcacctttgttgtatctcagaggttttataggttgtttctctattatcattcatttcaaagcattttttagtttccattttgatttcattattgactctatgatcatacgggagcaggttatttaatttccatgtatttgcatggttttaaggttgcttacagttgagttccaattttattccactgtagtctgagagagtacttgatataatttcaattttttttttaaatttttgagacttgttttgtggcctattatatggcctatcttggagaatgttccatgtgatgatgaaaagaatgtatattctgcagttgttgggtagaatgttctgtaaatatctgttaagtccatttgttgtagggtatagtttaagtccaaaaatttttgtttgttgactttctgtcttgttggactgtctagtgctttcagtggagtattgaagtcaaccagtattattgtgttgccatctgtcttatttcttaggttcagtagtaattgttttataaatttgggagctccagtgttaggattgtgacattttcctattggactagttcttttagcattatgtaatgtccctttttgtcttttttaactgctgttgctttaaagtttgttttttggtgtccatttgcatagtatatctttttctacccctttaccttatgtttatatgaaaccttatgtttatgtgaggccttatgtgttaggtgagtctcttaaagacagtaaacacttggttggtgaattcttattcattttgctgttctgtatgctttaagtggagcattttggccatttatattcaatgttagtattgagatgtgaggtcctattttattcatcatgccatttgctgcctaaataccttacttttttattactgtgttattgttttataagtcctatgagatttatgctttaaatgttttatgttctattttggtgtatttcgaggattcatttcaagatttagagctctttttagcagttcttgtaatgctggcttggtagtggctaactctctcagcatttgtttgtctgaaagagacttgatctttcatttatgaagcttagttcactggatacacattctcggctgataattgttttgtttaaggaggctaaagatagtactccaaacctttctagcttgtaggatttctgttgagaaatctgcttttaatctgataggttcctttataaattacctgatactttgcttcacagctcttaaaattcttttctccgtcttgactttagagagcctggtgactatgtgcctaggcgatgatctttctccagggtgttccctgggtgttctttgagcttctcgtatttggatgtctagatctctaggaaagccagggaagttttcctcaattaatccctcaaatatgtttttcaaacctttagatttgtcttcttcctcgggaacaccagttattcttaggtttggttgtttaacataatcccaaacttcttggaggctttgttcagttttttttttttttttgagacacactttagctcttgttgcccaggctggagtgcaatggggcgatctcggaacactgcaacctccacctcccaggttcaagcaattctcctggcttagcctcccaagtagctgggattacaggtgcctgccaccacgcccagctaattttttgtatttttagtagagccagggtttcactatgttggccaggctggtctcgtactcctgacctcaggcgatccacctgcctcagcctcccaaagtgctgggattacaggcatgagccaccatgcccggcagctttgttcatttttaattcatttttcttcatctttgtcagattgagttaattcacaagccttgtcttcaagctctgaagttctttcttctacttgtttgattctattgctaagactttccagtgtgttttgcatttctccaagtgtgttcttcatttccagaagttgtgatttttttttatgctctctatttttttggagatttttccatccatatcctgtaacattttttaaatttctttaagttggtattcatccttctctggtgcctccttgggtagtttaataatccaccttctgaattcttttctggcaattcagagatttcttcttgggttggatccactgctggtaaggtagtgtgatcttttggggctgttaaagaaccttgttttgacatattaccaggattgtttttcttcttccttctcatttgggtacactatatcagaggaaacatctgggactcaagggctgctgttaggattttttttgtcccacagggtgctcccttgatgtggtgctctcccccttctccaaaggatggggcttcctgagagctgaactacagtgattgtcaacacccagcagagctactgtgctccaggctccaggctggtactgggtagtgtctgcaaagagtcctgtgatgtggttcgtcttcaggtctcatccatggatatcagtacctgctcctgtggaggtggcagggcagtgaagtgaactccatgagggtccttggttttaattttgtttattgggataattttgtgttggttgtcctccagccaggaggtggagcttttaagagagcatcagctgcaatagtatagggaggatacaagcttgccctagggtcacttgaaataggatttgagtttctcaggtggtgggtgggggggggccacagagctcccaagagattatgtcctttgtcttctggctaccagggcaggtagagaaagaccatcaggtgggggcagggttaggtgtgtctgagctcagattccccttggacagggaaagctgatgctgctgtgggggatggggtgtgattctcaggccaatggaggtatattcccaagggaattatggctgcctctgctgtgtcatgcaagttgccaggcaagttggggaaagctggtagttacaggcctcatccagttcccacacagcctgaaaggccagtctcactcccaccatcacccaccaacaacgctgagtttatttccaggcagcaagtgagcagagctgagaacttgctaccagcctccctgctgagaaagcaagcagggttttcagagttcaagcctccctgcctgctgtggcttctgtgctggtgtctgcactcccagatcacccccacccctgggttctgtccaggaaattttgtgttcggtcgaaacttcagctggaagttttcttctccctgtggtatttccccaattctactggcagccctcctgaaggacctttgtgagacaaagtcagtaatggcttccctggggactgagagagcccacagggctcttcccgctgcttcctctacccctgtatttcgctcagctctctaaattcaccttagctccaggtaaggtcaaatccttcacttgtgatccagaccttcaggttccccagtgaggatgtatgttcaggggtggatgatcccctttcacactttcacactttgggcactcacagtttttctgctgtctcctggagcctgcagcagcaatccgctttttttcaaatgtgccattttgaatattccactcacatttaaatggaaaagcctattaagatatattaggagaatgatgttcttcataggcttcaaaaggatataaaactcgtggtaaataataaaatatttgaagaaattaggagggtggggaaccaatataatgcagtggccaaaagcaaggactttggaataggatagacttgttctacatctggcacatttgtttcctgatattgggaaaaatagcttttaaatatttctcataagattggtttaaaaattaaatgagataatggaaaaatatttcttattccattgccttgtacattatgggaaatcaatgtgcaataggtcctattgctcttagcaagataaagacaaacactggaaagatttctagggagagaaaatgtcacatgcaaatgttaaaatgtgaaacagcatagtgagttctgtataaattggtatatgtagaaaggtataggaaaatgatgcaagacaggtaaaaagcagccctccaacaagctggcttttgtcataaagacagaaatggagtctccaatgtaaaaacatcagtaagtagatattgaaagattttaggaagaagagtacttgatcattccacattttagcaaaaaaaaaattctgacaattgcctggagggatacattagagagagaccatgtttggaagtaatgagacctattagaatctaataaaggatgatattctcacaaatgaaaagatgttgtgcttcctctaatattgaaaaccattaaacagaaaacgaatactttcagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaaggtacaatttcctgggtcccatgcctcatgtctccccaccataatttacagggatcattagactgttgaaagagctgctgctgtaatctctgtgaatgtacaatcttggtatgaaattatgtcactcaatcatttattgaattcatacagtgagatagcaccacatcataatctttactatctaaaaggcattcatttatataatgatttctaactttaagaggattactatcttgtattgctccagttgtagagagggtaagagagagtggccagacaagcagagacgaagacaagaatgcgttcagatcctacattcccgtttcttttacccatttcccctttgcttattagtaatatttctgattttattttcatagttccaagttcctacccccattacatattttgacacatggtattttcttgatgggtatctgtttctcctatgtcatcactggtgagaatctccttaaattttacatgccaacttaaatgttttcctctggcaagttctcgctgatacaagatactggaactgatgagtcctcccattctttgctttcacagggtctcctgtcaatgagattaaattactaatttcatagaagtgaacagagagacttactttataatgtgttccccatacttccttgatctgaggttttccttaacagggtcagcatagctcaggttatatctgtagaccagagcaaacctacaaattcagcctagaacatggaacaacaatgacaataattatatttccactttttgagcacttaactagacgttggttcttacgtgttgttcctgatgtacgttatctcattctttcttcataaccatcaggaggatgctaattctgccccaattcacagagaagaaaatagaggtacagaaaggttaaaaatcttcctcaggctttcaaagaaagttagagtcatgattcatatccagtcttatttaaacctaaaacgtgaaaaattaatgattatatatggctttagattaggagtttatatatgccatgtcagtaatttatttattagtcgcgtaacagttacatagcccacgctttgcaaaccttctgataacaaatgtggccagtggtgatcagagtgtgttctaataagtaaaccaccctccagaagtagaatcctttcattcgcctctctaacagagtgcattttctatattaaatatctgaatgacagaagtggtagaactatggaaattaaactaatattaataaataacaaaaaaggttaaaaatagtcaaaataaaggaagttatacttccttacccttggtaaagagtatttttaaaaaatcacttacttggtaatgccaaggtaagttcttcaatatttctaaatacatttgagaaccttgaaggattctagctggctgatgcagactacaaaacagcagaattctgcatctggaattgtggattttaaagaatctttctagcaaagtgatgatcaaaacatgtaaagcaacataaggctggttttcctggagcctgaagagctgcaggaaagagaaagagtaatttaatcaagtaaaatttatgtgattaaatttctcactattaattaagtatattcattgagaccctactagtctctgtgtcttttgatatttataaggtatgcgttcatgaagtgcttcctgactcaagaggattactgtcttttgttgatccaggtgtagagagagattgtggggaagtagccagatggaggaagatgaatacaagaatatgttcattatctttattccaattacctttcatcctttcactttgttcatgaccacattccaggttttattttaaaatatcgatggtcttttccaaatgagaagctttgacatatagattgcttcctttgctgggatcactttctccagtctcttcttgaacccaactctccacaggccccagcctaaatcccttcctagagcaagtcctcactggcaaccacgtttcagattaggtgagatcctcccgtagttggttctctctggtcctctctttgtgagctttcctagctccctttatttttcctaatagcatttaaacaattggggtgtgggagtaattttctccttttatataccataagctcagatggtaggtagcgtctaccccagaggaacagaatacaagaggggaaaaagtcagttcatgctatgtgcatcaattcttattccagattaccttttgctcagcagtgatatgacccttgtagtcacctgcactgagggttcagaagcctgtacctgtggtgaaggggcaggaaacttggaggaaaagcagaaggattaaatcattattttttacagttgcttcttacccaagccccaagctgtattctgacccagcagcagatacttccagccaccatgtacacatcctggaagagaagcttcctatatttaaggattctctattttgatttttttttggtttgttttcattgttgtaatttttagctagcttcagaaagctgtatttccctccatagtttatgcaggtgttgtttgaagaacagaacctgtgtctttttgccatcttggcacaggtggctgtggaaggagcccttgctcagtcattgcaacctaagatccattttctttgtgccttttcagtgacttaagtggcatctccaaacaactatgcttttatcactcatatttctttgaaaggattatgtgagaatttctaagtcccacctgctaaaatatgaatcacaacccttgctacagctgtacaaatgattgtgctgtatgtgaacttccctggagcacaggaatcccaggaggattatatgccttcatggcctcatgcacctaaacacactacgcagccatttattcttgggtgtccactatcgtctgtaaatacagttgtctgtctaactactttcctagtgactccccagatgagtatagtcttgttccactgatcatagggtttcccaaagattttctctatggtatacgctctatattcattgagatttaaaacaaacaggctattcttatcattgattttttttttctgttctgtacacctaaagcaagaaacacaaattgacatgaatcaggagcagggatgggaggggagataattgctctaagaaaaaaaattacgtagtgatttaaaatattattcaaccaaagattacatttctctcatctaaattctactctggttatgggactgttttatttaaatgaatttgagaagataatactccaaggtactctcgtgaataagtggcagaaatgaatagagaagtctctttaataaaaagcttcccataccaactcgatctagggtttctgtcaacaaggtaaacagaatatgagacggcagttaatcagaacacacatacaaatccctgcagagacagtgtaacaacagtaacataaatcggatttctacttcgtaagcacttactaggtgctggttttaaaatctgtattctttatgtatattgttgcattctttcctcataacagtcatgattgatgctattctcagcctcattttacataagagacaaccaagataaatacagttttaaaatatttctcaaaattcacaaagacagtgagtgtgctaaatgtaaattatgtgcactttatgtagtttttcttattcattcttccttacatcacccagatgatgttattgtcagtcacatttcacatttctaaacaccaaggatcttagaggttaaaactttactcaagctgataatgatttttagtgttagagccaagattcaaatccagccttaatgaactctaaagcttgagcatttaatgatcatatactgcttccaaagtcagaatatagatgttgaactgtctcatatatttacacatatttaaaattagacattgtttttgtttgggtttgttttcataatctagtctctgcaaggctcctaatgaaaaatcaggtgctgtaagtctctgtatcatcctatgttttacattgccacgttaagacccctgtgttcatctgcacccaataatcagatgctgtatcttcagtgtaagtcaaaagaaaaactagatgacaattttccaagttagtgtctcatctaggtgccaactgcactgtgaccacactgttttctaatcactcatccatgtgtaccagttgaagacaggcctcccatgtacagagttctcaatttttcatgttgttttgttgttgttattgtcctgtttgactggtaaattccaaaattctatactttctaagagttttatatgtcgtatagagctacctatcatgactgtttgccatcttgcttcaggtggatagacagaggctatgcctagtgaagtcattatctgctctgatcttctctgctatttcaaggacaaaattggacatcccaggacagtcagttttctgacgcataatgacttgaaagaaagttaatgacagtttcaaagttcccaattgcctaaatatgtgatacagcaatttctgcagccataggaatcattatgctgtgcctaaagaccctaggacagggattctagaaagaggcacgtgtctccatggccgccgatgcttaataacacagtgcattacttctgctttggtgaccagcccaaaggttgtctcaccactcactctaagattcaccagctgagcaggaaagccttgtccttactcatcatggtttctcccgaagattttgtatatgatatgcgttcattgtgcttttggattcaaaacctgaagaagacagaagcatgactttaagtcacgactcctctaaagcatagatcatataatgcctgaatcatgatcgggtatggtagcagggattatttactatgagaaaaacaatcagctactatattaaaatattactcaacgaaatctacaatctgctgaaatccaaattctgatcatctaaattctgctgaaataatgagaatatttgtttcaacttattttgaaaagaaaattactcaagacagttttatcaatgctattaggctgccacattgtagaagggaataaagaggcttttttgataatcttcctataccccctcaatcaggagctccctacaactgggtcaacataaagcattaaatatctttaaatagggcagacattaaaaaaaatgcacagaacataaaataacaataaaaatattgttctgcttattgaggatttattggatgctggtctgtaaaaactgtgtttgttacaaaattatgccatatattcgtcattgtatctccataaagataaaattttcatctcatttcacatatgagattcatgagatacaaagaggttaaaaataccattcaggctaataaaaataattagtgttagagtaaggattcatatctagttttagtcaagtaaaaaactttggtaatcatgcaaatatgtttcttccagtatgggacagtatatattaaaattctgtcatatatccataaatattcatatatgtagtgttgaattttgcatttgttttcataatccagatgccacaagccataataaggtgcataacgggcctatagggttgggtgttcgaaaccataacaagcaggttttatagcccttttttcaatctatttaaagaccagagaaatatattttatagacgggtctctatatattggagatgggtctcactctgtcacctaggctggagtgcagtggcgcaatcaaagctcactgcaacctcagacacctgagctcaagggatcctcctgcctcagcctctcaagtagatgggactaaaggtgcacgctaccaggcctggctaattttttaaaatgttttgtagagatgaggtctcgctatattgcccaggctgatcttgaactcttggcctcaagtgattctcctgcctcagcctcctgagttgctggggttacatgcacaagccactgcatgcagcttaaatgttcttaaagtctttcattagtgacattaggggaagtcacacatgattttccagacaccctctatcctttctttaacaaggtataaaaagacaggtgctgggaatgccctagtgcaatttggaatgatcctaattactgttgggaatcctgaaggattctgaatatctgatgcacacacaccacaggaccaacagaatcccgcccctggaactgtgctttcagggaatgcttccagcaaagggaggatcagtatgcccaaacagccaacacgtgagtttcctggaacctgaagtgcaaattacaggagtcagtttgtgtatttgcttgatgagaatggcttctatcactttggttaatgttgttctaaaatttgctgcccttataaactgagagggttatttaacaaaaataacctcaatggaggggcttaaccaagttggcctagatggattttcagcagaaatagagccaggactcaatcacacaccaataaaatttcaaccaacaggatgaaggctataatactggtttgtgagtgtacagttgaaggagttaggatatctaaattgacactcttcttccatagaaaataccagagagatgacagtgagaacagaataaaaggaaaaataagaaaaccaaacctatatagatacagacatggatacattaggtttttgtttgtttgtttgagatagagtctcgctgtcacccaggatggagtgcagtggcataatctcagctcactgcaacctgtgcctcccgggttcaggtgattatcctgcctcagcctcccaagtagctgggactacaggtgtgcaccaccatgccaggccaatttttgtatttttagtagagacggggtttaaccatgttggccagactggtcttgaactcctcacctcaggcaatcctcccgcctcggcctcccaaagtgttgggattacaggtgtgagccactgtgcctggccgggttctatctcattccgaaaaccacaagacagaaaagactcaatcttttcctgagaacctggaggccagaatcaccccagttgatgacttcaatagaataaagtcttctcaagacttgaaactgcatctgcaaacttctggcttcagaaaacctccaggagtgagccatcctcagacttcacagaaaattacataaaccccatccagccatttcttagccaaatcactagcttactattatcatcctttgtgcctcttcaaaggtgtatttgcattgtataatgcaataggaaccattgctgaagaggtacaaattagtacagacattttgaaaaccaatttggtgctatcttaaacctgaaaacatgcatactttaccaatgctgcaaatccaactgggcatatgaataaataaaatgtatacaaatagtcacagcagcatcatgtgaactggaaaaatcttggaagaacccatgacgtatgtcaagagaatgggtaaattagggaacatgatgttgaattgaaattaaataagctgcagatgcatgcatcacagatgcatatgaagcatataataattggaaaaagcaaatcacagtaaattttaaatagtataataacatttttgtaagctctgaaactaataaaactaaatatcatattgcttaagaataaatgccttgtgtggtaaaagctatttttagagctattcatcatgattcaagactgtccttacctctgggagctaaagctgatagaggatgagttcagagagaagcatgttggtaatcttttctttcttaaattgtttgagtgttttcatagctactcatgctacgaagtatgtagttttaaacactgaacaaaaagttttatgttctaaatttagaaatatactcctttcaataagattccattaatacatgtggcatacttaaatagagaaacatttttaatgaaacgattttcatctcaccttgatctggggtatccatcaacagagtcaacataaagcatggaaaatgtgtgcatcaggcagaaattcaaatcctgcacaggccattattaacaatggcaataattatatttttgcttgttgggcatttactagggtctaggctctaaacttattagctatgtatattatgtaacttattcttcattacaaccccataaatatgatattgtcagtctcaattcacatatgagaacactagcgttcatagttttggaataatgtttctaccagtgtgagagagaagatttaaattgtctccagtatatttacatgtgtgtgtacactaacatttcagaatagacagtgtcaggcttgggtttgtttaatagcctgaactctgcagcctttcagtgatggaggaggtccacgagagtggccagaggctgttctcatcagagagccacagcactgcagcaggctcctgcagccctctcacctaccactttttcagctaacggtgcgatagaattatattagtgaaagccagaagtgagaaaaacagtgacaaatggacatcacatgtaaatggttagaaatgggttttcactattataattaatggtattcaaagtatatgattttgcagacactctctgtcctcacttgaacaaagtgtaagaagccagctactgggaattccccaggtggaacgtggaacccctgtgattacgattgagaatcttgacgatttcagtttgcctcatatagacagcaagggcaacataatcctgactctggaactgtagctttgagaggatcctcgcagcaaagatcagtttgctgaacaaaaagatggagaggttggtgtactagagcctgaagagcagataactattacctgtatgtgtactcatttgatgagacaggtttacttataaatactcctcagtttggctgattttactctgagtcatgcccccctcatcaccaggaagagttatctaccagaaaatgacattaagtggtctcagatcagcatacaacacagatagatccaagaatctaaggccagtgaaagaaacttcagtcatctgaatcttgaccatttcagaccgaagactataatcctggtcctgtgtaggctgaaatgtgggctgaggaaactaaagttatgtcagtatctagacacattagcagagggaagagcctataaaaagggggattttgaaaaaatcatatatggagcccatacctactcgttaatagttcagacccatttttttgtcttctacttcaaagacgtaagtgaatattcctggaaaattctgatttctcctacatactggcttaaaagggacatgtgatgttttcttagctccaacccttctaaataagcaatgtgtccatttctgtagccataggagttattctgctgcacctaaacctcccttagcttagtaatctcagccaggatcatatgtcttctacctccggtacagccattttccctctggtgtccagccagccccataggaggcaaaacctgtctgactaccctctatatgatccagtagctctgcaggaaagctttattcttattgatgataggttctctcacaaattttgtgtgtgatatggattattcctggttttgattggaaacccaaagcataacaattttatatttgatatcttctgccatgtctcccttaaaataaacaacacaaaatgatttgaagtatgaataggaataattgctattttttcctgaataataaatcccccagtattactataccaatgtgttcatcctctatattccagtttctttgcgatcctttctccttcgctctctcaccatacatcagagtttagtttccgtatccatgctcttaaccacatcgggggtttggatacttcttttgatgtcaattttttccatctcagttctgtccccagatatcttcaaccacaaggtaccagtctaatctattccttgagcaagttctcactaataccctcctcccagaatagatcatattttctcattgtttgccttcataggtacctttctatttctttagagcatttatcatagctataataaacctatgactttcttccctactcagcaataaatgtaggttatagataccctttcctaggggaagacaacacaggggtgggaaagtgagtttacacttgtgtgttgtcaacacttatcccagcttgccttttgttctgccctgatatcactccctgtgttacctacaatccagcgttatggggcctatacccaaggcaaatgggcagggaaggtatgggcagggaaatactgacccatggcaacttgagggatagggaacactaagatttacattactattctccaatatcatttctcacccaagccccaagctgcccccggcccaggttgcagacctgagcaccatcacacatgtcagttgaggacaggctttctacatgtgggttttctcaattttttagacagtcatttttttggttattaatttcaagatttcatatttccccctatatagtctttcctggttcttcttgggcagaactagctgcttgtaactgttgccatcttgggacttaccatcaaggccacaggtagagcccatgtgtagtcatgaaaatctcaggcccactgtctctctgttactgcaatgacatacatagacatcataagacaactactctgtccatgcatactggcttggaagtgacactttctaagaccttgcctgcctaaatatgcagcacaatcatttctacttgcataggaatcattctgctgctctgaaagcacaagatccaaggcagactcatccacctaaacatacaccacgtagtcatttcttctctgggatccagccatcttcacaggaggcctgcaaaaatggtgtctgaccaatcagtctgtgattcgcaacgtaagccgggaatccttgctcttatacatcacagcttctcccaagtagtttttctataatagagttctttctgactttttaattcaaagccggaaacagactattacctttgatttatgctgttacgtatcctgaagtgaacagtacacaagggcataattcatgaacagggtagggtggaggaggatttattctgagggaaaacaaatgcttgcacttttaaaatattattcaaacaaagattataatttcatcatccaaactgggctattgtgatgacagtttaagatttcacttatttttaaaagattatatctcaagacaatcttgtcaataaaattacattgctacacatggcagatctgaagagaggggcttctctcctattatgcttcctatattacctccatacaaggtttccatcaacaagggcatcataaagcatgaaatatctgttcaccggagcagacatgcaaacccctaatagatcgtggaaaaataatagcaacaaagatttatttattgagcatttactgagctctggactctaaaacccattctttgtgcacattacctaaattattctttataacaccataaaaaaatgctatggctagtcccatctcacatgtgggaaaactgaggtgcaaagaaatcttcctcagggtcacacagatagtattagagtcaggattcaaatgcagccttattgaacttaaaatgttaacatttaaaatgtgaacctttaatgagcatagactgaatccacagtaggtgtgcaaatgttaaaatgtctgcagtttatttttaaacaattttgaaaatacagtgttttgtttggggtttatttccatagtccaggtgctcagtggtggtcagagactgttctaatcaagaagctgttctccatgtgagctcactacaagcagttcttttgtgtacctctctatcaacaattgccacttaaaaaattaggttactgaatgggaaaactgctaaaaaaaagtgccacattggccaaataggatgaatattttttggacttccattggtttaattaaaagtagtcaaggtatgtgattttagagatattccccaattttacttgaaaaatgtataaaaatatagctaatgggaatgctttaggtggaatattaaattcttctgaatacagctaaaaactctgaaagattctgattgcctgatccatactgtagtgatcatagaaccttccctgaggaattgtgaatttgagagaatcttcttgttatggctacgatcagagatccctaaaggatggagatctgggtttcttgtatgctgaagagcacttgagagagactggtttgtgtatctaattgatgagaaaggcctagttaataaatgtccataaatgtagccaactttattgcaagccatgctgcccccaaaatagccctaagagttgtacctgaccaaataactcagtccagttttacaggatgtgaagactgagtattccatccccagacaatgcaatttcagttatctgagtttttaatcctgactgggatgagagaaggctgagtgatagaagtatctgaatatgtggtattattcctcctgcaactcagggaaaaacagagaaactggcaaagtgaacatcctatttaaaaaagaaaaaaggaaaagatgtgtttcatctgatcttgaaaaacattaactagaaaaaaagaacaaacatctattttcctttagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacggtacaagttccctcttcccaatacattcccctcactacaatgtaatgacaaggattaacacaaccttgaaagcacctcaccaatcccctactacatacaatgctttaatttaaccaaatcagtcatttatttatcaagtgtgtattttgaggtcctatccaaaattaaaattctatttttatcatctctattccatagcaggtataattagatatctttttaattttattttccttttggcttacctttttgtttttccctcaatacaccacgaaaataatactttaaggtagaacaaggtgggaaaaaacagagccaaccataacactatcactgattctttctctttcatttattataactcaaataataccatctttaaaaatttaggaaaagaaggtacataagcaaaaataattaatttttaactatcagaaatctttatctaatgccacatttcagtacatggtctttctgactttacacctttcattatgtatatacaaagagtcttattatattctctcagagtaaatcacattacgcatatttttctataactcatgctttttattaatatatcttgaactgccattcaaccatacaatatagatttaaattactttattgtaccagaaaaattgcatggttattccatacattataaaatgatcctacattatttggcttatgttgtttctagtattctgtgaatttacaatgaacataataagaacaaatgtctctcagatcttctttcattaccctcagagtagctttataattatttccttaggtcctgtgcaccttgtgtcagggtactaatgtcatggctattgtaaggtgatttgatactgattaacttcattgggaacgggtttcctaatgttatggaaaattggccacattgatgagttttgtgtgtgatatgcgttattcctggttttgatttgaaaaccagaaggataacatttttatatttgatatcttctaccatgtctccctttaaataaacaacatacaatgatttgagatatgaacaggaataattgctattttttcctgaataacaattccaccagtattattattaccaatatgttcatcctctacattccagtttctttgcaatcctttctcttttgctctctcaccatacatcagaggttagtttcactatccatgctcttaaccacatcaagggttttgatacttcctttgatatcaaatttttccgtctcaattctgtccccaaataagttcaaccacgaggtaccagtctcatctattccttgagcaagttctcactaataccctcctcccagaatagatcatattttctcattgtttgccttcataggtacctttctatttctttagagcatttatcatagctataataaacctatgactttcttccctactcagcaataaatgtaggttatagataccctttcctaggagaagataacacagaggtgggaaagtgaatttacacttgtgtgttatcaacccttatcccagcttgccttttgttctgccctgatacctctgtatgacctacaatccagcgctatggggcctacacccaagacgaatgggcagggaaggtatgggcagggaaatactgacccacggcaacttgagggataggaaacactaagatttacattactattctccaatgttgtttctcacccaagccccaagctgcccccggcccaggttgcggacccgagcaccatccacacacgtcagttgagaacaggctttctacatacaggttttctcaattttttagacagtctttttttttagttattaatttcaagatttcatatttccccctatatagtctttcctggttcttcttgggcagaactagctgcttgtaactgttgccatcttgggacttaccatcaaggccacaggtagagcccatgtgtagtcatgaaaatctcaggcccactgtctctctgttactgcaatgacatacatagacatcataagacaactactctgtccatgcatactggcttggaagtgacactttctaagaccttgcctgcctaaatatgcagcacaatcatttctacttgcataggaatcattctgctgctctgaaagcacaagatccaaggcagactcatccacctaaacatacaccacgtagtcatttcttctctgggatccagccatcttcacaggaggcctgcaaaaatggtgtctgaccaatcagtctgtgattcgcaacgtaagccgggaatccttgctcttatacatcacagcttctcccaagtagtttttctataatagagttctttctgactttttaattcaaagccggaaacagactattacctttgatttatgctgttacgtatcctgaagtgaacagtacacaagggcataattcatgaacagggtagggtggaggaggatttattctgagggaaaacaaatgcttgcacttttaaaatattattcaaacaaagattataatttcatcatccaaactgggctattgtgatgacagtttaagatttcacttatttttaaaagattatatctcaagacaatcttgtcaataaaattacattgctacacatggcagatctgaagagaggggcttctctcctattatgcttcctatattacctccatacaagatttccatcagcaagggcatcataaagcatgaaatatctgttcatcagagcagacacgcaaacccctaatagatcgtggaaaaataatagcaacaaagatttatttattgagcatttactgagctctggactctaaaacccattctttgtgcacattacctaatttattctttataacaccatacaaaaatgctatggctagtcccacttcacatgtgagaaaactgagatgcaaagaaatcttcctcagggtcacacaaatagtattagagtcaggattcaaatgcagccttattgaacttaaaatgttaacatttaaaatgtgaacctttaatgagcatagactgaatccacagtaggtgtgcaaatgttaaacaattttgaaaatacagtgttttgtttggggtttatttccatagtccaggtgctcagtggtgctcagagactgttctaatcaagaagctgttctccatgtgagctcactacaagcagttcttttgtgtacctctctatcaacaattgccacttaaaaaattaggttactgaatggcaaaactgctaaaataatgtgccacattggccaaatagggtgaatattttttggacttccattagtttaattaaaggtagtcaaggtatgtgattttagagatattctccagtcttacttgaaaaatgtataaaaatatagctaatgggaatgctttaggtggaatattaaattgttctgaatacagctaaaaaccctgaaagattctgatagcctgatccacactgtagtgatcatagaaccttccctgaggaattgtgaatttgagagaatcttcctgttatggctacgatcagagatccctaaaggatggagatctgggtttcttgtatgctgaagagcacttgagagagactggtttgtgtatctaattgatgagaaaggcctagttaataaatgtccataaatgtagccaactttattgcaagccatgctgcccccaaaatagccctaagagttgtacctgaccaaataactcagtccagttttacaggatgtgaagactgagtattccatccccagacaatgcaatttcagttatctgagtttttaatcctgactgggatgagagaaggctgagtgatagaagtatctgaatatgtggtattattcctcctgcaactcagggaaaaacagagaaactggcaaagtgaacatcctatttaaaaaagaaaaaaggaaaagatgtgtttcatctgatcttgaaaaacattaactagaaaaaaagaacaaacatctattttcctttagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacggtacaagttccctcttcccaatacattcccctcgctactatataatgacaaggattaacacaaccgtgaaagcacctcaccaatcccctactacatacaatgctttaatttaaccaaatcagtcatttatttatcaagtgtgtattttgaggtcctatccaaaattaaaattctgtttttatcatctctattccataacaggtataattagatgtttgtttaattttatttttcttttggcttacgtttttgtttttccctcaatacatcatgaaaatcataccttaaagtagaacaaggtgggaaaaaacagagccacccataacactatcactgatttttcccctttcatttattataactcaaacaatatgtttaaaaatttaggaaaggaaggtacataagcaaaaataacttttaactgtcagaaatctctatctaatgccacatttcagtacatggtctttctgattttatacctttcagtatgtatatacaaagagtcttattttctctcagagtaaatcacattcacatatttttccataacccatgttttttattaatatatcgtgaactgccatgcaatcatacaatatagatttaaattattttattgtactagaaaaattgcacagttattccatacattataaaaatgatcattttttatttggctttatgttgtttccagtattctgtgtatttacaacgaacataataagatcacatgtctctcagatcttctttcattgccctcagagtagctttataattatttccttaggttctgtgcaccttgtgtcagggtactgatgtcatggctattgtgaggtgatttgatactgattaacttcattgggaatgggtttcctaatgttatggaaaattggccacattgatgagttcattagagttaagtccatcagagttaaagccatcactcacaggtggccaatatcatcttccaggtcagatcacattgctggtctgtggaggcagccgtcctgcctccatgttctggtctctaagactcccttgatcccttcttgcctccatacctcctcttccagatcagcagcccctccaagtcaaagtgctctcctacaactcagaaacagtgcaggccactgtggagacaggaggttaaagaaaagtcccctcccgcctaatttttcacgtccatgactctttttagttcctgccattattcagattggagagcctctaacctgggccccttcagattaggaaagtttgtggagtcttccagtggctgccttaatgatgtttttgcaacatagtgctgcttcattagaaagggctttgcaatttggttctttaaaatgcccctatctactagaatgagttccaactgaaatctcatgaaatctaaggtttgtggttgagactattccttactctgaatgctagtaatatgatttttttctctatttttattttatttggtcactgtcatattaggcaggagggaacttttctttaacctcctctctccacagtggcctgcactatttctgagttgtaggagagcactttgaattggaggggctgctgatctggaagaggaagtatggaggcaagaagggatcaagggagtcctagagaccagaacatggaggcaggacagctgcctccacggaccagcagtgctcaatatgacctgacctgggtagaaaggagtaaaactgagattcttctaaaatctcatctcttttgggagtcacttcatggcagctttgcctttaccctctgcttccccatacctcttgataggggatatgccttttctttatgggttaattctcattaaaaaagaaatattcttccttccactctcataaaacaatgaagataataaaattactccttacatctttttcatttcttccgttacctaaatcatactatctcagtgatctttgtctagttttccctactttacccagttaaggtgatacttgaggaccaacactgaggctgagatgactctcactagagaatgaccctgtttttcctgttttaattgtgcctatgttttggtctctaccttctaagttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataaggtaagcccacaccattgttttataaaatttctcctgcaacctccaatttttaaagtcttaacttgtcaactggagtttggtcaacttactcaacacagaaaatcaaccccttcacccttcccccagcactagagataattgaatagagttcatttcaggatatggggtacgttatattgtaacattcctcttcttaaggtatcatcatgcaagttatttagacagtcactaggaaacttggcattttattagttttgatgatctattcagagccacccttgtccaggacagtgcagagtttatatcaacacacatatccttaggattttgtttctttgagttcttctccatctgtatcaatgacaacttaatttaattgtgaataaaagagttgctctcccaagcctgaatcctgattgtgacaaccagagtaagaaataaaatagactactctgctttagaatgcagctatgtctaacagttagctagaattctgatcatttggactccaaagtttcttgcctcttctcattcattaattcatcaggagactgtagagcaactaacttctgcattaaataataagagaaatacgaagcaaaaagactaaaaaagtcacgtagcttaactgctcaatttataaatggggcaataaaatgcaaaaaaaagaaaaaaagcttggtgaattcttaggcttacagtgtgcctttcagtctctacacatcatgtaaatattatgcttagctgatttaacttcttgtttgaagtactgtttcatactccattatacatgtcttctagggtggcttacttttaattgtgctgttttctctacactcagtttaaatgactgtacatatatatgtggttgtagagttaatgaataatgagctacaaaccagaacaatgtgactagatagataggatgatctagatttgagatctgggcagattgggaaagagtgactatatggagaagaaagaagtagttacatattgaaataacagtctacttaatgaggacgtgcaacattctttctcaaacttacaaagtgccataaaaagcctctattctctgctcttgggcaggtgtgaaagaaacctaccaaattaatcagatttttctgtatccaggctccttaaaaaatcccagctgtgctgatgtggaaacaggaagaattaggaaagtaatcaattttttttcctagaaaaaatccagcagacaaagaacttcaacaaaagaggctcaagggaggagttgaaaggcaggattcaaagaccaagtatcttaagctatttggtacctgttattcaggacctacagctctgtttactctatcaaagacaaaagtttccagaaacaccctgtatttctcatagatttgaaaattattgatccagtttcagaagataagtgttaattttcttttgcagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggttggaactttataggaacatcatttttccaagtggcgaatcattttgtttatactttaagaagactagactgctactattacagagagtctagcaagtggaaaaggaacaaagccttgcactttactgggtgtaaacttcccaccattgtttttaaagaaggatacttgtaatcataataaaaaaaattacagagactttcaaaggccatgatacctaagttaaataagaaagaattggttgcttttaccacaatgtggagataatttaataagaatttgggtttggttaaggcacatttgtttcaactagctggttctgtgactttctagttgactaaagacttacactaggaatctcaggttcatcatttgtgaaatgggagaaatactgtctaccatagagggtcatcaacttagctcacagcagccctgaattaccaagaatgcatctgagcaaatcagatcacaaaggtacctgcctttagtgagatacatacactggtttacatcagacagaggtagctgggtctacataacaaagtccatgctttttgccacactgacccatacattcatgtgggattcttggaacactaacaaaggctaatattagaaggcaaatagttcaaaacaaaggctgacatattcaggcacacacatgctctcagattgctccagttctcaggaccagcagtcaaacatttcaaaccttctttgatagcaattgcaccaggaataccttttgtactctcccccttccttctgcccaatgaaaaccctctcctcaactcttgtcattgggtgcaccagctcctttctctctcctgttgttccctgacatctcctgctctttcacttgcactcatgctgagtaggagtgaatatctcatttcacggtccaaattaaacagagaggcatgactcaaaggtcaagaatttattaagggagatagatgagagcgagaaaagaatcatttagaaaggaataggggaagagatatggtgcagggggaggagatacagtgtgattgaagggagaaatgtaggatcatcagcatctcaactggtctgtctttatctctttctccttcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaggaatgcttccccagcagtctctttaatccatccatgagttgcttaaaagcaaatagtctgtggtctgcaaatcagggtggggcacacaggcctcaagcaatatttggatttatactttgggtgtgatctttaccgggtaaagccctgatcaagaatgaacaggctgtgttctgctgaaagaaaccaggctaaagggataagtaagcgtgaaatccagtttgtggttcagttgccaagtgctgtgttactgttttagcccagagcagtagatatcttttcagaattggtctcctggagggggcataattgggtaatttttctgccaaatgaggcaccttctggtgatgtgcatgaaggcacttgtctgtgttagaggaatatctgggcctgcctgatgtgaaatatctggttttatgcatttcctcaaaacaccgactgctcttcacgcactttcaaaccatatttcctgttctcgcaatccactatagtgatctgatacattagaaagctgccctaggaagagctgcattaggcaaacactgaagataattaattttattcagaatagaatagcagaaagtaagtatctaaaactaaaatttagctaaatttattgattatatatttggtacctggtacttggcaattattttgtgacacttaatcttcatattagttctagaaggttgattgttttctcctctttactcaccctataatatgtgacaaacacggaatagaaaggcaaagtcactttcttaatgacccttagatggtaaattagagagcttgatttagaacccaggctgctcttctcgtttggggtgtgtacgttaggagagggttgtggggatgtggtggaagctgtgaggaatggaatggggaagtctactactgttgcaggaattttcctttgttcagctaaacatgggaatccttatcatggggccatgaaaagttaggctcgcagacaatttgaagtgtgaggagggcagcgtttattgggtgaaaaggaaaagagggaaacggtccttctgcaaagccagactccctgcttgtgggcttcccacctggcagtttgaatttcaggttccacccaggaagaggaggggctgggctcttccccactggaaatggcgcaaacttctgtggcttcaccccagtgcacactcctcccagtgtgcaggctggagtttctctggggaccccttcccacctggctgtctcattgccccctctaaagaaatgcatctaactgccattagaataaggataaggataaggacaaagaccgatcttaactgcttcctgctgacagggggtgctgtttcggcaaaacagcagtcaaagtccctcagaggcctatttaagggttcccagcagaatgggccattgtccgcctctccagttgcatgactggagtttgatggcctgaaggcaagaagagacaaattgtgttattagaaaacatgtatctaaacaaggggaggggtaaggacagctcaaaaatcctgaggccttttatcagtttgcacaaggagagggaggccaaaagcccaaccggcaaaaaaaaaaaaaaaaaaaaaaaaaaaaaaaactaccctttagctgccatgttgggcttctgggttcccttcccctgagcccaatcctaagctgaccagtttaaggttttaaactcttcccagtttggaggatgcatctgacgggagtgtcccgtagtacggagacacaattgcctatcagtgaagagagaactgaggggggagaaaggaaaaatgaaaggtgttttttcaaaggagtcccaaaggttcaggatgctttcaaaaggggtacagattgaaaatgaatggttactcatctaaaaagaggggagcaggcatccctggttcccgtctcttcctagcagatacccatggtacatgagggagagaaggaagagcatcctctttccctcttccatcctcacatccccaagtcccagcaaccttggcagtcagcacc

SEQ ID NO: 14727 - DNA, 8035 bp, Human
ctagatgtgttgaagagacagctagtctagccagaatggaggattcaggtagagaagttttgagagataaagctgggaaaatacagaatagtcaaattgtggagagaccataactgcccaaccaaagggcttaggttttctactaggggctcaccatttctcagcatatgttctgtggactactggcgtcagaatcaactgtggtgcttgataaaaatgcagtttcctggtcccaacctggacctactaaatatggatctatgtagtggggcctggaaatttttatcttttttttttttcccttaactcaggctggactgcagtggcacggtcacagctcactgtagccttgacctccccaggctcaggtgatcctcccacctcagcctcctgagtagctgggactacagataagcgccaccatgcccggctagttttttgtttttgtttttttgtattttttgtagagacaggattttgccatgctgcccaggctggtctcgaatttctgtggctcaagtaatcctcccgcctcagcctcccaaagtgctgagattacaggtgtgagccaccatgtcctgcttttataatttttaaacaatcttctcatctgatgtttatgtacacaaacatttctgaatcattgttgtatgtattagggaactgttcaaccggttttattttcccttaaagaaagggtggtatgaccaaagacagtgatgtatacaagatataagaaggattcagggctaccgaaaaggcactgtagagtctaggtatgacctgataaggatctaaaatagtactgttgacagtaaaaacagggaaaaagaaactgatccaacaatatgaaggaaggaccaacatgattcaaagtctgatcaggactgagaggacttaaattaaaatgatgtgttgtatactaagcctctgatattagaatgttgctatcatgaacagaaacaagaagactgtcacaggcagcctcctttaaagaaaaaataaagttctttttatttcattaatttaattaatttttaagagatggagtcttgctatgttacccaggctggatttgaactcctgggctccaccagtgatcctcctacctcaacctacctagtagctgggattacagatatgtgctgccatatccagttctttttttttttttttttttttttttttgagacagagtcttactctgtcttcctggctggagtgcagtggcatgatcttagctcatgcagccaagatctcatgatctctgcagcctccacgtcccgggttcaagctattctcctgtctcagcctcccaagtaggtgggactacaggtgcatgctaccctgcctggttaatttttatatttttagtagagacaggttttctctatgttggccaggctggtcttgaactcctggcctcaagtgatctgcctgcgtcaaccctcccaacgtgctgggattacaggtgtgagccaccgtgttcagcccatacctagttcttaaagtctgtttcagtcatgttaaacttgaggtgatgacaggatgtttgacagttgtgtgtgtgtgtgtgtgtgtgtgtgtgtgtgtgtgtatacacacactacaccacacgaaagcattttctgtcccatataatctaagtttactagatattttctcaaataattgctgcagttccacaattgttacattatctgatcagtatcccatggactccaaactcacattttcaaatcagtctgtagatttcaaataagtcttttagagaagatttgaaatggaagataccatttcaaaacctcttttgaatgacactaaagcatgtagcaggcctatagaatgagcatactgtcaaaaggcattaagtggaaaaccctccctgctctggaggcggggattggttctacaaagcctcctgtcatgccagtggccaactagagaagttggagctttttcgttgtttttttttttttccctcctgtgacatgtgctttagttgcagtggaaaggaaatgtgtcatctgtggtttggttttaaaagtggaaaactagctgcacatatccttttttactgcagatttactttaaggctcatattctccaagtctattctgctttaaaaagaagacaagaaaagaagtggtttatcaaaatcacgttataatcagattttgaccaagcattttgtaaggtaggtcatatatatacggcttttcttatgccttttcacttctaacgtctgacagattagtgttcgaggaaatgctatcaaagtgtgtaagaatctcactaacaaactagaattgtgactgaaaatgtatactttttttttctgtcctgttacataaattttaagttagaaatgaaaaaatttgccatcgccatggagttttaaattaggattacgaaggatctaagtttggtttcctcaagtaaactggaaatgttttgttatttttcaaaagttaaaaaataaatttctcattactaatgcttggacattacaaattctactgaaaataaattctactgaaaatgatcagatataagaaaacttctgataacacaacctggcctccaaggcataaactggagtaaaaacagtcctcaattctcaggcatttgtaagggcaagagaaagtctcattttgtcatacagtttgtttatttgggcactgcagtacatctggctgaagacaatcaacagcaggcctattatctgttccgtggtaagcactgttaaaatgtgtaccaatactatgatgtatactacactgttaatgaactaatgtgaacagaataatctactttaaatcattctagcatctaatacagaagtccagtctagtataaaaagatggaaattacttgctaatccaatttcaagtatttctttttgtggaagaatcatgaaatatccaaagatttatgtcactaaacttaaaaattaaagctgaacactattatacaaaagccagtgacttgggcctttaattgtctactaaaggtcataatctaaaaagtaatcttaatcctggaatatttaatagtttttcctccctactattaatatgaaatatagtctccagttagcattgtttattacatgctacttttgtttgcataactcaacgtatcacatttcttattttcaatttctgtattttaatagtatacaaatgtcagccaatgacatataacaaccatttcttataaaaccttgatgttcaaaagcctgactagcagtggcatccatgttgcttaggagttggtttggaaacaaagactttcaggccctacctatactagctaggtaagaatctgccttttttttttttttttaaataaaaggactcctaagtacatttgagaagaatttctatagcatacgtagggttcttaaccaggcaatttcatttagtaaatctcaggagaacaatatagttttgcttttagttcattcaaataaatgctaacaataaaatactcctttcaaaagtagctcaagacaaactggtatattattataagataccttaataatgattataaatctttcctgctgggttagcagtacatggaactgttaaattctaagatatgccatttctatttaaatcaatcatttggtagatttaaaaaatgtataatataacttgtctcctttttgtactagtttccagcaagctcagggccaaagtggaaattcaacattttcaattatctgttgagatgcttataacctgccacttcatcccaaatcatcaagatcctgatgctctatttctattttattacacatttttttttacaattatgtcaaaatcagaaaaaatgctaggtataaatgatgctttaaaagaaaacccagcaacttttgttgaacttttaagtctactcagaggaaatttgctgtttttttttttttttcttcagatttttaggttgagaaaactggtatgcctttgccttcagaaagacacagtcagtccagggaaatataaatgaaaagagacaaccaccacagtaaaattgcgttcacaaatacacttacaaatgtatttctaagtaccagctttattctaagcttcaagatgaacacccaagaaaaaaaaagaacaccttgaatttctatttgaagttcagtttcttttggttgctaccaaacttcccctctttccaccaaaaaaatttgcatttatttcatacatgaagcaagaagctcaaggccacatttcttctgtaaagattggtgacaggttagagggtgggtagtttctgtaagaatgatccttaatttttttttttttttaaagaaggaatcagaaaagtaaaagcagaactaactgactcaaagcagaagtctagcacgcttcaaaggaagaaaactatataaagccatgatagtccacttaaaatgattaatatttatttgtaatgctaacttctagcatctaaaagtgttaatagaaattaaaatgcttcttcatacatagctgaatagaaaagaaatttagttgagaaggaattcagggtagcgaatattaggcataagcttgtagtttacttgtaacatctcaacactatcttttaactacaattaccaaaactaggatccattattctttcacaaactaacaaattatattgctatcccaacagattgccaagtatgcccacggacatggaacacacaggacattacctacatcttgcctttctgatgacaacagttttttctttgtctcctggaacaaaagcaaactatacccgtctgtgggctaacagtacttcttcctgggattcagttattcaaaacaagacaggcagaaaccaaaatgaaaacattaacacaaaccctataactcctgaagtagattataaaggtaattctacaaacatgcctgaaacatctcacatcgtagctttaacttctaaatctgaacaggagctttatataccttctgtcgtcagcaacagtccttcaacagtacagagcattgaaaacacaagcaaaagtcatggtgaaattttcaaaaaggatgtctgtgcggaaaacaacaacaacatggctatgctaatttgcttaattataattgcagtgctttttcttatctgtacctttctatttctatcaactgtggttttggcaaacaaagtctcttctctcagacgatcaaaacaagtaggcaagcgtcagcctagaagcaatggcgattttctggcaagcggtctatggcccgctgaatcagacacttggaaaagaacaaaacagctcacaggacccaacctagtgatgcaatctactggagtgctcacagctacaagggaaagaaaagatgaagaaggaactgaaaaacttactaacaaacagataggttagtgaagaaaaatgcaaagtagcaatgagaaggcttatggagtaaaaatgaagtcagttggtatttaatcccaaagtgttgttctgattatctaaaatttgacatggtagaccttgcaatttagaatcaagcaggtgagacagggagaagtatgcctgcttaattatttaaactgtgtacttttgttttgacactgaatattttaaaaagcaaataataaaataactaagcatttgaggaaaattttaaggataaattgaggaaactgattaatagagatagcaagggataattaaataaatattccctatgtagcaacagtggttagatgatctttgtctgaatgtaattaaactttgaatagttttagtgtgtccttaaagccaagtatatgctttaacatcaaatggaagtcaaattcctaatgcatagatagagagagctaaactgtgtaatttaatggtatcttctttgctggatgtggcagaatccacaccagcttatcaaccaacacagctaattttagaatagatcctttatctttccatatggcacacgtaagaaagtgtttttctactattaatattaaattaaaacctttacttttgtataataaattaaaactcagaataaacctgtgaccacgtatatttgcattcactttattactttagagaacacattgtaaagatcaataagaaatagagcacaactaaaataaataagatttatagccacaccaataggctaagtgtaaacgcaaagtatgtttcactgtttatgattaataatattcatcttttctataaatactacttactggaacattaacaacaagtaccaaaggttgattaatttttggacttcaaggatgccaagtagcctaatgatttattaggggtgtgtgtgtgtgtgtgtgtgtgtgtgtgtgtgtgtgttcaaatctggaaaactgcatacttcaggttataatttaacctttaaagaaactggcttcaagtaaaataatgacttacatttaagttgagaacccccccatcttcaattaaatatattacaaaaattggtttgagagactttccaaatatctactgaaattaacacagggctaagatcaggccacatttcaaaaatctcatcccttactgggcatttatttcgggcaatatagtaaccattttaaaaatattttttatatgttttttcccaagtatgactacaatcttactctcccttctaagctagtgattcttaccctggctgcatgtcagaatcacctgaagagtttttaaaaaacaccaatgcctaattcccatgtcttccttctgatgcaactggaatggggtgaactctaagcattggtaatttttacgtaactctcaaggtgataactgctcttggtcatcaaattcaaacgtctagctattattaaaatgagaggaaaaaaataaagcatcatttttattatcaatttattagcaatttgtaaaaaacaaatctattctctaaacgagaaatcataacaatattattccagataaagttaagtgttaacaaagtaaaaaggaaagcatgagaatattcatgccagtcatggtgactgaaatcaggttatcttttgaggggaaaaataacccagattagaaatgaaactgggcagacttcccattctgtgcaaaaattgaaaatttgagattgtgcaccagtacatccaggagtaacacaaagcactccttgaatcaagggtcataaataaacacttgtcagagaaaattaaaagaaattaatatcatcataaaaataggaaattactttcatattcaacatactggtcaaacattttctcaccagagagcttctaccacaaggatatttaaaagaatatttaaaattcaccactcactatcttggctattaaacatatactctcagaatggtactatccaatgatagttactgaacaaacagaagtgtttcctttccaaatgacaggtattttaaaatggtaggtaagatatctttgagttcaaaatttaaaagtcatttagttttgaacaaaaacacattccctacccctgggtattacagttcaccagcttaattcagggatttaaaaatagtgaatcaggttaggcacagtggcttacacctataatcctgggaggatcacctgaggccaggagtttgaggccagcctgcacaacaaagtaagagcctcatctttacaataaataaataagccagccagcgagcatagtagcatgtgcctgtagtcctagctactcgagaggctgaggcaggaggattgcttgaggtcaggagttcaagaccagcctgcgcaacacagcaataccctgtccgtaaaaacaacaatacttccaaaaaccagtgaatcaaaagctttatagcatttgattatattatgctttatagtaggagcccataaaaaaaaactattctttttgcaccaagctataagtaccctgaagttaagaacaaggtcataataacctgtgtttcccgcagtgaccaggaaaaagcagtgcatgggttaacacattccgtacctactataatatgcatcatccaaggcactttacatttatttaattccacaataagcttataaattaggaattatgatctcc

SEQ ID NO: 14728 - DNA, 12152 bp, Human
cataaagtgacagattacttggtggtcttttcttggcatttattgctaaaagaatcctcttggtgacaacaggccagtcttcaaccaactgaacagtgagcatctatgtctgtacagttggtaacatgtttgaaatgtcttagatcattgtggaaggtcaaagaacatctaaacaaaagtttaagagatacagatagttcataaactatatttactggtaatcacttcagatgcaactgaacttaaagttatctcaatggttttgtttttttttttttgagacggagtctcactctgtcgccaggctggagtgcagtggtgccatctcggctcactgcaacctctgcctcccaggttcaagcgaatctcctgcatcaagcctcctgggcagctgggactcctgggtggcgcgcaccaccacgcccagctaatttttgtattttttagtagagacggtttccccacgttggccaggatggtctcgatctcttgacctcgtgatctgctcgcctcagcctgctaaagtgctgggattacaggcgtgagccaccataccaggcctcaatgttttatttttcttttgtatcctaaatagaatctttaaacacacgctacaaaaaaataacacctggtgtttgagacagcactccagtctgtggtttcccaatgcagcagttaataaaaaagcaacaattttttttttttctgaaactgtttcggcctaaaacactgcttattcctcaacagtctccctcacagaagtaattattggaccatatattccctaaaatctcttccagcattaacataccacggttctaagagttcagtgatatattttacaactactgtaaaacagatcattctttgaatagatacttgtgtttaatcttacaaatctgtaaagtatgaatgacgttttagcattatacagtcaacaaagcaccaaaggtgaaataattacaataccttttgggaaaagacaatatttattgagatagctttcacattctttttacatataatgtcatttcattccgaaaaacaactctacgaagctgtataatttactttgaaataaggaaataaagcctcagtaacttaagtggcttgcccaagaataccgtaagtagcagagccagaattcaaaccctggttttaaccccaatcattacatccgtatgaattaagtaaaatgctaaacttacgatgtacatttttgcgaactgatataaactgttgagtaaataaattagattttgttgaccagtgcaattacacatgcttccctaataaaaaatttgaaatccattaatgataaaattattaacattaatggaaaacatcagcgcattcggagattgactacccgaaaagaaataggaaacatctgcccttagtgctgtgacataacacacatatttccgtggatgaaagaaagacctactggctgagcctattttgtttggttagaccctaccctctctcctaaaaactcctttggtactcaatttcaagcaggaggtaataaattacaacggaaatactaaagagcaaactttccggaaacacaaaaataagttttattttaaaaagtacaataagcattaattctccagagtaaatgggtaaccgagcagacaggtgtaatcttcagccagcaccttggcttcttcacaatctccttcagaaaaaccgattcaagagctaagaagccagtaaagtcaaacctcgagaagatcccttctccagcgaatcagcgcccctgctccccgcccgcccggctccgctgggtacgcgacagcgacctccgcgcctgctctccgcctcgggtcagcggggctgggggttgggggtggaactgaaaatgcctgttggccaaactcgggtcacagagagacacgcctgtacggggcgggggtgtgcgggtgactcacgccgggtgcacagtagctcctacgcctcacccagtatctcccctcacttccctcaacccttcccacaaactgggaggaaaactgagacctcctggtcacccgccgccgggccttttagaaactcccacaagctctgccttccctccctggtcctcttcagaccccctcttagttcttcgcggctaacggtaagctctctccttacctctccctaatcggcccctctggagaggaaaagaaaacttaagagtcgggtcgcgctagcctccagcagccgccgcgcccaccgactgctccgccccttctcctccccctcctccaggctcgcgctcggggccgggtgtggagctggaacagagggctggcaaggcgcgcatgcgcaccgagggtggagccgctgagcacagaaccggaaacttagagacaaagttcggagccccgcccccgccgcgcgccgctgagttgtctggccccgccgacccacggcccacgacccaccgacccacgaatcggcccggccgtcgcgtgcaccatgtctggctcctccagcgtcgccgctatgaagaaagtggttcaacagctccggctggaggccggactcaaccgcgtaaaagtgagcgggggcgggcggccgaggcgggaggaaggcggcggcggcgggtgggatccggcggcccagctggcgggggcgggcgggacacgcgccggccctcgcttcccctggagaggacgcgcgctcagcggcggcgatcggggagcggccagctttagagcaggcgccgcgtgggtctacgctgtgttttagggggacgattagttcgcccttccgccccaggactttccgaggcgggctggcccctgggttgaaccgtggccgacattccggtcctcctccgtctctacctcccttggcagccttctcggctggtctcaccaacagctgcgcctccgcgcgctgtccgcacccttcctttcccactttgccagcctcctgtttctcatcggacagggtattttccgacttttgattcagagcagacttttctcccatttgatctttcccaaacctacttcctttagtattaaattcttaccttcaacttctcttgtccgttgaacacatacttttaagcgaattattgcataacttaaactgtggattgaataagcatttttcgaaacgatcctggagtgtaaagttccggtcagtgccccgtacaacctcgaacaaagcgtgcatttcatacctatggcacagtttgctcgtatttgaccttggggatatcgactggtccgcatgccggagaaaatgattattgtgggtaattattggtcttattttggcgtctggttagtattggccttgtcttggggtactttgggagaaaaagccttttgtctgtgttgatagaataacttgacattcaagtgctgttctaagtatttcctgatttttacagtcctaaatggattggcttctttctggtacaataggtcaggctacatgtgaaacacttctgcagttaaaaaaagaaacaagaatgtaaatcatgtgccctgttaaaagcagccagttcctaagatgatttgattttatactcatcaggctagtctttattacttgccgaaatgttttgtgaactgagagggtctctaagctttcttaactagaagtgtcagagacctagcttactcagttgtggtcacctcagaagggaagggaaattctcattcgtcttggtgcaggatcctcctgagagagagtctcccatttagttttgttaactagaaatgtcagggacctagcttactcagttgtggtcaactcagaagggaagggaattctcattcgtcttggtgtgggatccccctcacgtccagtccttgaaatgctgtagacctcactgcagtttggaatccatttctctactctcccaattcttacctcatcacagtggtttctagtcagtcttggctggatttggctctgaaactcgaaatcatttatttcgtaaccattaaatgtcattcaggtgtgcctttatcatagataggatggaccaagaaaaaaaaatgggggtgggatagtgaaagcaataaattgtacatctttagtctccaaagaaaatgacatgaggttctcaggctaaaatactccaagagctttactttgaaaaccctagctgctgctcccctaattccccaaaactgatcctacctaaatcttcagtagacttctggttctggtcgggatcattaaaggcaccagacatgatttggttttggagttattgcctgatgttaaggctgtagcaagaaggggagcatccccttttgtactttttaatgagcttttctttagacatgttgctaaatgtggtttaacgttgtgtatctgttttatcaatgactgggctaggtgatttttttgtgagatttttaaactagcacaatcttacttttaacctttatgtgtgagtacaattgatagaacttaccataagtgcttgacaaactgtcataggtaggtcaggacatttttgagagtgagaaggggcactaataggccaggattacagggtttcaacctcctggatggtgattgttacagtgccttaggggctagcagcttgttccagttttagagtctttgtctcagctttcctcactgtttggaatgctgtttctcactgatggttatttggctggatctcttgtcattgagatctcagcttcaatgtcacctcagacaccttcccttaggtgggcacccagtcaccatctaaaagattattcattttactacagagcaccttgtctgtcattttctctgaactgttagctccataacaacagggctctggctgttcttatgtattcttagtgcctgtaagtatatgcggcacatagtggtgcttgaaaattgtgaaagcgagttacattggaccccacctacactttaaacagaaaattaacaggtactctttatgcttcctgctggttaatatgaatgaaaacactaaacactattacaatatttggtgaaaaatgacaccattgttcccctactttagctacacttcttttggaaggcgggggatgagggggtgtagtcatttgtaaaaatacttcttttacataggagctaataaacctatggaactcattactctggactgctgtataagcaaaacacacaaatagattcgataagcgtttagattcatcttaggatgaagaattattaggttggaggtacagctgtaatctgcaggggttcttggtatagagagcatttgtgatgctattaattccctgaggccacatatccagctggatggactggacacctgctcccagcctccttgcggataaagactgagaataaaataaatgagtatttctcccactttttaaatctcagttcaagacttcagatattagatgcatttggggcatgttttagtcattcatgttccacgtctgaacgggtccgttaatgttattaaactagacagtgacagatttctgcccagtgtcacgtgactgaaaggctgctagcaaacttcaatttaacagtttttctgagcagcctgcctttaagaaactattgccttaaatatgatttaagtgttaatatacatatacagagccacccaaacaggacttaaggaacttcaatggctttatggttattttgtttatatcctacatcaccttagcagaatatatagaaatagtagatgtctaagtgaatgaatgcatgcctcttttaatttgttttagtttaaatgcaagacagtataagggtctgataaatttgaggatcagtatactgaatgcattcttagtgttggcttttctaaattatgtgctagttatcccacattatgttcattcacagtagcatttttccagtaatactgctttcaagacaaagtaatagtttgctagaatgttattgctttttgtttaacccttaatgtttttaataagatgttaagtaccctcaggtttgcacttgaacagcctattattaataagcaagatgtgctacgctttgcaaaaatcaacataattctactgtttgtactcagtcatctgatgcttctagtaaccaagcaaaagaaaacatacttaattaaatcagtcttatttgcaagcactagttttaagtattaagagctcactaggctgggcgtggtggctcacacctgtaatctcagcactttgggaggccgaggtgggcggatcacgaggtcaagagagagagaccatcctggccaacacggtgaaaccccgtctctactaaaaatagaaaaactagctgggcgtggtgacgtgcgcctgtagtcccagctactcaggaggctgaggcaggagaatcgcttgaaccgaggcggaggttgcagtgagccgagatcgcaccactgtactccagcctggcaacagagtgagactccgtctcaaaaaaaaaaaaaaaaaaaaaaagagctcactatttgacttaagtcttcaattattatatagtatcttcttttgaagcaagagaagtactgttttattgtaagtacaatatttccaaagattgagaaaaccttcattaaaatgttctcaccatctggcacttccccccctctttgttatgtataggtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtaagtttccttaaatttaaaacaaaaacccacactgtaggaataactagtcttctctttctttgcagcacttaaaagatcatcccatgccctttcctttggccctccatttccagtatttttctgttttgcaaggaaagtgaggattcatgaaacttgctgacttagtagccatgaaggctaatcgtttctattttaccataaagaaggttaagtagaggatttaataaccataaagagggtataggagagttactacaaaatcccactgccgtaacaagccatgtgttactttttagagcattggcctaatggagtccccaagtactagttttgtttttgtgtacctggcaaatatttagacagtttttaaaaaatctgcaatgtttatggggataacttaaagtactaccaactgatttggattaactcttgatgttattgctctaactgaacccagctgtagagcagtatagcaaagattgggaattggaaatgcaagagaaagtcagatgtaattgagtaagccagtgtggtagaggcgtttggactgaggtagaacagactttatattttgttctcatttgttagattaaagataaaacatgaaggaaatgcagtatataagttcttggtggcaaacagacagtggactgaatttcagagaattaaaaactaaagaccctgttggctttattaaagcatgcttcagtacattaatttgtgccttccagatcaaatgtcatgtgtacaaaatgtatgttaatctaagagatgtgaccaaaaacgttttggatcatttaaaatgtaactgaagggtgctgccttttataaattcttagtactttagttagggaatgtactcattagtattgacctatgagaagcaaacttaaactaatagtacttttttaaaaaagattttgtatatggcacacaccccttactaactttctgacttctccaaagtccaggaagctgcttcctaaaataccttgttacatagttgtgccctccttaattaagcttcctagacctgggagtgtccaggaagtctgtataagtacatgtttccagtaaatacaatgattggttaagatgtttaagttttttgaaataccagggggaaaaaaagccctttgaaaacaggtgtcatgtgcacaaaaatgcacatgaagaagtaattcactttcatatttaacagtttattataatatcctttgtttctggtactattcatttaattcttcatggtagtttttggaagtttcatatttttatggtttattaatgattgtttttttaacctcagttcttgtattcactttacagtggtttattttcatttgaataaaatactgggcagctgttaatagttttacttcataggaatctacagataagtgtttaaatgaattgctcaagtttaaaaatatggctgggggtaagaacccagaaggtaaaataatgtctattaatcccagcagtataagaaaacagctttgtggatattaagatttgcagcagtttgggctaggagaataataattgggcatcaaagcattgcttctcaagcttgaatatatgcaaatcactttgttaaaatgcaaattctaattcagaaggtctgaggtgagtccctagaacttgcatttcttacaactgcccacctacactgatgctgacagtactggacctacactgagtggcatgaatgtaaagaatctacattggagttatgtatataaatacagttttatcactggagtgcagtggcgcagtctcggctcactgcaacctctgcctccaaggttcaagtgctcctgcctcagcttcctgagtagctgggattacaggtgcacaccaccacgcccggctactttttgtatttttggtagagacagcgtttctcgaacgcctgacctcaggtgatctgcccacctcagcctcccaaaatgctgagattacaggcgtgagccaccgtgcccggccctgtatttccttttaagaggaaattttactattttttttgagattccagcttttgaaatttttcctcttttacacaaaacaaaatagaataacacaggattaaaaactgttaatcagtagaacatgtatgcacaaaaaaatgcagataagacgacaggcttattgacagtattcgccgtttttcattctgccttttttaaatgaatttatttcattaaatactctttgtaaacaagatatttaatggttgtactaaactatgatggaattatacttcactgaatatttaagtttccaaaatttgaggttacagtgaggtgaagattttggtgaacatctatatatacttagtacctctattaagtttctagaagtaaaaaggagtgaacgtttaacatttttacaacgttgtacttgatatcccctgccaatataatactttggccttccactagaaacatgagaatgttttttccttgagtcctaacaaaccttagtcttttctgtcactattttaggtgagattaaacatttttcacagcattctgtttatgccttttcaacatttttgtcacagactatctcagattaacacttttgtacctttccatatcaataactaatcctaaagttagtatgctcatgttttaattttttagtacactgtttttcaatttaatgttttcattttttaaatcttttagtttatactctattaaactgaaatattatggtttgaaaacataacttattttttaaggcataacttataatagctttgtattccatcatatgtagaaaccttcgtttatccattctcctacggagttatatttaggctgtttcagttctttgctgttaaaatactaatacagtcagtatccttgtacatgtttctctatgtctgggtttatctaggtaactagaagtgtggttgcatcctttacttcactagatactgccaaactgccctgctaaatatagtcttgctcatttttctaaggatgtttggatttttgatttaagagagttttattaaccttttttattatatacagaatgtattttggcagtaatcttagcaagttaatctgtaagtctgtttataaaacaggaatgacttatacatcagagtggttgtgaaaattaagggaaagattttactgttactggaccataggcatttcccatcctgcttcttttaagttattcatgaaaaaaattaaaaactatgttctttgatactttaccctaactcacctttttttttttttcccatcttaggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaacttttattttgcattattattggtattaaatacatggtatattaatctgttctgaacacctgaaggggttaagtttgtacagttttttccacctactcttctcacatgactttatgccatacatctggcaagactgctagggaattaaaggtaaactgtgaacctttattcttttaaggtcaggaggaggctgttaagttctacgggtttccatccatgagttacttatagggttaactttgtttcagtgcctgaatggagtactacagcaccatgtaatgaggtaaaaaagagctccccacaacgtgggcacaaaaaaccaaaaacctcaaaatcaggaagcaaagattagcttcagtaatttgcaactttgctttaaaccctggtagatcattttgctttaaattttttacccttctgaaggcttaagagaatgttaaaacatccagaaacctggcctccatttaagctattaaaactgtgccagacactgggaatccaaggttaatctggtataaaaatcaagggttagccaatatttaccaaccattttattcctctcatgtgttctatgcaaataggaaagttaatctgaatcttgattccaacttaattattcacagttacccaaaaacaagagaactaagtttaaggaaacctaagccatcaaaataacttttatttgtattttctacataaacacacagtggcaattcatggcatttggtaattcgtccagacgtgaaaggtttatgaaatcagcaaatgccattttgaaaagagtattctgtcaaaaataatttaccaaagttcaagataggcctgttcagcaaaatccaatatcattctctcagtactttataaatggaattttcttctacttgtatccatttcccggggctgaaagtggaaagcaagggagtggaggaagaaaacaaaacaaaaatataattaacaattcaggtaagacagtaaaagttaacgtccctagatcttcataagtaacactagtgctgaaaaaccgggtttgtgcgagaccccgaatagtcagtcttcggtctaatataaaagatgttggcagttactgtgtgtgtgtgattttaaagtaaaatgttactaagtgaagtactgcttatactagatagaaaaggatgttttaggccatgcacggtggctcacacctgtaatcccagcactttgggaggctgaggcaggcagatcatgaggtcaggagatcaagaccatcctggctaacacggggaaaccccttctctactaaaaatagaaaagattagccggtgtggtggtgcacacttgtaatcccagctactcgggaggctgaggcaggagaatagcttgaacccgggaggtggaggttgcagtgagtcgagatggcgcccctgcactccagcctgggcaacaaagctgagactcatctcaaaaaaaacaaaacaacaacaacaaaaaagttttcatttatgatttaagatgatgatctccaaacttctaagaaaacttatcaatagttctcaagaaacatgtagtagagtcacatataacacaggcttataagcagattgctgctgggtcccaccccctaaattgctgatcgagtaggtctgtgggccaaagaattttcattcctaataggttcctaggtaatggtgctggtctcgctttgagaaccactaatgtttatacttcagatgagccaaggttaatcaccagacccagatattgtatctttttttttttttttttagttcaagggtatatgtgcaggatgtacaggtttgttacataggtaaacgtgctatagtggtttgctgcacagatcatttcatcacctaggtattaagcccagcatccattagctattcctgatgctctctctcctcccaccctcttatcccatacttta

SEQ ID NO: 14729 - DNA, 7242 bp, Human
cctagtggaaactaaaactgtggacatgccctacatatctatcatctaccaagtaaaaattggtgaaaaattcttagtctttaggtaaaagtctggatatttctgcagttcataattagacaagcaagaaactctggtgagaaactggaaagcactgaagagacatctcctcccttttcttccatattgttttcaaatgcgatctagtgaagatttcgtgcttggtgtcttcaattatagcaatgctcattaggagtgatgtacactactgcctgtgggccctttcccacaaagtggctcaagttcaaggtcaggttggtgagaggctatgattgagtctgcccagagtttagggtaagccattccatataattgtcaagaccctcgtgtagaatggaaacattcctgtcttctccagaaaaactgggagttctagaaaaagcagacagaaggatttgatttgggaggggtagtaaaggaagcggaaaacctctaaagacagatttgtgaaacaaaccgtttgattcttctgaattgcactgcacattaggccccaacagaggggcctcaagcaattctgccagtggctggggtttccccttccattcccttttccttgtaaggaagtttaaagcttgcaggaggcagataggggtcttgggctttctgggtactcagcttgtgtgggagtatgccagtatcagggacagtttcctgggccccttgcagaccatagggagaggactgcagggcagggagactggcatctccacacaggcgtctgtattcttggggtccagaactcccgcagctggtttctggcagtcagccaggcttggcttcctcagacttctttagatcccaaaaaagggggaaagtgcctctcttctttctcttttctgactgacacttcaggattttacaagattttgtcccatccgctctgtcagcttctctctttccctctttgtgttgctgtccctgagtctcatctctccctctccccgtccctccctcaagtcctgtgggtctccgtccctccgtatgtctttacttaaagggaaatccagacccttccacaggccactctagaggctccatttccccttcaggtccggaagtggagtgtcctgggttccatccagatcgcatgtcttctacgtctacgttcgtgtctcccgcctcttccctcagcctcacccgaatcagggcctccagagcattctgggcagtagcgagtccctgggtaaggggcgtccagggcacctccctggggcccggagcagctcattccaggacatctgggacaggaagggtaccgggaatgaactggggtgctagtacccaggacccaaagccaggggctgccagaaatacctattaacccccatttcccagcctcctcttacacaggcgcattcccgggttctcctctgaggccgggagcggcctcccagccccacccccgactccccttcccccccaggagatggacactttatagagagagctttttattctctcgttaaacctgtcaaagcgcaggagacagaaagctagggagggagaggaggagaaggaggtggggcccggctcctcgtcccctcttcctccgcccaccacgcctcccctccccccggacgtgtaaatgagactctgcaaactggaaagcagcgaaaggacacctccttccttttctctcttgttgtttttaagtggaatgagagagagaggagtggagagggaaaagaagagagagagggagaagagagagaggagagaaagagcgagagagcgagagagagagacagagacagagagagagagagagagagagagagagagagagagaaagagagagagagagagagagaataagctggggtaaagtattttcgcagtttctgcctttaggattttattagcttctctcccccaggccgcagccaatcagcgcgcgtgcccgggcccctgcgtctcttgcgtcaagacggccgtgctgagcgaatgcaggcgacttgcgagctgggagcgatttaaaacgctttggattcccccggcctgggtggggagagcgagctgggtgccccctagattccccgcccccgcacctcatgagccgaccctcggctccatggagcccggcaattatgccaccttggatggagccaaggatatcgaaggcttgctgggagcgggaggggggcggaatctggtcgcccactcccctctgaccagccacccagcggcgcctacgctgatgcctgctgtcaactatgcccccttggatctgccaggctcggcggagccgccaaagcaatgccacccatgccctggggtgccccaggggacgtccccagctcccgtgccttatggttactttggaggcgggtactactcctgccgagtgtcccggagctcgctgaaaccctgtgcccaggcagccaccctggccgcgtaccccgcggagactcccacggccggggaagagtaccccagccgccccactgagtttgccttctatccgggatatccgggaacctaccagcctatggccagttacctggacgtgtctgtggtgcagactctgggtgctcctggagaaccgcgacatgactccctgttgcctgtggacagttaccagtcttgggctctcgctggtggctggaacagccagatgtgttgccagggagaacagaacccaccaggtcccttttggaaggcagcatttgcaggtacctctattaccctgggtccccttgtctctgagcctggggttgtgggtcccaatggcatttccctgggaggaggaggagggagacttggagctggtgaggatgagcttggtgctcctcccttggttattaggactctgaaggaggtctgagtagctggagggcctggatggaggtcagtgtgaggggcctgagctgggtgctatctgaagcctgaaggccacctcacttctccaggaggccctgggaccagcctttcaacatgtctgagaggtttagatctctttgctgttgagtggggatcagggtgtccctacccagcacaattccaaactaattctacacaaaagctaaataactctcaattcggtgcgtggggagtgggtgtgggagatgggtaaaaaggtattggatgtactgtagagaatacaacctctcactttctattagatgagttttccaatttccaaagaaaaatttaggtttcctgcagccgtgacatatgtgtgtgcactgggatgggttaatgtgtgtgtgtgtgtgtgtgtatgcgcatgtattgggagtgggggcagaaacgtgtttccagaatttgcctgtagaatctaaaagagtggccaagagtctggaaatgcatgaagactggacgtatgtgatggtgggcaaaggcctgactgtgtgtggtgtgtgggtatgtttgcagattcgcgggtgtgagagcagtgatgggtgagggtggccttcaggagccaaggctgagcggtggtgagagaacaagccggaagccagggtgctgtcctggtatgctttggaggaacaggattgcacgtgcgcctgtagggtgacctgtgtgcacctgtgagatgacttagcttggggcttgcaaggcctgggtctgcatgggtgggtatctgaccatgccttttcctccctccctttcacgccgcgcagactccagcgggcagcaccctcctgacgcctgcgcctttcgtcgcggccgcaagaaacgcattccgtacagcaaggggcagttgcgggagctggagcgggagtatgcggctaacaagttcatcaccaaggacaagaggcgcaagatctcggcagccaccagcctctcggagcgccagattaccatctggtttcagaaccgccgggtcaaagagaagaaggttctcgccaaggtgaagaacagcgctaccccttaagagatctccttgcctgggtgggaggagcgaaagtgggggtgtcctggggagaccaggaacctgccaagcccaggctggggccaaggactctgctgagaggcccctagagacaacacccttcccaggccactggctgctggactgttcctcaggagcggcctgggtacccagtatgtgcagggagacggaaccccatgtgacagcccactccaccagggttcccaaagaacctggcccagtcataatcattcatcctgacagtggcaataatcacgataaccagtactagctgccatgatcgttagcctcatattttctatctagagctctgtagagcactttagaaaccgctttcatgaattgagctaattatgaataaatttggaaggcgatccctttgcagggaagctttctctcagacccccttccattacacctctcaccctggtaacagcaggaagactgaggagaggggaacgggcagattcgttgtgtggctgtgatgtccgtttagcatttttctcagctgacagctgggtaggtggacaattgtagaggctgtctcttcctccctccttgtccaccccatagggtgtacccactggtcttggaaacacccatccttaatacgatgatttttctgtcgtgtgaaaatgaagccagcaggctgcccctagtcagtccttccttccagagaaaaagagatttgagaaagtgcctgggtaattcaccattaatttcctcccccaaactctctgagtcttcccttaatatttctggtggttctgaccaaagcaggtcatggtttgttgagcatttgggatcccagtgaagtagatgtttgtagccttgcatacttagcccttcccaggcacaaacggagtggcagagtggtgccaaccctgttttcccagtccacgtagacagattcacagtgcggaattctggaagctggagacagacgggctctttgcagagccgggactctgagagggacatgagggcctctgcctctgtgttcattctctgatgtcctgtacctgggctcagtgcccggtgggactcatctcctggccgcgcagcaaagccagcgggttcgtgctggtccttcctgcaccttaggctgggggtggggggcctgccggcgcattctccacgattgagcgcacaggcctgaagtctggacaacccgcagaaccgaagctccgagcagcgggtcggtggcgagtagtggggtcggtggcgagcagttggtggtgggccgcggccgccactacctcgaggacatttccctcccggagccagctctcctagaaaccccgcggcggccgccgcagccaagtgtttatggcccgcggtcgggtgggatcctagccctgtctcctctcctgggaaggagtgagggtgggacgtgacttagacacctacaaatctatttaccaaagaggagcccgggactgagggaaaaggccaaagagtgtgagtgcatgcggactgggggttcaggggaagaggacgaggaggaggaagatgaggtcgatttcctgatttaaaaaatcgtccaagccccgtggtccagcttaaggtcctcggttacatgcgccgctcagagcaggtcactttctgccttccacgtcctccttcaaggaagccccatgtgggtagctttcaatatcgcaggttcttactcctctgcctctataagctcaaacccaccaacgatcgggcaagtaaaccccctccctcgccgacttcggaactggcgagagttcagcgcagatgggcctgtggggagggggcaagatagatgagggggagcggcatggtgcggggtgaccccttggagagaggaaaaaggccacaagaggggctgccaccgccactaacggagatggccctggtagagacctttgggggtctggaacctctggactccccatgctctaactcccacactctgctatcagaaacttaaacttgaggattttctctgtttttcactcgcaataaattcagagcaaacaaaagatgtggaatcttagagatttattccactggtgtgttaggaccattaaaaagacgtgggcgcccccttccgacagaggctcaccactccaggagaacctgcgggcaggctttcatcctccgcggagctacaggcttccagcggcctggggcctcgtgggtactgagctgcgtgtgggggtccaggacccgatgtcgcctgccattcggccagggcatcggcagatgtattggtccagcccccgagagacccaggaagaaggcaaggaggttcggtacgagccatctcgaatggaagaagaaggcggtcggtctgcgggagccaggccgcagagccatccgccttctgtccatgtcttctttatcttcctcgccataataattagtggtgtggacccccccacacacactttttttcggatttacttgtatggaacctgtgcaaaaaatatttaatttcgttttgtattaaacgctttcattgggaatcccttcccaattttagtctcccacctatccctggacgaccacattgaaatctctcacttatttgtgtttaaatcacaacaaaatctacaaacctatattcgcctgcagatatttatttttacataagggctatgttaagctacaggaggaaatgttttgcttaccattcggacaaacgtgtgaacacaatgtcacaataggtgaatccagacaatgagctcacagacgaataaacgcagaggcacacacatatactccggaaaataagcagggcgccttttcactaacaaggcgcaattgtaccctgagctgccctccagaccgttcccctccctcagagccaaactcccgcagcgaatctctcagcaagctacgaaatgggatcacagggtcgcgtctacgcgggctccaggcccgaaataatttctaactccaaagcaagtggattttattaggcctccagaagccgaataagggagtagtggcgcaatgcgtagaaactacctccggaagctctttttgaatctcggttccagcacccgcaacgcagagcgcgaacctgaggctccatctttcgggttttactccggctggctagcgcttccgggaaccctgcgaggccgccgccagccgagaatccgccccgccttccctgcaggcgatccctactccaaatagtagttcccgggccggaagctggaaagccctcgaagcaggaaaaagcctcatccaggccccccagttctcgggagcagctccagctttccttccccaacctagagcaaact

SEQ ID NO: 14730 - DNA, 13906 bp, Human
aaagtcctctagctattcatggtgaaattagccttcatagacagaaatacaaaaggtaatggcagccacgtgcagaggcttatgcctgtaatcccagcactttgggatgccgaggcgggcagatcactagaggtcaggagttcgagaccagcctggccaatatggtgaaaccctgactgtgtctcaaaaaaaaaaataaaagtaatgtcactgctagattggaggtgattgccggcacctgccactcagagagttggaggtgtctttaaaccaggaccatcctgggcaactagatcttacagttggggacttacaaactgggaaaatcgaaatacttctacttaaactcatttcctgacataattattaatagtgccccactcacttttttttttttttttaaacagtctcattctgtcacccaggctggagtgcagtggcacgatgttggctcactgcaacctccgcctcccaggttcaagtgatttctcgtgcctcagcctcccgagtagctgagattacaagtgtgcaccaccatgcccaggtattttttgtatttttagtagagacaggggtctcaccatgttggccagtctggtcttgagctcctggcctcaagtgatccaccagcctcggactcccaaagtgcagagattacaggcgtgagcccctgcaccctgccagccccactcacttttttttttttagacggagtttcgctctgtcacccagactggaatgcaatggcgcgatctcggctcactgcagcctccgcttcccgggttcaagcgattctcctacctcagcctcctgagtagctgggactacaggcacataccaccatgcccagctaatttttatattttagtagagactggcttttcaccatgttggccaggttggtctcgaactcctgacctcaggtgatccgcccgccttggtctcccaaagtgccaggattacaggcgtgagccaccatgcccggcccccactcactttttttaagagtactgcagcttggccaggcatggtggctcatgcctgtaatcacagcactgtgggaggccacagcaggaagattgcttgaagccaggagttcgagactagcctggcagcatattgagaccctgtctctacaaaaaagaaaaaagtacctggacatggtggcacatacctgtagtcctagctactcagaggctgaggtaggaggcttgcttgaacccaggagttaaaggctgcagtgagtaatgatagtgccactgctctccagcccaggtgacagagtgagacgctgtctcaaaaaagggaggaggtagtattgtggcttggataattatatggtcccctatacataatccttcctgaattcttttcagattaacattgagactggtgtttctttataactagcactaatagtgcttggtctatttttatttaccactttctttgcccctgccccaatttatacactggggcaaaattagctttggttttatagtctgttcacctaactaatttataggcctggtttgcataatttagttaacagcaagattttgccacacctgctttatcatcctttctgccaaactatttaaggtaaatggcactttaccccggtgtatttccatagctgaaataagctcttaaatttttataatcctatcctgaaacctaatcggtgtagcagaagaacgttttgcctcgtgagttatcacccctgacataatttgattttcatttataagattctcttagaaccaagtacagtggcacacacctgtagtctggctactcaggaagtgaaggcaggaggatcacttgagccaagagttccaggccagcctgggcaacatagtgagaccccatctctttaaaaaaacaaaaccagattatcttaaagtggggcatacctgtatttgtgtgctaatgtgaggctccacaggtatgcaagacatagtagctgtggatgtttcttataacttatattcccttttcttttgtcagtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaagtgagttgaagtcttaaaagcaacattctacattttagtggaagggttcactgaagctgataggtctaaaactcagacctgactaaaaatcaagaattatggggcctaatgcagctgattggtggcatgaagcatcccctagagaccttgaaatcaccttaagaagtggccaagttagaagccaagaactttttgacaaattagaggctcatacttgaagttcaaagagggagtccttcaaagaagactctaaattctttttttttttttttgagacggatattgctcttgttgcccaggctggagtacagtggcgcgatctcagcttatcgcaacctctgcctcccaggtgaaagcgattctcctgcctcagcctcctgagtagctgggattacaggcatgcgccactatgcccagctaattttgtatttttactagatacggggtttctctatgttggtcaggctggtctcaaacttctgaccttgggtgatccgcccgcctcagcctcccaaagtgctgttttttttgttttttgtttgtgtgtttttgagacagagtctcactctgtcgcccaggctggagtgcagcggtgcaatctcggctcactgcaagctcctcctcctgggttcatgccattctcctgcctcagcctcccgagtagctgggactacaggcacccaccatcacgcccggctaatttttttgtatttttagtagagacaaggtttcaccatgttcggcaggatggtctcgaactcctgaccttgtgatccacccgcctctgcctcccaaagtgctgggattacaggcgtgagccaccgctcccgaccataatgtttgtatttttagtagagacagggttttaccatattggtcaggctggtcttgaactcctgacctcgtgatccacccgcctcggcctcccaaatcatgcatgggattactatgcatgagccaccgtgcccggcaactctaaattcttgagcagggcagggaaagcagagcacctagagcagcgctcggttagatggggttccaagtgcatgtttaatcccccacataggtaagacttgacatgactttcaaaccttgttgtgtctgtgctttggtaataccagaactcagtgttttcattcttggtttattactgatttcctccgtatctcttactagttttcttaacgctggaggtcttaatgaagtcagtaatcttctgactacatttctagtatacaatttctagcttttttgattgtgctgtaactttaactaatgttttcttcacactttcctcttgaaaatcttaccccataaacaatgttgactttaacgtgagcaaatgacagttttttgaaggctcttttttcatagagaaggagaccctgctgtgacctctcaggactacaacagaataggtttctggccacacctgtgctccttgtattttctcttggtggaaatagaaggaataacttacaactttatgtggcattaaaaattttattgcagttcaggtgcggtgacttacgcatgtagtctcagcactttgggaagctgaggcaggcagatcgcttgaggtcaggagttcaagactagcctggccaacatggtgaaacctcgtctttactaaaaatatgaaaattagccgggcaaggtggcaggtgcctgtaatcccagctattcaggaggctgaggcaggagaatatcttgaacccaggaggtggagtttgcagtgagctgagattgtgccattgcactccaacctgggcaactgagcaaaacaccatctcataaaaaaactgctaaaaaaaacccccagtaccctgtttttatgtgttctgggctgttaattacaaatacaaatgtggttttccaaaatgttttttttaaaaaacaaaaacagcaaaattttagcataaacaaaatatagttttagaaactccaggatatgttaatgttaaaactgctaaaaaaaaaaaaaaaagtaccttgtttttatgtgttctgggctcttatttataaatggatttaccttcatgaatatccaatgaggtagtaaaagtgacacagaacataggtcagttctttactgtgcttgactgtcccatgctttgcagacatctggcatatttgcctctgcccactaaatgacagtgtgtctccaccccacctgatgacaacaaaaaaatgctcctacaggttctaacatgcaccctgggaaccaattttacattctcagtaactactgtgctaacaaaatcttcttccatgtcaaatgtatgactgttatttcttcttctggaagagcctacctggacgtagacattactctgtcctcagaagctttccataattacatgaatgctgccatggtgcacatcaacagggccctgaaactcattattcgtctctttctggtagaagatctggttgactccttgaaggttagttgtttctgcagctcttggtggtaaaacagaaaaagcagggactgggttataatttggaggaaaaacagtacataggattttatcagacaaaaatgaacgtatgcttagctcagtcattctataatgggataggtgtcactagagaaaggtatagccttctgctggggaacaaatatcagaagagaggtgatataattggaagcagtgcagtttcagtctttggacctcagaaaactacagacttcactcacataccttcaaatgtataacacaagtagggaaccttcatttggaaattgtccatgtcacacatcactaaatttatgcagacttaattagctggaggagaatgacatcagttaatgtgaattttgccttacggttattcctgcttaacttttgatatggccttcacagctggctgtcttcatgtggctgatgacctatgttggtgctgtttttaacggaatcacccttctaattcttggtaaggtggcaaggagaatgtgcccatgctctttgaagtagtttgtaagaataagagtgaagagaaagcccagcatggctctactcattcttcattgcccagtcttgacccatagagacctgggagtagaggcactggaggaaccggagtttgtggtcacaggtttatgaaatggtctcagttataaattaagaaatatcaaaacagctggaagtaaaggacagttgtctagatttggtttacgtatggggatcttatttacagaaaccattttggtaatttggaaattgttatttgtggtacaaagaaggtagcctgtatacctgaagaggttttttttgttttgttttaacactaccttaaattagctgtcttaattgggagtgctaaccaggatttctcattttgaggaatgcctgtgttttcctgtattttttgaggaaaaatgtatatgttactctgagtcttaagatgtgactgtctctcatatacacttgccatgtcccatgattctgtcttacagctgaactgctcattttcagtgtcccgattgtctatgagaagtacaaggtaagcatttatctgttccaaatcaaatgtgccagttgatgtatgactagttgtagttcatttctgagacattgaatgttcagagcagtctttttataactatttctacaatctaattttgtgagtcaagtgcctataagaaactggtggcagtagtttcctccaaggagagaaactggatatttaggagagagatgactaggaaagagaaacttcctttttatacttgtgtgcctttcgagtttttaatcatgtagatgtattttctatgcaaaagtaataagttgaaaaaatgcttaggccaggggtggtggcttgtgcctgtaatcccagcactttgggatgctgaagcgggagaatcccttgagcccaggagctcaagaccagcctgggcaacctggcaaaaccttgtctctaaaaaaaaatagccggatgcagtggcctgcacctgtagtctaagataggagaatctacttgagcctgggagacagaggttgcagtgagccgagatcatgtcattgcactccagcctgggtgatgggagtgaaaccctctctcaaaaaggccaggagcagtggctcatgcctataatcctaacactttggggggccgaggcaggcagatcacttgaggtcaggagttcgagaccagcctggccaacatggtaaaacttcatctctactaaaaatataaaaattagcccagtgtggggccaggcacggtggctcacgcctgtaatcccagcactttgggaggccgaggcgggcagatcacgaggtcaggagatcgagaccatcctggctaacacggtgaaaccccatctctactaaaaatacaaaaaattagtcgggtgtggtggcaggcgcctgtggtcccagttgctcaggaggctgaggcaggagaattgcttgaacctgggaggtggaggttgcagtgagccgagattgcaccactgcactccaacctggatgacagagcaagactccatctcaaaaaaaaaaaaaaaaaacgcttagatgggagattgagaccacggtgaaaccccgtctctactaaaaatacaaaaaattagccaggcatggtggcgggcgcctgtagtcccagctactcagagaggctgaggcaggagaatggcatgaacctgggaggtggagcttgcagtgagccgagatcgcgccactgcattccagcctgggcgacagggagactctgtctcaaaaaaaaaaaaaaaaaaaaaatgcttagatgaataaaagccgggtgtctaaaaggaaactttaaactctaggttattcaggtaatccatcagtgtgatgaggtgtttgcattgttggatgatgtgtaccaagtatactagatgccatgagattattctttatggattaagtcatccatcaagagactttttggctttttggtattaagtgaattagtgttacacaagagccataacatatttatgatgacagaaaatagattagacacacagtttctagtcattggaaactgttatatactccagtgtctctaaagaaaatacttaccaagtaagacttaacctctgcaaaagatgagtgattttttcactttaacaaagtgtggggtgtttatggtgtaatttggattctaaaaccagaggttttaaaaatacttttaaggctaggtgtggtggctcatgtctgtaatcccagcactttgggaggcggaggcaggtggattgcctgaggatgggagttcaagaccagcctgaccaacatgaagaaaccctgtctctgtctctattaaaaatacaaaattagccaggcatggtggcgcatgcctgtaatcccagctacttaggaggctgaggcaggagaattgcttaaacccgggaggtggaggtttcggtgagccgagatcacaccattgcactccagcctggacaacaagaacaaaattccatctcaaaaaaaaaaaaaaaaaaaaaaaaaaggctgggcacagtggctcatgcctgtaatcccagcactttgggaggccgaggtgggtggatcacgaggtcaggaggtcgagaccatcctggctaacacggtgaaaccccgtctctactaaaaatataaaaaattagccaggcgtggtggcgggcgcccgtagtcccagctactcgggaggctgaggcaggagaatggcgtgaacccgggaggtggagcttgcagtgagccaagatagcgccactgcactccaccctgggcgagagcgaggctccgtctcaaaaaaaaaaaaaacttttaaaaactgggtgttttcattttctacactggtcagtcgtgtttaaaaaatggttaaactagacaaaagagccgtgccttcaggaaaattggtgatctgtatgttaccacaactgaatttattttccttccttaaagacccagattgatcactatgttggcatcgcccgagatcagaccaagtcaattgttgaaaagtaagtacatttagagaccacatcatcatgaggtatgcttccttccccccaattatctttagtcccttgtacaaaatgcagatgccaaggaaagtaattttcattttgataaaaaccttagttaatagtttcattttactaaaaattattatagctgcttctataaaaaggaaaaaaaatcctttatatctttttctggccctgccttctggacctttgtaggccaggcattttgactcacatctgtaatgccagtgctttgggaggccgagacaggaggattgcttgatcccaggagttcaagaccagcctgggcaacatagctaggccttgtctctactaagaataaaaaattagctgtgcatggtaacacgtgcctttagtcccagctactggagaggctgagacaagaggatcaatgggaaaaaaaagatcagtggaattttttggagacagggtcttgctttgtcacccaggctgaagtgcagtctcgacctcctgggctcaggtgatcctcccacctcagcttctccagtagcaaggaccataggctactctgcctttttgaactggcttttaaatgttcttcattacaggctgggcacggtggctcacacctgtaatcccaacactttgggaggccaaggccggtggatcacgaggtcaggagttcgagaccagcctggccaacatagtgaaaccccatctctactaaaaatacaaaaattagccaggtgtggtggcatgcaactttagtcccagctactcaggaggctgaggagggagaattgcttgaacctgggaggcgaggttgcagtgagcagagaccatgccattgcactccagcctgggtgacagtgagactccgtctcaaaaaaaaaccaaaaagttattggttgcttccccaccttcatttattttcacatgtattcatttaagccaaacgtatccctctcagaaacaaaagttctagtaaataagtaacttaaggatcaaagttgtcttttctaagattgccaaatctctgttcccatttttttaaaccaattaataaatcaggaaataaaatattgacaaacatctttatgactccctatatcaaagagttgttttcttctttttactttttttccccatacctagaggacagtattttttttcttttttcttttttctttcttttttgttttgctttctagagacagggtctcactctgtcacccaggttgaagtgcagtggcacaagctgaaagctcactgcagccttgacctctgacctcccttgctccaagtgatcctcccaccccagcctcctgagtagctgacactacaggcatgtgccatgccctggcaaattttttattttttatagagatgggggtctcactatgttgcccaggccaggcttaaacttctggcttcaagtgatcctcccaccttggcctcacaaagtgctgagattacaggcatgagccctgcttttattttgaattattcatagcaaatactgtgaacctaacgctttgaatttgttaacatttttctttttttctttttttttttttttttgagatggagtctcgctgtcacccaggctggagtgcagtggtgcgatgtctgctcactgcagcctccacctcccgggttcaagcgattatccttcattcacctgcctcagcctcctgagtagctgggattacaggtgcacaccaacacgcctggctaatttttgcattttttagtagagacagggtttcaccacattggccaggctggtcttcaactcctgacctcatgatctgcctgcctcggactcccaaagtgctgggattacacgcgtgagccaccatacccagccgggagaatgcatttcacattgcttatgcaagtccaggactgtcctctagcatcacagttaaaataaaaacctagagcaaatgctaatgttttcactttctttctttttcccctccttttctcaataggatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggattttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaacacaaacaatgactgtggcatcattctgctaactttattctttatacacagtttgggtaaagtaagaaccaaacactgcttccactccccctatcctcactccactttggggactttaaaaagtgactaatagttggtactcgtaaggattcccaagactgcagaatttagttgtacagcataactgtgcatttgatctctgaaagaaaataagagaccctctaagaggtggtgaccttagaagaatgaggaggggtcagggggtcttttaccccagttcagcctcacaccagcctgggagattttcccacctgcaacgcaaagcagcctgtaaattacatatagccacaatacacttaaattgagtcaatcaccgtggaaaatgggaactaaatacatcatcaggtcttcattgaaagaacttgagtggtcacctgtgattagctcttctcctaaactaaggctgctgtgacccttaagctggcttttaaaaatgtattcaacatacctcttagaaaacttaggctgaaatattttttaaatgactgatgcaaacaatttcacaaatacgcatacaaatgtttgaataatgtcactaagtaacatggtatataaatatgtattcagagtaacatttacatattggccataatagcaagcataccattaacaacaacaacaaaaaaaatcatgaagagacttcacctgttcatgtcagaatcccaaggcaaggaggcacacctaggcaagagggccaactcaacttgcaacgtctaacctgtgaggccataacttccatcaaagcaggaatcaatggaatcactaccgcagcccttccctttcactggtgcccggcacttcagctgcatcaagatcaatggagggctcatgaaaacactgctaggccccaaccaagtttctgattcagtaaccctggggtatggcccaagaatttttatttctagcagattcctaaggtgatgctgctggtctcagggacacactttgagagccactggtgtgtttggggctgtctcagtaaagatgtccactctcctgaggcctctctctgcctacggaggggggggaatctaacccctctgccctggcttatccgaactttggcagtgggcttgagtgattataaattggttcccccaatttgcctactgtttttgaatgggcagagtaaaaaaagtggtgttaatactctggatccgaaaaaatgcatgaaggaaagtaaaagaatggcagtgcccagcctggtgccatccataatctccgttctcaagcttttaatactgtctcaaaaaccgtggaggttcaaactcactgggaatttacttttcagtcaattgacaacccattcaggatcttcctgaatccctggtggcctccacaacaaaaagcacaaagccccctgccgaggcagccttgggccctgcggcagccgccccacctctggagttctgctggggaggggaaggacgattggatggcgccttccagctgaggccctgcagagctcagtgtgctcatcccaaggcagtgtgcagggctttgccaccttcaggagtcacagatccaccgtggtggcctgcattgcccagcatgtcaatccttcggcaggcctgacaaattttaataactgaccagcgaattgggaagcagtgtggcatcgtgcaaagaacactgagtcaggagctaggattttcattctagttcttgtactgtccctacctggctgtgtgatcatctcggttcctgggctccaatttacctatctgtgaaggtgaggagggtagtactagtgatctccagggccctttccaattctgacaatcctcaattatataaaaatgctataaaatccgtggtataaaatccaactcccaaacaggaagcgtcaaggggactgggcctgaggcacttgaaccttaggctctggcctgggggtcagggatgagaggaggggcctcctctttgccctctgctttcccact

SEQ ID NO: 14731 - DNA, 126029 bp, Human
  misc_feature (1)...(126029): n = A,T,C or G
gtactgaatatgaataaagctggtaaattggaaatggtgtaatcgaaaacattttacttggtttatgaagatttacgtttttcacaaagttgtgctcttagatggtcatttggtttaaatactgttttgtttgtgctttcatgaaacacctttcaaaacaactcaatgggtaataatagaatctgattttaatctgccacaagattttaatgaacttgaaacaaactgcttgttgctcgaaaattcaggatgagtgatacacatatacttctgaattattttgtgttgattgaaatggtttcttaagctttttaatactataaatacatcttgctatagaatattcatctgaatatttaaattaatgtctcctattgtcttactattagaggaagaagtgttggatttatgggttagggtccttggagtattcacaattttttaaatttgaaattatgtgtgtaatccattttatataactttgaagtgggattaatatcttgtatcgtctttattttgtacaattggggatttagaataaatgaattgcaccctgccatagattacttacgtttgatttttaaatgccaggttttcatttattactaatcaactgataccagttttggtaactattacaaaggtggtaggcattattttggtagacaaaatgagttcttgattctgttttcccattttacatgagaagaataaatagttcaggttaaattgttttgtgttaatcatactgtttgtgattcatgtcaaatactgcagcatacacatccatggttaatacacgagcaccatttgttattgactgatgtgaggtggttggtctttgttaaattcaaaaatggaattttggatattgttcttgctacgaaatttatctttgtgtgtagagtatggaattgaaacagtttggattatggattttacctagattggacattgttgcttttgtttggtgtaaatctaaagtggatttcttcagtgagggagagacatggttctggcagattatgttgaataaggaaagttgattggatttttttgggtgtgtgaatatgcttgtctgaatggagtgcttggtaggatattgtttctggaattagtaatttgtttctgtggatctcatggttttgatatttaggagaatttgctttgtgacattactttgataatttgcaatcacgtatgtcctattgttaataacattgttgaaatgggtgtatacttacttgatttgaaatataagggaagtgttgggatatgtgttttctgttggatttggacgtggagtttcttgggttactgatttaaaggtgatcgtgtttggaccatactcttgaatttttgcctgaatcagtatgggaagtaaatatattgtgattatgagaagtttctttggggggaggagtgtaatattttcaaggttatataatgggttaaagaattttgtgaaagaacaaagaaaaatggatattcttgaataaaaattggttgcattaacttttgctccagtgcaacttgaacactagggaggcgctcttgagttgtaaaagttacccctttcttccagtggagatggaaaattcccccttaaattttgtctttagattatttttaggcatcataaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcaggtaagttcacgatcattggtgataattttaaagatttatttgtttaagtttgccttgttttctgtaaatacgagaaattcttggatgacgcaataagatacagagattgttatttgtatctagtgtgctactttgagaaagtttccttattgatagtgatgcttccactgttcggtttatcctgttgttttttcttttaaggaaaaaatagaaatatttagttttttggtgcttaccgttgttgtgttataacaatatcgttaacatcgtcaggactttgttcctgataataaaaagcatcgatagaagccgggaccttacctttctttcaacttttgacagtaaatacctgggcacaggacttcaaagcaaacacagattccccctcccccttaatatttaagaattaaaagatgatgagaaataaggacaaaagccaagaggaggacagttcgctacacagcaatgcatcgaggtatgagctatcaactttcttcctttttgtctttttttttgggggagaaacctcagcttacaattgtttaccttgacagacatggattgctgtctgttttattgtgtttttctaatttggattcgttttttaaagcatgaccttgagattgctaatatgccacaccctaattttttggtagcaatttatgaaagttgagttgtgacttaaggcctcttacagcagtcaaaaggtaaggtacctttattcaaaggggcctttactgtaatgtacagtttttctgtcagtaaatttcagtttttaggtttttgtactgcagaaaaatgaccttgtcggtttagccattgctgcattgcaccattttacatacaaggcaaattttttctttgaagaatccaggatatctaaacttgtaactgagggccatagagaagccttgtagtagtaaattatagtaaatagacatatcagaaagttatatgaatgaaaaaatgtacatttaaaaacaaaatcacttaaaggaccctttgactgatgcctctcagtttatatttttatgtgactttatatttcttttgatacacttgacattttaggaaattttgatgtgatttatcaaaacctttacttgatggttagagttcctgcatttatgaaatcaaatctgtaataacagaaatcctggaatactcttaatatatacttctattttgtgtttgttactgtgattaatatttgcagttgtatattttacatttaaattattttaaggtttgcatttgtatgcttaagacattgatttcctgttggtagatgtattttatcctcacaatttagatgtagctgctttaaatttattgatgtatttcgacagagtcgtctggaatgctttatcttctgaagcttaaaaatgtactgtttgtgcaaatcatgatctgtttcacattccttggagtaccttgttagtgatgaagtaataaagcctctaagatgtttttgttgtatgacctctgtatattaatttttaaaagtacatatgaatgcattttttgatgtgttctttatgcattttcatattataaattttaaatcatgcagtttaacaaggatgtgattcattatgtggttttccttcccaatttttacttttctaatttttataaataatacacttttctattaggctagtgaatttgaaagttttgaacatgatgtgttactaatatgctgaattctatttattttatttgactaaaagcatattgagccttgctttagaaaataagttaccaaatttttttgcattgagttgtcacccagtttgtagtgctgtcttaattgaattgcccatgtaaattactagattaaattgaggacagaaaagttttttactcatcctaagctgtttttttctggaaagtaatgacaatttgaagaaatgagaacctccagatatatttggcaaattattaaagattcagcactaaaattgttgctcccttgagtgtatcatttgcataggtctcacatgggttttggctctcttatgcaaggtttgtggttaacatcattgatcagactgtgctttctaattctaaaaaattgagcagtgttggtattctttcagtatttttactctcacctggaaaactacctggaagttgtcaggcatttgcttactggtagtggaggttacagctgtacatgaagcatgtactgactgtacttttaaattggtttgtcaagtatactttgaatcatatacctgatggatgtccaaaaatatttaagactctttgaaaagaagatagttacttttaaattagttaccctaaatttcatatcttaatacatgtacataattatgacatcacttccttttaaaatgtgcagctgtagaatgttagtggtgttttaatgtggtagattaatattacttctagtgagctgaactgtccctgtaattagtacttggttccttctgccatcagagtttttattgcccaaagtatagtgtttagggaatactacgaaaatcacctttgcagcctgagccacagaagaggaaatgagtttgcaggtcaagtaaactttggtctgagaattactttagtatctggaaagaatgagtgcaagtttaggtaaatctggtaataccctgtttttggaaatagtgcagtagttaatagtggttatataagtttgtattttaatttgaagttaatgctaaagtctgttatactttatcacgatttttgaaaattaaaaactttaaaaaacgcgattttaaaaacatttgattgatatttgtaaaatttctaagtatttaaaacaaagttttaatgatggacatacgagaagtataccatactttttatctgaataatttgcagcttggggataacttaagtaacatcaaagaatgaaaacgggactgtgtgcacacaaagagttcagtgtgttctccacggcaccacgttagcaatttatcttaagaattgaacgagtttattaaatttatctccaaatcgtctgcctttgagccagatttatttttataacctgaggtgcgggtaaatcctacaattttcaggggcgctttaccagatattctaaaaggctggggatgattagaaatggcataatgcagttacttgtgtactagaacaggcagtttaactggcagccattttatgacgctgataatacattaaaaaacgggattttggagaagactgaatctaaactaatagaaatctgaaataccaaagcctatttccttccccctctctgctcttctggggaactctggtgccgacataaaaggcagttcgatagggcacgcagcagctctttgagcccctggcatcttgatgcaggtccagctcagtcacaaaatggctgttcctttgtgccgcagcgctgacagacatactgcattgcactgtgtactcgccaaacagcaggaagttgccgtgccgagttcaaaggccggccggcgccggcgcggggtgctgattggctgtgcgcgcgcctggtaacagcagggtcaacggcggcgccttcggcagcctccgccccgtgacgtcagacggctccccgggggggcggggagagaacgcagtgacgtctggccgcgtgcgcatgtcgggcgctttctcctccccctacccagggagccgcacgccgaggggaaaaggaagggaactctagttgggactttccggtgggcggcttctttcctggacgcgtttgctcctggcagtcttgtccgcccttgcctgtagcggtccgcaccctgtagtgtgttcttttgcccatttccgggaatggtttatcctctttgagaagcggctgcttttggagaaaaagtgcaggcactatttataaattttaaaggcactatttggaaatcttaaaatagaaaatttgcccagttttacattttcccttttcataccttagcgtcccttctccccgcccccgttcagtgtgaagagatgagtgggtttaattttgttacaattgaccaaaacgtttgagtgtcagaggcggatacttttattttagtgaaaacctcttgacgggtgttaacagctgtttaatacatggctcataaacaaagggaagattatttgaacttgtccccatgcgtttttacttggtaccgtacattttctcagttggcatttgatggagaaaaactcaggtcagtatgtgctaagtactatatatttaagattcacagtgggatagtttagtagaaaatagaaaatttcacgttcaataacattaaaaagtggcagaatacagcgttaggcaaccattactatgtaagtaaatgtcagaaaactactcttttaagtgttaatagcacttgctaatgcagggtgactgacagcttggctgatagtggggtcacttggccaaatcttcgcaattatcttccctaggcctccatttcgggaattctgagtcccggtaaacggttgggtttatgctcactgatttgccttgtttggaaacctttacaaggatttctggttaaaacttcatcgttcagcaacgatgtcttaataattaaattacacatactgaatttaagcaagcaagaaattcagtggatttatctactgtggacaaagtttttttcctgccatactagagtttttttagcagttggagtaggctgtcctgtagttagccatagtttagagttattttagtaaagtgtgttacttcaaaggagatgttgacccttcagtgcaggtgatatttgcttgggcgtatgtcaagtttctgaatacagtctgtgaaagttagaattcactatgatagtgagttttgtaggttctcataatctaggttctttgggaagaattatttggatagtttgtgaaaactagctgaaattgctttttctgttacagagaagtgttcatcaaataatttgtacctgattttaaaattatatgctcaaatgtatattgcgtataaaatgctaacagagaattaagtgtttatagaacttgataaacgtttaactgtagcttccaacttaaagtatacctgccacaagaacgaaagtaataatctcacctccctttttgtgtagagactgaattctaattagttgtgttaatagtatttgctgaatacctttcaattcctaaaactggggtcaaagtagtcaacattgcagttaattatttttgaagaggatatgaactattctgttatttaagatattttaacctaaataccattatgagttaaaatgcataccatgatataacaatttacctattaactgttgacaatcttgcagccaattaagttttttatagaaccagtgttcttaggtatgtttgttgagccttctactttttttccctttgatgtggggaatagcatcaagcagcaagaaaagagtgttgatcgatttctctctctttctctctctctctctgtatccttgccgtttaaaatatgcactttccaactagtatttggccgttagggagttagtatctttgtaaagattaagtcagcagaggaaggtgggcaaataatatttttgataaagacttttggttgtgacagttgtagcaagttattgcttgaggagtgaatctggaagtttatttgaattttaactaaaactcacagattttatcattagtttactctcccttacccccaaataaaacaactgacagttatgagagacctcctgagaccacctggtatttccaaactcctatcatttctcccataaaatttgatacactaagtttgtttctggtataaaaattgagtgactgctctgtgtcagccattaaattttttcttgctatgagccatcttttttttttttttttttaagatcctttagtttttagctgcttcttggtaaccttagaactttgcttccttgaagaacttggctttcttgatatggtgtcacttgaacaaagaaacttaaaaaaaaattcctctaagagtattttgtgtacaggtgaaagtaactttgtggcttggttacactgggtgtgtcacagctgagtaactccctcctgcacttcagcttgactaagcgttgagttcacatgtatacctttgcaaagctgccattcacaacttgttttggaactttagggttatcagtataaagcctgagtaacaaaacttagtcatccaatgtccaggctggattgtatttttattttgtgatcagtaattcagcacaatgctggaacacattactcacatttgtcttatgacccttttctgtaatcaatggaatctttaattgataaagcaagtctagggggtgagaccttttttaaaaaaagctcctatatactgaatatatttgagccctgattatgaagtgagggacaaggcttttctttttgaaataaatgatggaggacatagatatgtggtagccattcatgctacataatttagcattttattgttaatatgtttggttatgggtcttcttgtttggtatttcaacatgttctggactggatatcatactgaaaagtatttcagttctcattactgagtccctgtagtttggggaaaatgtgatcactgatcttgaaggagagaatgtttcagaagcatccggctaaggcaggattgtagagatagtcttgattttatactttggatttaattctgatgagtcattttgtcacttgtgtatgcttaactgttacctctgtgcctggcaagagctaggtatgagttcagcttttactttagtcctgaaaatttttgttcccagtttaggccagtgaagaagcacttatgattggacttgtaattttctcattttaaaaatgtagataatggtcatcttcattgggtcatgaagattaaataatatagtgcccataaaatgcttagcaaagagcccatcacattaaaagtgctcaataaatgtaagcttttagtaaggttattttattcttactgtttgtttcatcttactttcttgcacccctccttcatatcctaagttcttcttcaggagctaggttggccctgaggaactcgctggttgtcttggcctaccaggagagtttgtttaggccagttacaggagagatttgtgagaatgattttaggaggcaagtcctcatttagtcagcttgggtgcgttttacagttcatcctctcttagaattttttttttttttttttttttttgagaagagccagccttttgagagagcatatgactcttcctggactacaacagcttcttgtgtgaatcacagcccggcttttgccagttagtctgagtagataactacccacccccactcccccaagctgataattattaccctggtttatcctctgtctcatttcccctctcaagctgttagagaatgaatactgaatactgtggtgcactgctccatggatataaatgtaacagcagtaatatttacaaccaatgtctaattggctgtagcttgctttcagtgttcagtctaaaccataggactatatatttgtcttagcataatgccgaacatgcaagtctgcttaaactatagtcttaagatttgtgtgttttgggtttcctctacttcctctatttcctgtcttttttgggttataggtcagatgggttctactttttattcccatttcagactgtggagagcttctaaaaataccagtgtccatccctgcccctaggatctagttaatttttaaaagctctctgtgtttcaaatttgcatgtgtttctgtatgtttgcagtatctccgtgtgttttcaaatcttctgatggagcacttcgtgtactttaacccttggtctttccattgcctgtcccatttttaaattccctttttagtcttaatagctgcttgagttaggacctctggaagcaaaagtgggataggatgctgacggggaattgtaggcttgatggaagaggatgtttctatattaaatgtcatggcagatccagttctaggcatacctttaaaatgtatacacaggctgggcgtggtagctcactcctgtaatcccagcagtttgggaggcccaggcaggcggatcacttgaggtagggagttcgagaacagcctggccaacatggtgaaaccctgtctctactaaaaatacaaagattagctggacatgatggtgggtgcctgtagtcccagctgcttgggaggctgaggccggacaatctcctgaagctgggaggcggaggttgcagttagatgaactgacacaccactgcactccagcctgggagacagggtgaccaaaaaaaaaaaaagaaaaaagataaaaaatgtatatgcaggtgggctttctcccctcaagattctgaattccttgtaagtgtcttctagtcgctttaagctcttgtggtcgtctcttccttagtgtactctccttacatcctttggaagtttagattctagaattatttacttggaatgcagttacattccattctaaacttcctttcccttgggtttataaaaacattggtgggttgtgaattgtgaccgacattgaaaaaatacaaaagaatgtggtaataaactccagggtgtatcccatttgtatgggttgtttctaagtctagcagtgcctgctagctggtaatctttcactttggattttttgttgttgttgggacagagtctcactctgctgtgctgggattacaggtgtgaaccatcatacccagcctcgtggtggtattatagatgcctgaggctggataatttgttattgtggggagcgtctcatacacagtgcagtgctgcaatcccagtctcaggtgggattttcccacctctgcctcccaaggagctgggaccacaggtgtgtaccaccccacctgtctaatttttgtagagatgggtttggaccatgttgcccaggctggtctctaattcttgggctcacctagacctccgaaagtgctgggattacagatgtgagccaccgtacctggccttcactttggattttatcaggaaggaatattgtacatggtgaacattttgtagaaaaataccaaagtagatttatatttattgagtgcttactctgggtaagggactgttttaagggttttacgtgtgtgtgtgtgtgtgtatgtatatatgtatatatatacacatatatacatatatataaattttttcttttgagacagggtttcactcccatctctcacactggagtgcagtggtacaatttcggttcactgcaacctccaccctccaggctcaagcagttctcctgccttagcctccctagtagctgggactacaggcacatgccactgcacttggctaattttttgaattttttgtagagagggggtttcgccacgtttcccaggctggtgttgaactgggcatgaaccaccatgcctggctatatgtatattttatttaatatgaaagtcagtatagcaaaaatgttagtaaccctcctaaagttaaccaactcactaaatgaatgattacatagtcctcttcctttaaaggcctgtgggtgaccttaggtcctgctgatcttatttatttttttgagacggaatctcactgtgttgcctaggttggagtgcagtggcgccgtctcagctcattgcaacctccgcctcccaggttcaagcgattgttctgcatcagcctcccgagtggttgggatcacaggcgtttgccaccatacacccagctacttcttactatttttagtagagatgggatttcaccatgtcggtcaggctggtctcagactcctgacctcaaatgatcttgccacctccgcctcccaaagtgctgggattacaggggtgagccactgcgcctggtccctgccgagcatttactacccatgccgttctgttccttcagttccattgtgtgcttaccaaggattagtagatacatcttgaatttgtttatgctggttgtacggtcatgtgttgcttagcaatggagatacattctgagaagtatgtcgttaggtgatcttgtagttgtatgaacatctcacacaaacctaggtatagcctactgcacacttatgctgtagcctgttgctcctaggccacaactgtatagagcatgttacagtactgaatgctgtaggtgattgtaatacaatggtaaatatttgtgtatctaaacagaaaagatacagttaaaatacagtattacagtcttatgggatcactgttgtatatgacaccagtcattgacctaaacttccttatgtggtgcatgatacttgtaactttgcattttaattaaatagcaagtcagtaggtgaaatgattgtgagagattgtttcagtgaaaactaagttgaatgctttaggaagactaaataatagcatgtatactacctcctaagaatctagaacttgttctgattgctttgtatgtgttagtttatgtaattctcaccactcctgaggtacatatgcttatcgctatttgctagatgagaaaattgagtcacaaggagagtagatggtagaattgggattcaaacagtggcagtttgactccagcattgattaagcatcttgtgaaaagttgctgtcaaattaatgggtaagaggaaacttagccgggtgtagtggttgattcttgtaatcccagcactttcggaggctgaggctggcagatcacttgaggccaggagttcgagaccagcctggccaacatggtgaaaccctgtgtctactaaaaatacaaaaattagctggatgtggtggtgcactcctgtaataccggctattagggaggctgaggcagagacgcttgaacctgggaggcggaagttgcagtgagctcagatcgcaccactccactctagcctgggcagcagagtgagactgtgtccccccaacccctgcccaagaaaaaatcaacatcaacaaaaaaagaggaaactaatgtatatgagactggggaaaatagtaaaaatcttgcataattctgtagtttgcttctttttaaacactttgcattttaaagaagcagactcaaaatcacagtgcactgtgggtgtgattgatgccagtcacacattctgctgttcaaaaggccatgactctacatcaaaagattctagttaaaatgttgccctgaagtgatgctcatggggatagtataagaaacaaatgtgcaaagatgggtagatgggaggtactggaggcctcggaacttcacctttgtgcagtttgtcgtccattggcacacatgaactttggatttggccacacgttttgaagatttgtgctttgcttcaagtttgtttttttttgttcgaaacttagttcccagacaggttttgcatgagaatcacttggagaattttaaaagccaagctccctgtctgattggatttaggagccatgtagtaggtttgaggaattgtccaaagctctgggtgggtctgtggcatagctaggcttgagaactgttgtgtttatctgccgtctcggggaatagttcttgagtgtgttgtgtgttgacaatcttgaggcggagtctcgctctgtcgcctgggctggagtgcagtggcgcagtctcggcttactgtaacctctgccccctgggttcaagtgattctcctgcctcagcctcccaagtagctgggattacaggtgtgcaccaccgtgcccagttaatttttgtatttttgttttgttttgttttgagacggagtctcgctttgttgcctgagctagagtgcaatggctcgatcttggctcactgcagcctccacctcctgggttcaagtgattctcctgcctcagccttctgagtagctgggaccacaggtgcccgccaccacgcctggctaattttttgtatttttagtagagacaggggtttcactatgttggccaggctggtctcaaactcctgacctcgtgatccgcccaccttgtgatccgcccgcctcggcctcccaaagtgctgggattacaggcgtgagccactgcgccaggccctgacaaactaaaatgatcagtgtgtcttccatttagatgcaggttggcattcaaatagaggcaatatatgactggtgaattgtaatttcaaaggaaagcagtaatggatcaaactcttgcactgttctctttcccttgcttaaaaaaaagtctgttccctctgaatctagctttatatagacgtttaaatccttaagtttacttgctaaaaatcacctggggtgcttgttcaacatattcccaggcttcttgcttgaaagttaaaaaattcagcaattctagggttgtgtccaagaatctgtatgttgaacagcaacctcagttgattcttgtactgaggcaagtttgggaataaggtcagtgtgggacggggtttcgatcttttctgttctgttctgctgctttttagctgtagaatcttgggcaggagtgtctgagcctgtttcttcatcttttaaaatagagtaagggtagtacttgtctcttagggaaggaagttcaaattaaataaaatgatacttctaggcagtggtctttaactagtggcaggtttgtccccttccattaccctggacatttttgcttgtcactctgggggtgggggtgttactggcctctagtgggtagaggccagagatgctccccaacatccaagagtgtgtatgagacagctccccacaataacaaattatccagcctcaggcatctataatgccaccactaggctgggcacggcggttcacgcctgtaatcccagcactttgggaggctgaggtgggatcccttgagctaggagttcgagaccagcttgggcaatttagggagatgccatttctacaaaaaatgtaaaaattagccgggtgtggcagtatgcacctatagtcccagctatttggaaggctgaggtgggaggattgcttgagtccaagagcttgcggctgcagtgagctgtgatcacattacgtgcactccatcctgggcaactgagcaagaccctatccaaaaaaaacaaaaaccctatgattgagaaaccgtgcttgccttggtaaatgttggttgttagtaataaagttgagtccctttgcggtttcttctctggcctgatccagggacccctcttactcccatgacgttatgggcatacgtttcacatttattattgggattggtaatcagatcttttaatctcctttgaactttgggagttgctgaaagcaccatatattttataaaagtctaaagtttataacctaaacaatagctaactaaagacaagactcacagggctgaaaggaactcttggtcaaattggtccatctgtccttagggctttaatgggtgtaaatacattgcccgaggtggttaagtattcttttgttaatgaattctggggagaactccccttgtaactgcttttcacagcttggttatttacaaagacttttgattttacctgaatagaaagcttcttttgtcttttgtgtattagcacattgccagatcctgattaggtaggtatttgtgaagtgccttaactaatttgtaccttaaccaggcttcttgctagaatacatgtttctctaatgtatgcctgggtgctaatagtttggtgctatggaaactacttatatttggttattggggagcagaagtagtatgcatgatgaggctaaggtgatgcctgcctggcttcagctgtgaattttagaaatacactgattaaaggtaaatttttttttctgtccttactgctggatttcttaatctgggaggtacttgatggaatttagcctttttatcccttgaaattataagcagcattttgtgtgcactttttcttatacatgtacctttttctgctgtcaaaagacaacatttcaacacattgagtataaagatctaattggattttattattgattaacaaattaggtagcaccccatctataaaaaaataggtgcccattgggcatggtggaacaatcggtttttataaggttgagcaggaacaggaaaacaacatagtacaaaaatgtgggttaacatcaggttacttgaggttattttccttataagggttaaagcagagggaacttccttatgccagctcacactgtctgtctggggatttgggtatcttctttcctgaaggtaaggtaaacaatttagaagtttaacatgagtgactctattttggtttggtctgttagggtctaggagctcggtccaaattagtggccttccatagattctgtttaacactggaaggagggtccgtagtgttgcgtgtgttagggtgactgctgagagcactgctgaatcctggggaggggcctgcaccttagaactgatcagttctacagtgttagaaacagacctcttttgtcagaaattaagaattcagaaaagttcaaaggatataattaaagtttttttttttttgagacagagtctcgctctgttgcccaggctggagtgcagtggtgcgatctcagctcactgcaagctccgcctcccgggttcacgccattctgctgcctcagcctcccgagtagctgggactacaggcatgtgtcaccatgcccggctaactttttgtatttttagtagagacagtgtttcaccgtgttagccaggatggtctccatctgaccttgtgatctgcctgcctcggcctcccaaagtgctgggattacaggcgtgagccaccacgcccggcctaataaagttttaaaataaaaaagttagacatagctagggtcacttttatgattttggcatataaagagttggcacttataaaatgtacatggttatgtaaatatgttttgtgttttaaaaatttaatagttttgaaattttctttttgatattgtgaaaggaaaataaatctcggtatctccaaattactaagccaaagggaaaagtcaagctgggaactgtgtcaggcaaacctgcctcccatttttttcctaaataagatagctagaaaaataaaaatgctacatacctccctaacaatttgcccacaaggaaattccttgtggacaaagaactcaaagccatcccctctgttcacctaagacaaatgcgtatctgattgcttcctctgccctgttgttttgctaagccagactgaggcataaatgactatgcctctactctcttctcacatggaacttgtgtattcagtgaaaggctaatcaagagacttaaaagaatgcaactgtttgtctattatctacctatgacctggaagccccctcccctgcttccagttgtccggcctttccaggccaaaccagtgtgcatcttacacatattgatgtctcatgtctccctaaaatgtgtgaaaaccaagctgtgccccatcaccctgggcacataccatcaggacctcctgaggatgtgtcacgggcacgtccttaaccttggcaaaataaactttctaaattgattgagctctgtttcagatacttttgggctcacagtatttacagacataattcagccctaatctagctgctgcatttagttgcatagtgtgaatatttcacattttacttttacattttcataaatgggtatatggattatttaggttttgttatgaacagagctctgaatatttatttgcctcgtcctatacaagtttgataatttgtctacgttacatgcccacaaattgaattacaggattcatacacttttttatttttttgagttggagtctcaccctgttgctcaggctggagtgcaatggtgcaacctcagttcactgcaacctccaactcccacgttcaagcgattctcctaccttggcctcccgagtaactgggactacaggcgcgtgccaccacgcccagctaatttttgtatttttagtagagacggggtttcaccatgtggtccaggattgtctcagtctcctgacctcctaatctgaccacctcggcctcccaaattgctgggattacaggcatgagctactgctcctggctgattcgtatacattttaagggttactggctattcttacaattatttaatactaagagactttaatttctgcaaagcagatgagtgcaaaataaccagttataatgtttcccaagttaacagaggtttagttatttttaaaaatgagtttattggccatttcagtttcttctccgtaattgcgtatccattttctttgtgcagtttttggttggatttttgataggtaattcttcatatgttgtgtatctatatactttgttatgtgtacattgaaattttgtttcccagtccgtctgggaaacaagttacttgtcttttaaccttgtttatagtaataacttattctgaagaagcacaggacttgaaccaaaggtggagagtttaaagaactacatccagtattctttaccaataagaaatgtgtggccaggcgcagtggctcatgcctgtaatcctagcactttgggaggccaaggcgggcagattacctgaggtccggagttcaagaccagcctggccgacatggtgaaaccctgtctctactaaaaatacaaaacaattagccaggtgcagtggggcatgcctgtaattccagctactctggagactgaggcaggagaatcgcatgaaccctggaggcggaggttacggtgagccgagatcacgccactgcactccagcctgggctacagagcgcgacttggtctcaaaaaacaaacaagcaaaaagaaaaaaaaggtgtgaccagtcagtcttctttgcttttccatcttaagacacatagaagtgactgagaaggaatagttatgcaatgacatcggtttaataatcagttcaactgaagaatgtatgtaaataagggcagtgatacctaacgctgatagttgatagtgtggattgcataattcagactgtggggtgatatcttacacacgcacatacacacacacactcttgggctttgtcttctttataggtaaggattaggagaattttgacatatgcctgacacaaaagtgctccgtaaatattagctattgtatcactggcaggaagttagcctggaaataagttttatggaattccagtgtagattgctttgtgattgttttgccagattttgctttcacccacaaaaacactaagctctgccaaccagttcggccattttgtaagttaggaaaataaacactaaagtgaaatggcggcttttgggcggggctcccacaggctggctccttttaagtggaatgttgctgtgctgccctcttgtggccatttgggaaaccgcgattaaaaatggaacagtaagtgttaatggcacttcgtttcaaagtccagttccaagaaggttaatcactccgtttttacctacttcagaaagtattttgaagagataccaaattctttttatccacaagcaaaaggaagtggtaaacctttttctcatcagcatttatttttgattggaatctgaattcccagttttgacttgtttttttatctgtgtgttgtattttccttttaattatttgttaagtaaaaaattataaaagttgtttgcaatttagatgttgaataattttcagatagttgtttttcgtgaagattctgtatatatgttggatagtcattcctgaaaatccaatgtttaattgccctgtaactagtaagccactggtagtcagctaattttattactttgttatttaggtgaaggcttaaaggactccactcactaactcagtttgaccctttctattagtcttgtgggctttctgcctcctctactaaaccagcactaaagctacagcttagtactaatagtatttactattataattattaggtattaatggcaattctacatagtcttttaggaaatgtcgtttttttaagggaataatatgaatatatatatacgtatatatacacatgtacgctatatatacacacatatatacacatatacatatatatacatacacacatatatatacatacatatatatatatattttttgagacagagttttgctgttgatgcttgggctggagtgcagtggtgtgatctcggctcactgaaacgtccacctcctgagttcaagcgattctcctgcctcagcctccaaagtagctgggattacaggtgcatgccaccatacctggctaattgtttttttagtacaggctgggtttcaccgtgttggccaggctggtcttgaactcctgacctcaggtgttccacccgcctgggcctcccagagtgctgggattacaggcttgagccaccatgctcggcccataattacactttttttttttttgagacggagtctggctgtgtcatccaggctggagtgcagtggcacgatctcattttccatttccagtttatttagtgattattcctcttacgagaagtatgaaaattaagtaatgactttgttaaggcttttttttttcttctttaagcagttcccctcattagtacttgtattcagtcttacatctgattctggttccaaaaacaatttaaaaacacttttttttttttggagacggagtcttgctttgttgcccaggctggagtgcaatggcacgattgcggctcactgcaacctctgcctcctgggttcaagtgattcttctgcctcagcctcccgagtagctgggactacaggcacactaccatgcccagctaattttttgtatttgtagtagagatggggtttcaccgtgttagccaggatggtctcccatctcctgacctcatgatcttcccatctcagcctcccaaagtgttgggattacaggcgtgagccaccgcgcctggcctaaaaacactttttaaaaacactcattcaaatctttgctggttttgtgtagggtgggatgtacttgccgcccttggtttggatttggctctcatgattagacttactttagacaattaactagtttagacattaaaaatacttaaggtatataatgaagtgctgtgaattcactattaagcttcactactaagtttcagtcataaaatgtcactagtatcattccctgagagcatctgcctccctcaacccctaaaggcaaatatagttgtgaacttggtgttaatcttttcttgggtttgattttcattgttgttatttttgaaattacacaagtaatccatggaactcacaagtatacttcaaataacccatccctaacagagtaaaccagtgttagcaatgtggtgattaaaatgcatttatacacatagatatatgctgacagaaaaacggcttttttttttccccagaaggtattgttgtgtgcattgttacatttctaggaatcactctcctacacaaactcaaaaacacatagctgcacaagaagatacgtagaaagaaagatatttatggttacagtcaacagtttccaaatacaaatactctactcagaaatatggaaagtgtatcagagatatttgcaacttattgattaagtgaaaaatctgaaaataacctaaatgtaccgttaataggggaatgttacataaaatgtagtgaatttatagtataaaccagttcaaagggaatgagatgggcatccatatagacatatcctgatgcgggcattggcattccattacatcctatctgcagtgcttcccacttttcaacacagaacactataaacatttctagttgggctgttctagttatcttcagtaaactaatgctgccttttgtgggtctctagttggtaaagattttcagtctttttgttgctgttggagttttctgtttcctagtagtgtgtagacctgttgtctgtgacagttttattggtggtgattgccaaaacatgattctattcttaaacttttgtctggagttaaacattatagtagttgaaaaactaaatacgttatttcaaaggggaggcaaattgcacattctagcaaatgaatgtgcaattgaatccttctctaatataccaggcacaaagaacatcaaaggagatatgcttagtttgcaagtttattggggaggttgacaagcggccagattactcgatagtatgggacaagtggaggcaaggtagtgtagatgttaacagctgccggagctttggagtgagtctttctaggtcagcatgtgtgtcattgctaaaagtatagagagccagcagggcatggtaattgaagctcagacttgagatgtggctgcctgttttccatctcggtggtggtaactgctgtgacatatgtcagtattgtggaagtatctgataggtgttgagcttaggataggagaccaaaggatgttttctgggagaaggtgatacctaagcccacaaaattagagaggtatttaatttgctgtgtccgcagtgggtgcaggagctagaggggagcaatgctaggtctagagtctggagcagtgggggtgagggaagaaatgattaagtcatgtgccttgagaaattgtcagaggccaggttttatagggcatgctgaaattggatgttatcagtgaccagaagacccggatgcctgggaggtgaacaagccttcagctgcctttgctatgggaatacagtttccaggtactgccttgcctaacatccctttcaagtagactgccctttctattaaataaatcccttccttacttacaaggaaattctggagctgtctctgtacctgtctgtccatgaacaaatagtggaggcaaaactaataaattccagctagtgtcatggattgtggggtaacgactcactaatgggtgttagctggggagaattttgtgttagaaggggaatctcagcttggatgtgatatgctcagatttcctgtttgggtagggctttggcatttatagggcactgctttcatagctgccattagatgttcttatgacactactggtagatgtcacataggttgacacaagttaaaagatgacacaggcctgaggtgagctaggactgaaatggaagctgcgatgccagagcccacagcttttaagtgttcctatcactatccagctctcctcttccttttttctttcctgttgacaacctgcctggtcacaggtataaaataaatgactcagatgctttagtcacctggactagtcagcttggactgtgcaaggggttaaggagtcagtaattgtaatgaggtcttgaaactgttgagtcacttgttacaaggaagcctgttttgggaccttgtgtaacagggataagagttaataatgttttctgagtctctaatcttttggccccctatggtaaaatagaaagaaatgagctttagatccacacttggattggaatcccggcccctcaccctcttcctcaatttctagttttgtccattggccaagttacataaaagaggtcagtttttttcgtcattcatatggtgataataatgcctaatagtattgtccttgggaataagcaaaataatacatataaagtacttagcctagtgtctgatacctgttaggtgatcaggaagttacatggtttttctcatctttccccacttcccagtattgagaacctcccctcgacccctgctctcccattttttctcattgcttcctcatggtaactgaaaggcctccgtattgtaatgtgctgtggatcgcatggtgttatttgcagcagtcccagtttgcagtgtactgccctgtgcacctctagaagatgcagtgatggtaaatatagaacttccccttaccctttcaggttttgtgccacgtgtcttatctcctggcttctgaactcagggacttttctgttaatgttactgtaggttctgggtttttccttgcccccctcagagcaaagatgggtagtttttaagcaagagtaaacagtccacctcttgctgtagagtccatccgtttgaggtctttttgcttcagagtatcttcccctctaccagcatgcccctcagttgctttttcaccattagaggaagatgaggatattgttttctctgtgcttgagattgatactctatcacccctcagtctctgtggtttctgttttgttcctttagatgacatctacctacttaggttgctgctccctatgggatgtttggaatgaagaagggaagggagatgtgtggaggccagtagccgtctttattgggttgggtgttctcattagcatcagagtgccctttttgtttacttacttctgttaagtctaccacttctggatctcactgcagattataaggcagggcctctggattgaagttaatgtgtataaatttttataaagctcctcagatgagcctaatttgctcctattagtgagaaccacgattggataattgcaaccagtttgcattcttcctctttgggtgagatgctttgttttttttgtttttgttttttggagacagggtctcactgtgacacccaggctggagtacagtggcgtaatcatggctcactgcatcctcgacttcctaggctcaaatgatcctcccacctgagtttcccgagtagctgggatcgcaggcatgcaccatcatacccagctaatttaaacattttcttgaagagatgggttttgcatattgtccaggctggtcttgaactcctgggctcaagcaatcttcctgcctaggcttcccaaagtgttgggattataggcttgagccactgtgtccagcttgttttttttttttttttttttctggagaccaagtctcgctctgtctctaggctggagtgcagtggcgtgatcttggctcactacatcctttgcctcccaggttcaagcgatccttctgcctcagtctcccgagtagcttagactgcaggtgtgtgccaccacagccagctaatttttgtatttttaatagagatggggtttcaccgtgtggtccaggatgctctcgatctcctgacctcgtgatccgcccgcctcggcctcccaaagtgctgggattacaggcatgagccaccgcgcccggcctgcttggtttggttttgttctgtgttttgtttttttcttgttgagaggggaatgatacttaacagataagacttcgtggattcatatatatctggtttcaaatcttactgtgttaactaggtgtgagagttaaatacttatgagcctcagttcagcctcatttgaatgaaggggacagtaatatccatgttcagagtttctgtcaagagcctgtccatagaaataacctgttctgtagcatcatgtaaacattcaggaaagggtagctattggggattttgagaatggtagcaataacgttatttggaatgtaaaagtataaatgtgaatttgaagattttggtcttatattactaaaattactatctgcaaatgttttaccatgagaatttttttttaagcagattcatgtgtcagttcttaaatatttttaaatctctctctctctcaaaataagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaaggtatctactttgccctgcagtacaaatgtgctgctagcctaggacaagctagcagacctttgttgttcatgaaaactcattagtatatcttgatgatgaaacctacagccattttttctagtaatatacagtagtatatctgaggatacaaatgaagacttctttctgctctattaaggaaaataaatgacctgaaccatccaattatagggaggaaagacaaatttttatacgcttggtttttaactttatttatttatttttgcaacagagtcttgctctgttgcccagcctggagtgcgcagtggcacgatcttggctcactgcaatctccgcctcccaggttcaagtgattctcctgcctcagtcacccaagtagttgagattacaggtgtctgccaccacgcccagctaatttttgtatttttagcggagactgggtttcatcatgttggccattctggtcttgaacttctgacctcaggtgatccacgtgcctcggcctcccaaagtgctgggattatagacctgagccaccatgcccagcctaaaatatatttttaaggttaaagtgagcagttccggaaagttaataatatgtagttataggttggatggacctacaagccagtcagaatgattgcactgtgcctttgataatcattatcctaaaatgagaacttctaaggaaggctcttggttttctatgtacacctccttttcacatggtagctctctgtccccctccaaaagcttattactcatgtaagagtactcagtagtgagtaactccacatagtagatttttcatggaggagttgacttagatatcggctctcaaaaggacaaataagaacacaagataattttaggatgtaaacattataatatatgctgtaataaagtcataatagttgagctagaatgcctggctggtatcttgaagtgataaaactagttgatgtagtaacactgaaatgattttgccctcccagttaataagggctccataaaaacctgtgttgagtaaaaactttcatagctctagcagagggccaggtgtgggcatggatagacaggctagagtaaagcgcactttccctccttcctttctctgccaggttttttcagagtgttttatgtttactgcctctacctatatttcctaccatttggttattcctaactccttctgtttggaccttttgtcctttaactccaaggtgatgctaaggccgttacagaatctgtggactttgggttatgtgattacattggattctagttgtaaaatgcctattctgggccatcttttcttttgaagccttgattttcttcagcttacttcatcatttttatgttgttgttgttgttgttaaagtcattgttgataatgtcctttcttagtgacattgttggatcatttttcataaagatgagacagggtcttgctctgtcccccaggctggagtgcagtggtgcaatcacagctcactgcagccttgatcttctgggttcaagtgatcctcccacctcagcctcccaagtagctgggactacaggcacgtattgacacacctgtctaatttttaaattttgttgtagagacaggatctccctacgtagcccaggctgatcttgagctcctgaactcaagccattcttctgcctggacctcccagggtggtgggattacatgcctggccctacacttttaaatacaaacatttcacaagtctcagctagtggcttcttttgtgcatgttctgaaccttacttttccaaatattctcatgacgttagctgtcacctgtaatttgataacccatatttctcatctcagcttttgctacttgcttaatttctgttacaccttttcatgtcagtgttccacaatccattcaaattccttttgcttatgtgtgattctgttaaaagaatacagaatatacttagtagtagttatctctggggaagaaagtgaaaatgatttttctcctcaactaatctgtcttttaaactttttaaatcactggtgaggattgttacaggtcttaaaggttgttacaggtctacaaaaatcaggtcttaaaggcaaagggctaattactgctacagaataaaaaatagatgtgttagagaaagggtggcagtggttctcattctgagaacttctagctaagtgttagcaatgcctcatctgcgtttatctgggatgttacatgacctgaggaacttaaagaaaaatacaaattcctgattcttacttaattagacttaatgggggctttgccgcttgtattttcagtttcacaggtgtgggttagtgcagtcaagactgaaactcaaagcagtagggaatttaaaatgtatcagtaaatactttgtctttagtggaagcagccgctgtcttacctttctgtattattcagctgtatgtttatattttaatgatgggtaagcggtgtaccatatagatttatagctgttaagtaatgaagacattgttaaactaatatttcctaggataatatgcctattttaaaaaaaatggcgctttattgtctcataaatagaactagcaaaacaacccttttgatacttggttacttgaattctcttcaattgcaataaacgtttgataataataatgggggtcaagaaaaaagattaatgcgtggtctcttaattttacagatgtgggaagaatatcctgatgtttatggggtcaggcggtcaaaccgaagcagacaagaaccatcgcgatttaatattaaggaagaggtaaggaaaaaatgttttaagggcatgcatttaaactccctatcttacttcattctttctgactctggtatgtattaccattaaaaagactgaacttcaggcatgagggttaagtgactctaatatgagctatctatgaccagatacagtaaggcaagaagttaataatcaaataaaagaatctaaccagaaagatcatataatagtgaattttttagtagagtattatacagaactgacctcaaaatggtttattttttaagttgtctctcatagtgaaaattgattatatatagcaagaagtttacctttttaagcccctaacttctaaatctcctagatatttattaaatgggtaacttgtttggtaaacaaacagagcaatagaaatagtttgggatttattcctgaaagaggagggagtgcttaattaatgtatctacttttatttaacttcttaaatttggtttccttgctcatttttagtgtgagatataataaaatgagtttcaaacatacttactctaattgtgagagattgatcagtgatttttttaaattggtattctataccaggcttggttgtctatagaatcagacttctttcacctttctcattttgtgtgatatttttgtggattcttattctgaattaggtttatagactagatcctgaagagagattcttttgtctcaatgaaatgtctactttctgctttcttgggaggactttgctagtcttagctatataacgtacttctgatgaaagttaaatattgatagccacaggtcagtgagttgggtgtgggtttttaaataaatgtaccttaaaaatctaattcaccctaacatctgcattacatttgtgatgttttattttgagtgacctctgagctgttttgcctttgcttttgttttccatagtgtctcgcactaggttactgagccatgtttgttaaaaccaatcacatagttgtagaaatctttccctcttttacatattaattaacacattctctgtagggtacaagattaacagcaataggaatagtttgccattttccttaattgtggagagaaagagctactgaaatgtctgtgactgtaagctttccttggcctagtgctgttagcagagcactgttggctcatgagtgaacatactcttaaatgagtctaaaatgaatacatcagtagttggtgcctttaaggcacactgactaaatgttgtggcatttttatttgatagtctcaatctgcagtatccagtatggtccccactactcacatgtggcttttaaaattcgcattagttaaaaataaaacttccatttctcagtcacaccagtcacattttaagcgcttggtagtcacatgtggctgatgggtactgtattggacattgtagatacaggacatttacatcgttgcagaaagttattggatattgctgttctggaagtcaagctgagataaatatttcctggctttagagataactcagtgatagcagagagatattaattttcaaatcaaaagaagagggagttccaccaagcaagtgcttaggtttctttgtgtctaaaagctcatattgaataatggtatattgagtagactgttgatccaggagatagtgttgtcccgaagaactgtgaattaaagtctgtaatcatttttcccccctcacacactgaaggcaagtagcgggtctgagagtgggagcccaaaaagaagaggccagaggcagctgaaaaaacagtaagtctttcatgggggaaattattcaatctagtagtttcaaacttgtcagcatttctaggactgccttcgttgtgtctttagtctactccaggtcccttagtctgcttctgtctctcttactagctcgggtgactgtctaccttgacctgttgcaatagcagcagcagcattggaaactcaagattctcagtttaacacatggaaggggtccacgtatactcgagcttttgcttgggataaatctcagcttcttccatcgggttaacccaattagcccattgatttttttcagaaaaatatgtataaataacaagtacacaggtatttggtattgtagtaagcaaggaacaaatgtagatttgctatttttatggcaaaattatattggctgaacatccattttggtaagaaattacatattgttgtttctgtataattttaatgttgcagttcataagccagaaaaatttaatttgtggacttaatgtggagtttctttataacatagatttatatgttgattttttaatttaaaaagttcgatttatatgatatgaaattatttgattttttttgagaaataatttttaaagtcattttttggagagggtgtggatcccgttgacaatctgaattctatagcttctctcaaaaatgtagatattcaaaactttgtataccagttcaggggttctcatgttaaacagttgtccatggcttctattaagagctctaggtacatatgctctgttgtaaaatattattactctttagtaagtggcctaaggcaagtcatttgagattttaaaacccatttcctcatctccaaaaaaaaaaataataccatctacccaacaggattattagaaactatgctaagattttgtgacattaaataaatgtagggtattacagagccttacagaaaagtacttaattttgccctgctagagcgcattcagttttcatttgtgttttggagaaatagtaactgtaagcaaacctgcacttggcatcttagaaggcttttgttctgccccagtctcctggtctgcttgggagactattatctgcttactggtctaatggccttttgagtatctttcctgaaatgtccaccttgattacaccctgggaaatccatgcatgtaatcattacttcaccatctggctacattcctttggtctcttgactgcaagttaaatggtgctatgcttgaattcttgacttcctattttaatggccttatttgtgtgtgcagaagccagcgtttttttcagtcactgtataatacattgcgcttactctggttactggctcatagtcttgtcagcctttttgttttgttttgttttgagacagggtctcactctgttgctcaggctggagtgcagtggcttgatctcagctcactgcagccttggcttgctggacttaattgacccacctaagccactcgagtagctgggactacaggcatgtgctatcatgcccagctaagtttttaaaaatttattgtatagatggggtctcactatgtttctcaggctggtttcaacctcctgagctcaagcagtcctccagcctcggtctcctaggattacaggtgtgagccactgtgccccgccacttatcagtcttaagaattccccaaagttggcaaccttcagtagcatatatggacctttcttttcctgagtagaacctcttagttccttgcagagtgggatctgtcttctttttcatattgcttccctaccctagggctgttcataggaactgccttgggctgagatagttcccctcatgttcctgtgtttgggcactgggctagccttcgtttctgctattctctggccagctggtgagtattgtggatttacagagagctcttctcctgagtcaccagttgagattcctgaaagattaattaggggaggtcttgtagctgctgacactcaagttgcaaggcactttaggagccttctgtgatccaagctgagcaagtgtaacataacctaatgtgtggtcacatgcatttcagaattcagactcactcagagagtgaaaggtttgaaatattggcacaaagaaatgcttttctgaaaccctgcagattttattcacacattttagagtttttaaaaagggaccattttgtaaaattggtttaaaaaaattaattccaaactttaggaaagttgcaagaataaaagtgcagtacaaaggacaccttatatactttacccagattaccatttttcctccatttgctttattattatgggtgctgtttatttaagagagagggtcttgctctgtcacctaggctagagtgcagtggtgcaaccttggctctctgcagcctcaatctcctgagctcaagtgatcctcctacctcagcctcccaagtagctgggacgacaggcgtgcaccaccatgcctgattttgtatttttgtagacatagaggtctcactacgttgccctggctgttctcaaactcctggcctcaagttatcctctcaccttgctctccaaaagtgttgggattagcatacgtgagccactgcacccagcctgtgtatatttatatatatacaaacataatgttttttatgaactatttgagactaaaattcataaaattttaccttttatccctttaccttaaatatgtaaggtgtatttcttaaaaataaggattttctcttttataagcacagtacagtacagattcaacttagatttaaaacattgctgacgtacttttttttttttttttttgagacgcagtctggctttgtcgccaggctggggtacagtggcgcaatctcggctcactgcagcctccgcctccggggttcaagcaattctcctgccttagcctcccgagtagctgggactacaggcgtgcgccaccacgtccagctaattttttctatttttaatagagacggggtttcaccatgttggccaggatggtctcagtctcttgacctcgttatcagcctgtcttggcctcccagagtgctgggattgcaggcttgagccaccgcacctggctgctgatgtacttttgtctgattcatatttcagttttgtcaattaacccaataaagtctttcataatatttttccatctctactacaggatctagtttagggtcagttacatacaattagttgcacatcttttttttttttttttaattgtactttaagttctagggtatatgtgcacaatgtgcaggtttgttacatatgtatacatgtgtcatgttggtgtgctgcacccgttaactcgtcatttacattaggtatatctcctaatgctgacccttccccctcccccccaccccatgacaggccacagtgtgtgatgttccccaccctgtgtccaagtgttctcattgttcaattcccacctatgagtgagaacgtgcggtgtttggttttctgtccttgcgatagtttgctcagaatgatggtttctagcttcatccatgtccttacaaaggacatgtctgatttctttaattgggagcactttcacagccttcttttgcttttaggacattgatgtttttgaagaatgcagtcttgcaagggactgtgttctttgcagaattacgaagagaccaattaccccgtcacgatttgtattaggtttttattttttgggatggactctcgctctgtcgcccaggctggagtacgatggcgcaatctcagctcactgcaacctccgcctcctggactcaagtgattctcctgcctcatcctcctgagtagctgggattacaggcatgcgccactgtgcccagctgatttttgtatttttaatagacatggggtttcaccatgttgcccaggctggtcttgaactcctgacctcaggtgatccacccgcctcagcctccctaagtgctgggcttataagatgagccaccgcgcccggccctttttttttttttttttaagttaaagagacagggtcttcctctattggtgcacatgtgtggccatagctcactgcacccttgaactcctgagctcaagtgatcctcttgcttcagtctccccagtagctgggactgtaggcacgtacaaccacatccagctgtattcatacttttaaagcttagaagaagttatacagcacaatggacctgcacaatatttaaaatatttttaaattagttagcatcatttaattgagagtgcataacaatctgtgtttttagcttcttttgagaaaatttggtaatgctggcttatgtaacagtgatggaccaggagttctccattttgccttgtttgcagttctcatctggcccctgtgagtatttgagattgtaatctctgacttagagtcatacaaacaaacaaaacattgaactttttttaaccaactcagatgctgttttgattaaactctttttttcatgcattacctcttaatgttatccaaattgcgcagtgttgtataagatttttgttgacttctggtcctggtggttttgttttgtttttgtttttgagacggcgttttattcttaccaggtgggagtgcagtgcagtagcacattcacagctcactgcagctttgacctcctgggctcaagtgattctcccaccttagcctcctgagtagttgggactgcaggcgcacaccaccacaccaagctaatttcttaattttttgtaaaggctgggtctcactctgatgcccaggctggccttgaactccttggttcaagccatcctcccaccatggcctcccaaagtgttgggattacaggcatgagccactgtgcccggcccttttccagtgttttgaattggagattgtcacatacctgtaacacagtggaagggaatccctattagcctcagatttctgttgatcattggaatttttttttcaaaagcatgctttcttggggaaatctactgaagactgaggaaacaaaagtagctacttccctcttccagatgtcttctaagtggaggaaaaaggagttttcttttttacagacagttaatagcaagccttaccaactcttggtcaaagttctggctcattatatttaaaagtagcttttgttcatttcctactttacagttgattagatttgatttgtctgtcttaggatttgtgtctagccaaccaccttttcccaataaaggaagaaaactatacacatttaaattgcattttgactttttccatgtctatttacattgccttggggcctcttggctaaatcttggtatttttctccctagttctcaaaatttcgggaaaaatttagttgaattatgtgtttttacagtatctaggggggactctgttaatggcctctaaagctggatattgtaagtttcctttgatagacattttttgctcacgatctcatatcttaaactattctttattgtagactgacttacaatgtatggcttagtggtggagtcttgataagatttgcattttataagaggccagtaatgtaggagaggacagcagtttcacatgtgggagagccttatacatctgtagggttgggaagtaatttctttgtaacagctcagtcacttttttcacttcacccattcttcacagtgacttagtattgctggtccttactatcttttttctcgttcttgaaaatgaaaagaaaacgtgaaagaatccaaccaatttcaaatatacatacacacacacttaggccttttaaaccttgagtttttcaaatactcccaggacgtgtaagcctggctttaatgtttcctgattctttggtcctcagtgagttatgattgaaagtagcagggctgagggttggtgatatggccaagcaactcatttcctcactgcacttcagtttccttctctgggaggagaactttggactagttgatttgctaagttttttttttctttctttctttcttttttttttttttgagaacagagtctcgctttgtcacctaggctggagtgcagtggcccgatctcggcccactgtaagctccacctcccgggttcacgccattctcctgcctcagcctccagagtagctgggactacgggcgcccgccaccacgcctggctaattgttttgtatttttagtagatacggggtttcaccacgttagccaggatggtctcaatctactgacctcgtgatccgcccgcctcggcctcccaaagtgctgggattacaggcgtgagccaccgcgcccgaccttttttgcattcttatattgggagattctaagtcctcctggttgttcataagtctgtaaatctgtaatctaactggaaaactctagcctcaacacatccattctctgtgtttgctgtctgctatacttatagaagtggacctcattggtggccctggtttaggttctcaattcctgggggagatatggtaattagaatttattggtgaatctttcttatctgaaggactagctgttcatattccttcaagcatgcttctacttctctccagtttgactgtgtaagccccctctgaggggtaaactgttgtggacttggtctgagggagactgcagactcatgctggtctcccacttactgtaaacatcttcctttcttccttcctggtgatcaccttatattccttggattcttagcaaacatttattgtactatgctccggggaagcagaattagaccagtgtccagagtgtatatacgaaggtctttgttttaaagagactgaaggatattaggcaatactaacaggcctttctgtcttaccagaagcacccctacccgtctgactgatagactaattgcgcattctttcattgatttttttttttttaacctaacaaagaaacatctccatttgcctgactttggctaaactctggtacaaagacgaacaaaaagtcttggtgtacaaggacccatctactggggaaatgcatatggaaacacgcagtgctagtagaagttgaataatattcataaaattgctccactgaccgtccgtggaaggcctgaattgttgttttttccccctaaggtctccaccaattcaggtttagggtgaccgttgtagcttttaggaaggttctcaatctgcacatcagccacctcctttcaataagctttcaccattacttgacctgttctcccatgaagaatattgatttgacatttgtcttgttgtagctgttgtctttagtatgacctcattccctataaagtgacccataggcaaattggtaattgtttgatttacagagaagccccaggcacttgcctgtcagttttttcctaggtatttcatgcctagcagctattacatgtttcttccctcttctctgtaggtgagaaatgagtggggtccctgcaatatcttgttggattttcaagtaaactaaaactgtttgggatagtaggacgcctgtaggttatggctctttcaagccttctaagaattcaaggagcaaaggaacatctactgtatctaataattattaaaaactacatctttagctgaacagattagttatatgataggtttattgttgaaaaataattttagggactgtttccttaaatgtattctagagacttaaaatatctagtatagtggttctcagagtttctacccagtatcagcattacttgaatttgttgaaattcatattttttaggcctcaactgagacctactgcatcaggagctctgactagggcccagaaatctttttttttttgatggaggaggggcagataggggcagggtttcactcttaaccgcctagggtggagtacagtggcaaaatcacagctgactgcaacctcaaactcctgggttcaagtgatccttccgcctcctcagcctccttagtaactaggactgtagacatgctccaccaggcctggctcaattttaaaattttaactttaatttttctggagaggtgtcttgtattgctcagcttggtcttgagctcctggactcaagtgaaactcccaccttggcctcccaaagtgctgagattacaggcatggaccatctcacttggcccagaaatcttttttaacaagccctttaggtggtcctgataacattttaaaattttggaagcactgatcttgtgcatgttatggtttcaatcttgtcaataagagtagtaaatgaaaaaagtacatatatatccatttttatttatttttgttactggagataaaataggaatcgatattatgtagtccaggaaggatcacaattcaagtttaaatggagctagaatctcttttagcatgtctaaaatgtgcatgttctgccctttggatagtaaaattgaaattggttttgtcggattatttatcttgaaggattcttttagaaaaaaattactttgttttgcttttgatcacagagaaaaatggaaacaggaaccctcagaagatgaacaggaacaaggcaccagtgcagagagtgagccagaacaaaaaaaagtaaaagccagaagacctgtccccagaaggtgcactgtttgcttaagatctctacttgggatgagcttaatctgctgtagattgggaaggataatgtcgtgctgaaatgagagctttaatgagatgcattgtgttttgattctgcgttttagatatctgtggttcactttcagccagcctacattgcaggtcttactgcttctttcttcgcagactggctatcgtggggcaaacatgtcttccgcttttagtaaaactccttatatgtttggccagggtacagtctctttttgggagaacaaattgtttaaaacactgtttgcctggcttaaagcatacttgagtggtttattaccttgttcataaaatctatataacattaaacaaataatctgattgtgtagagaaggaggtaggctgaaatagcagcaaattatgctaatttttgataagacagatggcagcctaagatagtgatgacaggaaaagggagtcagaagacaggccccagggaaaatttcctccttgtagtattgcttagaatggactcagcaaactatgccctttgggccaaatttcatccaccacctattttcatatggcctgtgagctaagaatagtttttatagatgaacatttctaatttacagtttaaggatagagagcactaaatttgaactccaattaagtgaaatgttatcccctcaaaaacaattctgttctcattagtagatatatattgcagtaaatgtacctgattatttcattttgaattatttaaaaaaatttgtgaaaatttattttctttcattatgtaaggacctatacattggtccccattttgcctcttggctggcagagcctaaaatatttactctctggccatttacagaaaaagtttgccaacctctggcctaggacattgtacttaccccccaacaccagcaggggaatttgtcaactgaattttatcttattttatctcagcttaataagtttatctcagaactgtcacgccagttctgtcttttagaattttgctcattatttattacatcgttgatcatctgtttaggtttggttatgagaaaggtatgggaggtatgagagaaagagataataaatgtgatcatgagtatccatttctctccctctctgacttctttcacctttttatcactgatggaatatttggggatttccttaggtgagcttctagactgtggctttcaatcctggccatctccctggtctgtccaagttaattctgtgatagggcacacagtctctcaggtagtattccaggtatattttatacacatacagtaaaaacttatgtatagttacttcttgtgctttactttcttcacacagataatagcatcctctgctgcttgttctgtaggtttctttatcctggaaatcctttcgtattagtatacaaaaaactctttttttttttctatgagtacatggtactgtttagtttccagttgaagaatatttagagttttcttaatgttttgttgttgcaaataatgctatagtgaatactttattatgcctgtttaggtgtatatcaataggattaattcctacaagtaaaactgttaattcctacaagtaaaatagtttgatagctatttccagtttgcccaccaaagagatactatcatgaacaacatgctgtgtatgtgtttttatatcaggtaatcctgatgaacatttgtgaaacattcacgttctttcccataaatgattgaggattatcagcattagaatgaccttcctgttggaaatccagatttctagtgaattagaatttcagggagtagggcccaagaatatgcatgtttaacattccccaagtgaaatgttacattctgatgtatgaaccactgctctgggaaatactgttatataaagtagacaccaaatgataaagtgaagacttagccttttgtttctcttctcattttagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttaggtaagttgtaccccagaagtgtttcactggtgtgatgtgataaagtagttggttagattttggttctcataagtccggggttgtgcacttaatagataaaaataacagcctatgtcctgaagttgttttcagaaatctggttagctttcttgcaaaaagagtggtattgagccaaggggaataggaaaagagtagcaatagctcatttgaagccttcattcctaaaaaacaccacaagttcgtgtcctgtccaatggtgacttagtggcattatcttcatttcataacatttttttccattaaagatatttggattatattcctacttctgaattgctctttgaatcacagacgtttttctgaggttcagcttaacgtattgctacttgaatctgattttatcaagtactaataggatatgaagcattaataggaattatcattagtgaaataggccaggctcagtggctcatgcctgtaattccaacactttgggaggccgaggcaggcagattgcttgagcccaggggtttgagaccagcctagacaacagggcgagaccctgtctctacaaaaaataagaaaaagccgagtgtggtggcggcatgcacctgcagtcccagctacttgggaggctgaggtgggagaatcctgggagatggaggttgcagtgagttgagatcacgccactgcactccactccaggcaaaaaagctagatcctgtctcaaaaagaaaaaggaaaatgaaataaaggaacagatatatgcaaacactagtagtttactttatagaaatcaagtatttttttttttagattttacagatttgttcttcatagagatggtgaaaatgaatcctagagatattcataacttattcaatgtatccagttaataattccaaagctaggactgggctttgagtatgctagtgtatagcctagcactttttcttactgtaactgtactacatccaggattgtttttctttcttgtgactcaatcattcattgttaatatgtgataggaagttacatatataaaaatatatataaaaaatataaaaaatatataaatatataaataaatataaatatatataaatattataaatatataaaaatatatataaatatataaatatataaaaatatacatataaatatatataaaaatatatataaatatatatataaatatacatataaatatatataaaatatatataaatataaatatatataaatataaatataaatataaatatatatataaatatatatatataatttttttttttgagacggagtcttgctgtgttgcccaggctagagtgcagtggcgcgatcttggatcactgcaacctctgcctcccggattcaagtgattctgctgcctcagcctccagagtagctgggattacaggcgcccaccatgccggctaatttttgtatttttaatcgatacggtcaccatgttggccaggctggtttctaactcctgacctcgtgattcacctgtgtcagcctcccaaagtgctgggattacaggtgtgagcctccgcgcctagccaatatgtttctttttttaaaccaggaagtatttgtgttgaagcttccagcagtctgggaatacttaaatttcatattcttattactgggagacaacatacagggttgacatttttaattttagaaatattgcttctctttttgcctgatgaaatagtagcaaattttttcttccattatggtttttctttttttgtgtggtagtctacttgtttacataataatctgatactaaaaaatgaaaaaaatagaagtgtccttatagttttctatatcttgcttatacaaatcagtataaatatagaatttttattttcaaattgagttagactccctacagttgtttaggagcattcatcagcactttaggaaaaaaaagtaagctttgagcctactgtaaatggcagatctataaaacaacatgcttttggaaccaaaagggtatggtttcttattctagtgacggttatgtgtggcagtttaattctgaagagatcatttctcatttattcagcattattcctcttgcagttacaaagaagatgatgactttgagactgactcagatgatctcattgaaatgactggagaaggagttgatgaacagcaagataatagtgaaactattgaaaaggtcttagattcaagactgggaaagaaaggaggtatgtgtatttggggagcaaattacattttatgtatgcttagtaagacttagattttaggtattttaactctaatgtgatgaattttagtctactgctgtatttgttgtgatatgtagaagtctttctgacccagtgtttcagagctgaggacaaaggtatgtgtacactatgtctttaagattttaaattaagctagtatagataagtgtcaatgttttataaagcagtgatatagcagagatacctgctaattaacattaagcaaatccacctttggttatttgtttcttaagctccttgtgaaaatatcaaactggttaaataaatattgtggtaatattgaagatttttaaatatctaatttagatatctcataactaagttgcattaaagtaaactttctgtaaaggaaataccaaaataatacttaatgctttttcttttggcttttttttttttttctttttttcattctggcttcgattgaggttaagaaagttaaccggggacttcgagtaggggaggttggaggaggatattttggtgttctatccttagtcttggagagagggatttgttttccgagttagtaagggaccaaaacaaaaggatgttgctgctctgtttttattgtttttgaataagggatttctttgatttcacctgcaaatttaggaatatgtaaaaagtggtttacatttttaaaatacttgaaatttttgattgagtccgttctgtgttgtttgtgagtttgtacttatttcaagttgaagtattttggtgcttcatccacaaagggagtcttcagataattgcattcttgggaagctttttaatatctggtgtaatatactctctttcaagtgtacttaatccttttgcagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggtatattttccatcatggattaaagaaatgtatttgcagcctgaaagaagggaaggttttaaaataatgcatggagatcacagctatctagaatctcagattttgctttgatcatctaaacatggagccatttacaattctattttataagattgtgaccttcagatactatatttttatatgtggctaccaagtttttggagttaactagcttatggagcgttattcacacattctttagttttcacaataagtgcatgagatttgtactgttattacccattttgtagatggggagaatacggcacacagcaattctgcaagtggactcaggttttgaattctgatgccctgaatccagagcttattctcttaagcaccttgttattttcctgtagttaggctggggtggcttagatgtagagagttaatattctggaactctctgggttatgatatacttaaaacaaattctggttttatacaatttgcagaaatgatgtgaaggaaattattaggttaactactgaaactgtgatagtcctcgtgtgtttagtttacttacagccttgaatgtctgggtgttgtatatgggaaatatgtggagctatagcacacaaaaacctaaactgggtaataatggtatcaagctcagcctgaagacatacctgtctgtgtggtgtgattagcctatttttgtgtctggaatgtgcatagatttttgtgtctggaatgtggacagtaattctggttttactactgtgcaaaatgtgctactttagtaaattacatgttttttctttgactcaaaactgaaaatatgtaccccttagatggtgaggtaggcttgtaaagcagttagaaatttgaaatcctctgaaatataataattctaatattaagttgctgctgttgtcatctgaaaggttttggtaataagaataactagttttccaagtcatgtttaatcaatcctaaaacccatatatatataagaaaaggcgtacagttttattatcctgatttgttgagatgtatgaatttgccacatgaatctatcacataaaagagttatttttgggtctctttttagacaggacacatcagaggcaggtaactggtatatccttctatgagtgtaaggttttcagtgttctctaaaagtgttttttttgtttgtttgttttgttttgtaaaatctctggcgtaattactagtaaagattacttaaggggcagatgggagtaaaaaataggttttcttttccacctttgacttttgctttgatgtatgtggatccccagactttagtttatgtgtactttttctgtctgtctgccattcaggttagggaaagtttctcctgaagatgtagaatatttcaattgccaacaggagctggcttcagagttgaataaacagtatcagatagtagaaagagtaataggtaagtacatggtaactcacttcagccatatttgaacttgaggaatagtggcttttgcttttggaagtaatgtaaattttaaaaatgcactttggagactagacacgtgctaggtttattttaaaggaaaagctaagaagatttgctggtaaatttggatgtgggggatgagagaaagaggtgttaagtatgacctcaagatttgtggcctaaacatgtagaagtttagaggtaccatttaccgaagtggaaagatgaagggaagagctgatcattggagtggagaccaagagcttagtttgatatttgtaagtttgatttacttcttagtcatctaagtggagaatatagtgaaggctggagcatatgtgaacctggagcttaggactctttagtctgggctggagatttaaatttggaaatttatcagtatttagtatttaaaggccaagattgaacaggaccatcagaaatagagtatcacgtggtaagaagaagtagtctgagagcatttcagcttttggaagtcagaaagaagctagcaaaggagactgagaaagaacagtcggtgagacaggaggagagctgagagagagtggtgtactggaagccaagtgattcacatagccaggagagaggaaatgctgtcagtcaaggacgattaggactgagacttgatctgtgaatttggcactggcaaaacgcatccatggagtggtgagggtgcggcctgattagggtaggttcaagagaaaatgagaggggatagcaagtataaacaactcgttgggggagttttcttacaaaggggaacagagaagtggagtgtcagcctgagagagagatgagaaaaagaatttttttcttcttcttcttcttcttttttttttttttgagatggtgtcttgctctgttgcccaggctggagtgcagtggcgtgatctcagctcactgcaacctctgcctcccgggttcaagtgattctcctgcctcagccttcccagtagctgggattacaggcaccccccacccccaccacgcccggctaatttctatatttttagtagagacagagtttcaccatgttggccaggttggtcttgaactgctggcctcaagcaatctgcctgccttggcctcccaaagtgctgggattacaggcgtgagccactataatcccattttttttttttcttttttaaggtgtgaggtagtagaatatatttacattttattcatagaacccaaaatctttcattcttcattgtgtttataacttttctgtcttattttttatttgtttagctgtgaagacaagtaaatctacattgggtcaaacagattttccaggtaagcaagaaattttatttataaatgttcttcaacatttcagaacagtgtatgttttgcagattattttgttttgccacatgatgttttattgattatgcataaaacagaatgtcatttttcacttttaattgacagttgctaatctataaattttttttatatgaaatagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggtatggtgatggttggcttttgttttttcagggagaagatatactgataaagaggattggacacatatgtgctgagaaaatattacaaaatgaaatgatgattgccattttgaagtgaaagaaggtgatttaaatatgacattaaagcaaaaggagagaatgaattatttcatggctttgctgacttgtttaatcttgcaatttacataattagaaatagagatatttgagagaatacttgaaaggatttaggcacttttattttattttattttattattttattttgagacagagtttcgctgtgtcgcccaggctggagtgcactggcactatcttggctaactgcaacctctgcctcctgggtttaagtgattctcctgcctcagcctcctgagcagctgggattacaggcacgcaccaccacttccagctaattttttgtatttttagcagagatggggtttcaccatgttggtcaggctggtctcaaactcctgacctcaaatgatccacccaccttggcctcccaaagtgctgggattacaggcgtgagccaccatgcccagttgcatttaggcactttaaaagagaagtgaagccagttgcagtggctcacacctgtggttccagctacttgggaggctgaggcggcaggattgcttgagcacaggagtttgaggccaacctggggaagattgtgatacccgttctctaaaaaaaaaaaaaaatagagagcgggaagtgatagaaaaggcgagtgtctttgaattctaagttagaaattaaatatataggcttatttgctagattggctgaataaatcctttccttggaatttattccatcaggaaactgatgtgcttgggtcctcagtaatgaaatatcagacaagtgatacgtctctgagaagttgacattcatgttaatggcactagaattctatctgtgaaaaccagtatttaattgccaaagagtgtgatagggaaaatgtggtcagagaagcaccaatgtagaagtctctgagctccagtggtcattgaatgggttttaagaggaagttgtggttgttgaactgcatctggcccttgtataatggattggtgctgctggctatacagacaagagggggcccagggtattgccctcctgtgaaaggtatcaagagaaagattcttatagttcaataggagaactactagaccccaggggtgaggagaagaggaatgatgttgacaagtacatcaaggtcaaagtgtgtgtgtcttggctacctcgaagggtattttgactttatctcctaggtattcgtacagctgagtacagtggcattatgaaatagttttatttagaaagcttcatgtaatagcagtatataggagactctggagtaagtaattattaaagccagaaggtccagccagtaagatgtcattgaagtccacgaatgaagaagtagtgtgaggacaagggaagtaacagtggcgtggaaggagtggatgggagaacagttatggggtaggtttggtaggagtggatggatggctgggttttggagttgagagtaagcagtcggattccattcactgccagccgccctcatagagaactgaacacatcaataaccttatcaaatattcttattagaatgatacttctcataatgtgtgctatagagcactaatcttcagagaaaagtcccctgaaaaaagactttttggccatgtaactttgagatacatccctgaatgaatttctcctgtaaattcacgctatggacacacatttcagactttgaaaagtcatgagtaaagaaattgtataactttttgatcggttgtttcctaaactgatttggccacagaatccacattttatgcaaaccatagagactgacctcactagaatgctatcctttaagcttctgggggtgaaaacaaccttcccttcagaagcttgtttctgaagggaaaaccaaattcacgcaattaaagggtttaaggtagatgggcggcatttctgaatttacaaatcctgttatggtgaagatcaattgtatttagcatatgacagctggaggcaatgttttgtactctttagaatcagataacagaaagatagttgtttctgaaaaataggagactctgactgccatataatagacaagacctaaagtgctatttaatgatgttcatagatttatttcaggaaaggggcaagttaactaaaaatattttatttgaggatgaactaactctggcttatggaatattaaccatgaagaaaggggtgatggagtgaggtggtgattcacacacatgaaatttaagtttttggccaggcgcggtggctcacgcctgtaatcccagcactctgggaggccgaggtgggcagatcacgaggtcaggagatcgagaccatcctggctagcatggtgaaaccccatctctactaaaaatacaaaaatagccaggcgtgggtggtggcgggcgcctgtatgtagtcccagctacttgggaggctgaggcaggagaatggcgtgaacccgggaggcagagcttgcagtgagccgagattgggccactgcactccagcctgggtgacagagcaagactccgtctcaaaaaaagaaatttgagtttttatgctttgatgccgaatatgtgaattgtggctagcgttttaacatagtagcagtaagaacattttctcagacttgggcttttgtttttcaggccctgaagcagagaccacgatttgtagctttaaagaaacaacctgcatatttaggaggggagaatctggaacttcgagattatcagctagaaggtctaaactggctagctcattcctggtgcaagtaggtagaaaaatatgagtgcaattttccttactgtttctggcttctttattgttagatgtcaagaattttttttttcttttttcacacccttattgtatctcaaccaagaaatctttatgctgcatattacagaaataaaagatgattgagagaaatgcttcctgggagtttttatgtatgtgtaataccattttattctgatctaaagaatactttatttcattatttggtgggtaatttgtcatagccagaaacctgtatcatcatatgttactcatgagtgtatatagcaagttaagtcactcaaatctttaatgtggaaggagttactcagaagaaagaagaagatgtctttttcacatgtattttctttctaggccagggaagcctttaaattaatttcctacagtagtgctgtagagagtgtgattcccctcccttcactccactccctacctatatagtctgtaggattatcctgttcagaggaaggttgaacctgtgaaagtatcctttttataagaccacgttaatcttgggggggtgaaaaaaagatgagacagtgatagcactggaggtttaaaggtacttttgggaagtacttacaaatttccttcaccaatttcaagtagttcctaattactaagtgctaggtgttagaaacaaatgcttgttcctcggtgctgaaaagaactagtgctcaaggaattttctcagcaaggcaattttactttctgcagaaagggtgcttcttggaagcctaattgtcatgagagcacaccgaacaaagaaaagcagaggtttttatccctgactcattgggttcttactgctgcgtcctgtctccattggctggagctggaccgcacaatctagactgattccgattggctaaaagcttaaaactttcctaaatagataaacgcgcagtggaaaacaaaggaagggggttgtttacaggaaattaggagaataataacatttccaaataaggaaggggtgtaggctgtaagctgggaaatgcctgggcacgttcggacatgtctgagcaggttatagtccagaacaaataacctggttaaagtacaaggacatagaatgtacttattcccttactatatttaacagccacatagggcttaacaaagagttattagcaaaaagcaagggagcttgaaggaagttaatttctaaaagaaactgttatttctaacacttgttatttattctttaacaaaaagggaaactttgaagaggaactttttacttttcacatgcggatccattagtcctcgagaatttaacagtgaacctatatagatgtattttgctgtccttacagaacatgcagtgtaagaagtacctttaatgccaacctacacacttctttcccgaagtacccaattaagtgcaaatgcttaatgtctttagtgttttatagtaaagcaaaaaatccttatttagaattagaagtacaggcctgtgcaacatggcaaaaccccatctttaccaaaaaatacaaaaattagctggacatggtggcatgcttatgtagtctcagctacttgggggctgaggtgggaggatcgcttgagtccaggaggccaaggttgcagtgagccattttcgcaccattgcactccagcctgggtgacaaagtgaaacttcaccttaaaaaaaaaaaaaaggacagcttaaaaaatatttttcccctcattgctgaaaggaagctttctagttatagagatgcatttacagtgactttttcccaagtgaaccatctcctactttttatctgataaaatctagtacaatatttaatactcagttgtgaaaattaggtgtcttgagaagattgagaatgtgggtttgatataatgattctgaattgcttaaaaatgatttttccttttagaggttagtgggacctaattcatctaaatgacagttaataaaagttagatgaactttaattgtgatctaatcctctcattttataattgaagactcttaggaacaaaggtgccgtgtacccatccagagtcacatggtgttttgtgtacagtccttggccagcattttttagactttttattttttagtttttttgagactgagttttgctctgttgcccaggctggagcgcagtggcatgatcttggctcactgcaacctccgattcccaggttcacgtgattctcctgcctcaggctcttgagtagctgggattacacgcacgcaccaccatgcctggctaatttttgtatttttagtagagacggggtttcaccatgttggccaagctggtcttgaactcctgacctcaagtgatctgcctgccttggcctcccaaagtgctgggattacagccatgagccaccgtgcctggccagcatttttttactttaaaccaaaggaataaaaatcagttgaaaagggctcaagcacctgttaagccctggtcacaggaatgttactacattacataatgtgctattttggtctggttccagaaaaacaggtgaatcaattcaaacctactgtagtctgtatatgtagacaatggcattttctaggggcaggaaatactggagaaacttaactgtgcttcctcctgaatagtattgaaaagtgagggaaataagaaggaaattactcaaaggaatatactacatcgtttaaactgtgtagaaaattaggtgtacctgagatgtataggggtatggcttcatcattctccctttcccaagtgtgatcttctttgtttctgtattttaccctttaaactagctagtttgtagaacacagaaggtatttttagaaattatgtctttttggtgaattaaatgtcttgttttttgaatcagttaggttgcctttaactcataaattacttttagttctttctgatttgctgattaagcacatattatatatacgtgcaaactttcagtgtccttattttccagaacctttttataatgtttgcaatctgatgtcttacatgtaatcctaatttcctgccaaaatgactgtattctgtttcccaaatatattttcctaactctggctgtttcttcaattttaaatgtttttcttagatattctttttccattaatatcctgttgaaatctagcccattttgtagagtagtgtttctcaaactgtggttttaaggtagtgcttcccaacctttttggcactagggactggtttcgtggaagacaatttttccacaggctggggaggagggagggggatggtttctggatgattcaagcacattacatttattgtgcactttatttctattattattacattatactatataatgtagaatcagtgggagccctgagtttgtttttctgcaactggacggtcccatctgggggtgatgggagacagcaacagatcaccaggcattaggttctcataaggagtgtgcaacgtagatccctcacatgtgtagttcatagtggggttcatgctcctatgagaatctaatgccgttgctgatctgacaggaggcggagctcaggcactaatgccagcaatggggagcggctgaaaatacatatgaagcttccctccctcacccgctgctcaccttctgctgtgcagctgggttcccgagtggggaatcctggtctggtctaaggcatacctgagtcagaatctccaaaggtgtttgtcagcccttttccatatattgtttagtatatctagggtggggtccacaagtatgatctgtagcctacccctgctttagaccaaagtgtatttaaaacaagccccatgcacctatacatgtaggtctaggaaatagtgtgggtggcattaaacaacccagtggcctgcagtggaatggggtgggccagccacaggattcaccagcggtgctgatagctttctctattgatggagtctaaggttacatgcttgtcttcactttttacaaagcctgtcttctctgtgataaaagatagcctatggaaggtgatgtgaaaagcctaaaggtaaagagtctgacaaggctgtcatagtaatccaagtctaggtaggccacttgttattctgctttttatggtttctactttcttccttatgttgaaagctgaagtaattgcagatgagaagaaatacatttgaggcttatgaatgacaccttgcttggctgttattgtgaagcattggtgtcgttgctgtttatgcacattctgtgttttggtgaactaatgatttttttgtttttatttattttttctttctgcagaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacggtgtgtaaacaaaaagagctgggttagaatctgtgttataaatgtaatttagaaattcacttaaagcctttagtagatcatcagtaaaatttgtggttattattctgatactgtgctgtgttctcaatattaggaggtttatctatcacaaaagtgcaactcagatgttctttaacaaatatgcttactagttaaaaagcaacagcagtatgtgagtgggaatctcttttagctgggttgcaatattaaatttttcttctctctgccctttttacttctaagattgctttatatgagataatatggagttaatactttgtgtaatattaatattatttttgctttctcaatagacatattactgaaaataatcattcttcgaatttcttaatttcttaaacagtgaggttgcataacttataaaaaaggaataaaagtaaaggaaaacaagctattttaggactgtagaaataagaattatcctaaactgttaccaaactttatttgggcatcatgaatttagaacacagtgacttaagtttatctttgtttagcagatcttttctttatagtaactttttttaaagcacctactgtgtgctagatgttgcgctgggtgctttacgtataatacctgtaatcttcatgatagtcttcaaagctgatggcattctttcctgctactgatgaagaattgactcagagagtcttaacacgcgaccctagcgagcaagaatgtggcagagctcagattcggacacaggtgtttctatctagtctagagctttgctctttcatcactgtatataaactatttctgggaaattgcttgtaataagagcaagccattagcaatgtttaaatatttgagttgcatgttgtaaccatatattttcatacaaattcaaatttatttttggtaaatactttcattaaaattgtgtaacttaaacactggctgatttcattggcctaattttgagtttctaagaatatagttttagctttgttaaatcattagttaaccgttaaagacgaaaaaagagaaatttataggtttacaaaatagcgtaaagcactacattccaaaaatgattgcaaacaaagaaaatgaactctaaaaaattgtagtcagagaagttttccttgctatctccagttctccttttctttgttctttttacccccacttgggggcgatcacctgcaggcacttactgtcttgttctccagttcctaacttgacagccaaactgcaagagcgttgtcatgagtcttcgtgcttgctgagtgtccagttatacttcagtatgaatgtgctcatctttgtgttcttttacattgacgttattatacgtattgcattatattttcatcttacaagcctccctttttgttgggggacatatctctttggtctatggttgatgaagttccaaaggttggaatttgttttacttgttaatatatgtattttcctattcaaaaagtaaataaattgcatttttaaaagaaatttctaaggatctgggagatcccttgttgagttccaatcaccagggttcagtagctgatgaagtgcattttcttcagtagatgtatttctgggggccagtttcttctgattctggcaataaagcttttgctgttcggtggtcagtgttttaattctaactcttactgctttatagtttggttgcttaggtcattttagaatgtgagatattcattgaattctaatcagatttattttttatttggcatgtttctattacatcaatcacaaaacttatgtgatatagaaaggtagaagtagaaattatgtcttaattatgtttttttcttatagatacgggaatatgaatggattcattcccaaaccaaaagattgaagttcaacgcacttataacaacatatgagatcctcttgaaagataaggtgtgtaattaatatctaaaaggctaaatcttttccagtgcgacttgtccagatggtagggtctgttactgttctgtggagcatgttagaaataaatacttgaaagttaaaaataaaaaacaaatggtagggtctgtacctcctacttgccatgttacttttcttctcttatttcaaaaagcaagcaaatgaacaaccagaaaaattacttttcaaaggatattaacgttataaatagaaaacagaaccctatagatgaggggaccttaggtcaccaagtccagttgaattaaacagaatgaaagggtattgaataggtcagtaacttacctgagattattgtcagtcattggatgccatctcaggtatttcccttgaatgtcatcttaggcatttcctattgtatcattgttaaggcatttctccagaaaagatgatgtgaatggtctttgtgaggaggacaaaaataagaagctctttaaataccgcctttctgctaagaaatatatgtggtaggtagatcccattggtattaagtgcaaacaagttgagtttggtggctcttggtgtttgtgtgcttcagggttggggtggagaataggcaagagaaggaccataattaaggggagaatacagaatcatgtggtttttttgttttatttttgcccagcatagcaatttttgtgttcttgctgtggggcatgcagtaatagctggtataagaggcccacctataccttttagatgatgatactctcttttgaatagctaccaatctggcaactaacagaataaacagaagaggcctaatatatattgtcagtgaagaataaatgtgtcaatttatacctttgtaatggtatttatacagagataattaacacttgaaagcacttgtgggttcccttctgacctggtggctcgttctgttttgtttttactttagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtaagctccttcctgtgtatttcaaaagatgctagaatgtctgaaatgccaatgctttttaactttcttagtagaccttagggaaaacagatggcatggtttggggaaagcaaagcgtcaaatggaggcagggatggcggtagtaaaatgtttcataatcaatgaaagaaggcacagaaattagcctgttaaggaggaaagcagtattgtctgctgaaaggctgaattagttaatgcacttgggaaataattgttaaatagataacatcagaccttttcactgttggtataagataatcaatataagtaaaatgaaatatacaaggtacacaagcactgaaaagtatgttatactcaaatatctgataaccgaagcatcaattttacatcttattcacgtattattaaagaactatggaatgtgtttattgaaaagatttttatgggagagatgatatgcacatttcataaaacttaaaattatccaatggtattcagcgatacttagaataacatctatattcattaatttggaggactccactcagtctggccccttgacaatagtctgattcctctcatccactttctccattactcattatgcttcagccattctggctatctttctgtcccttaaacatgccaagccattactattccttcttgactagaattatatttcttcttgtcttcacatggccaaccaccttaatgtttcagctcatcttaaacgaccacctcctttcagaaatcttttgcagattgcctaacctaaagtagccctttagacatcttatccctaacctgttttagtgtctatatagcatctctttttacatttatgttctcattcatctcatgtcattaaattatgtatgaaaatcgcagggattttgtttgcttgattcattgctggttcccattgtctagaatagcacctggtgcacagtaaacaattcagttaatagttgttcagttgatagatatatgctctacaatctttttttttttaattcaggattaaattttattttttacttttatttttatttttaaattttaaatttaaatttgtttagtaactttatagtttgcaaccatcatcattgtccagttttggaacattttcctcatcccaaaaagttccccctttcttgtttgcagttaacctctgcttccacatatagccttaggcaaccagtaatcagcttttgtctctagagatttaccttttctagaagttttatataagtggaatcctaatatgtaggcttttgtttccggcttccttcacttagcatattttttttgagattcattcatgtcagagtctgtcagtaggtgttctctttcattgggtaatatttcattgcatccagttaccggttgatggacatttggattgctttgttttggggttattatatctttgtgtggacatatgtttttctttctcttgcttagagacttaggaatagaattgctggattgtttggaaagtttatgtttaacattatagaaactaccacgctgttttctaaagtgactaccattgtgcagtcctaccaaaaatgtttgaaggttctagtttccctgcgtcatcaccaggacttggtgcattgtcagtctttttgattctagccgttctggcgaatgtgtgtcattgtggttttgacttgcatttccctaatgactaatgatgttgaacgtcttttcatgtgttcattagccatttgtatgtctttggtgaaatttctattcaaatgttttggcattttaactcaggcgtcgtgttccgtcattggaactctaagcatgtgggaattatttatatcctactgctcaaggtcattgccaaggtctgattgcaaaaaattcaaaaaattgcaacctctatcataaatgggttaaaaaaattggattgtttgtcttattatgagttgaagaggttttttatttcttttaaaaaaattctaaagacaagtgctttatcagtacagtccccaactttctatagtttgatgtaaaatgttttgacttttcagtggtatgaaagcaatacactttcagtagaaagtatactttgaatgaacacaaccattctgtttttcattttcagtgtaatattcgataaattacatgagatattcaactctttattataaagttggctttgcgttaggtgattttgctcaatatcctcatgataagcgttctgagcacattcagggtaggctacggtgtgatgttctgtaggttaagtgcattaaatgcatttttgatttaacaatgttttaaacttacgatgggtttctcaggacataaccctgttgtaagttgaggagcatctgtatataatttgaacatattttatcccaatctgtggcttcttttcactttttgaatgttgtctttcaaagagaaaaagttattgattttgatgaagtttaatttatggatttctttgtatggattgtgctttagatatcatatctgacacagatttgcctaacctatggacacgaagacttgcttctttatttccttctagaagttctagcttttgtattaagtcagagttacattttgtttatagtgtgaagtgtgagtgccttagttcatgtttttgtagtagaatttgggaaattgttctagtatcacttgttgaaaagaatatctgttcttcattgaattgccttgacactgttgttgaaactcagttgacaccataaatgtcatgctttgtttctggactgtcagttctgttttattaatacatatttctgtccttctgccaatgtcacactgtcttgattaatgtagctttcgactgtttttttattttttattttttttgagatggagccttgctctgtcacccaggctggaagggaagtggcgcaatctcagctcactgcaacgtctgcctcccgggctcaagtgattctcctgcctcagcctcccaagtagctgggattacaggcacgcaccaccatgctcaactaattttttgtattttagtagaaatggggttttgccatgttggccaggctggtctcgaactcctgacctcaagtgatccaccgtccttggcctcccaaagtactggtattataggcgtgagccactgcacccggcctagactgctttttaaaaatggagaagtacaagttccattttcttctttttcaaaattgttttggttattctagaattcttgatacttccatgtacattttaggatcaggttgttaatttctgcaagaaaaatatggaattttgatagaaattgtgttgaatcatatatcagttaaagcaaaattattaatattgagtcttctaatccataatcatggaaagtttttctccatttatttagatcttctataatttttctcagtgtttagtggtttttagtttagaaatcttatacattcaaaatattcttttaattctgactatatttggagtggaatttttaaaaatataacctattatagaactacaattgggttttgtatattgatcttacatcctgcaaacttgataaacttactgttttctactgtgtgtgtatgtgtgtgtatattgttctgtatttcttagtatttttctatagacaggattatgttttctgtacctaaagatttcttttccaaaatggatgctttttatttcttcttcttgccttattgtattggcaggaacctccatcttaaatagaaatggtgggagcaggatgttggctatagatgttttttgtagataacctttattgggttgaggaggttttcttttcttcctagtttgtgaggttttaataaagaatggatattaggttttgtcaaatgcttattttctgtgtctgttgagatgaccatgtggttttgtcctttaacaatatagtatattacattaattgctttttagacattaggccaactgtttttttcctagcataaatctgacttgttaacagtgtttgatactttctatgcattgctagattcagttggctaatattttgttaaagatttttgcatctgtttggtgtttttttttttttttttttttttttttaagacagagtttccgtctgttgcccaggctagagtacaatggcaccatctcggctcactgcaacctccacctcccaggttcaagcatttctcatgcctcagccttccaggtagctgggattacaagcatgcaccaccatgcccggctaatttttgtatttttcgtagagacagtggggttttgccatgtcagccaggttggtctcgaactcctggccgtaagtgatctgcatctgcctgtctccgccgcctaaagtgctgggattacaggcgtgagccactgtgcctggccgcatttgtgttttttattttaattaggattttagtctatagctttttgttttgttttgatgtttacgttgctttggttttgggatcataaaatgaattggagagcgtttcccttctgttttctgaaggagtttgtgtaagtttagtgttatttcttctttaaatatttactagaattcaccagtgtagccatgtcaaccttcactttgtgggaaaatttttaatgactaacctggtttccagttacaggttcacttaagttttctatttcttcttgacttagttttgttaatttgtgtctttctaagagttagtctgtttcatctaacttgtcctaatttgttggcataaagttatagtactctcttagccttttaattttagttttcttttttaagagacatggtctttctctgtcacccacgctgagtgcagtggtacgatcatagttcactgtaacctcgaactcctgggctcaagggatcctcccacttctgtctcttgagtagctggggctgcagatgtgcaccacaatgcccagctaatttttaaaatttattttttgttatttgtagagatgggttcttgctgagttgtccaggttggtctcgaacttctgggctcaagtgatcctcccgcctctgtttcctaaaatgctgagataataggcatgaaccactgtgcctggtagattcttttaaggatcaatagtgattaaagttaattttcttgattatggtaatttgtatcttagctctttttcttggtcagttctagctaagggcttaacaattttgatgctctcaaagaagcaacttttgacatcattggtttcttcctctgttttttcttctctttttttttttttttttttttttgagactgagttttgcatttgttgcccaggctggagtgcagggtgcgatctcggctcactgcaacctccgccttccagtttcaagtgattatcctgcctcagcctcttgagtagctgggattacaggcacctgccaccacgcttggctaatttttgtatttttagtagagacgaggtttcaccaagttggccaggctggtcttgaactcctgaccttgtgatttgcctgccttggcctgccaaagtgctgggattgcaggcgtgagcccccgtgcccggaccctctgtttttctgtttatttccactctcaaaggttgccgtcctttgcttgcttttcatttaattttctctttttctcttaagatacagtttagattactgatgtaaaacttttttcttttctagttgtttaaaggtatgtttacttctatgcactgctttagctgcatcctgtaaatactgataattttgtgtttttgttttcatttgatttcatctattttctaaattctctgtgatttattctttgaagcatgggtttttcagaaggatggtgtttaatatccatatatttagggattttccaaatgtcttataattcggttttgtcttagagaacatgctttaaatgaatttattatgacttattaaatagtcttagtatgctttctttcctggagactgtccgataagtgcttgtaaagaataatctgtattctgcctttgtttgagtagtgttttgtaaatgtccgttcagtgtggtgttaatggtgttgttcaagacttttatatcttttctaactgccagtttagttgtgctttgaattattgagaatgaaatattttaatttttaactgtagttgagtttttgtcttctagtcattttttgcttcattattttggggttgttctgttaggtatgtatccattcataacttttgtatgttcctgaggtattgacctttttctggtcaataccagaatgtcccatttgacctctaatgatatttattgttttgtaaatccattttgtgtgattttattatagctcctcagctctcttctgattcctgtttgcatgatatattgttttccatcattcgaactggttaccatttgcatggtatactgttttccatcattttactttcaacttacttctttctgtaagtctaaaatgtgtcttatagacaacctgtacttggatgtaccttttttatccaggcaaataatccttgccttttgattggaatatttagttcatttacatttaacagaattaataatatggttggatttatttctgctattttactatttgttttccatatgtcttacatcttttttgttccactttctcctttattgccctcttctgtttcagcaagtatttttcagtgtgtcattttaattcctgttaattttttgctattaaaaaaattgtaattggttgctgtagggattgtatgcatcagtcttcttcaggttagtactgactcagttctggtaaaatagggcaactttgccccgctgtagctccattttcacttccttatgttataaatccaagaatacaaggaaataattattgctttccacaggtttgtcttttaaggacatatagaaaagagaaaaaaaatatatactatctttcatatttacccatatatttgatcattttcagtgatcttcatttcttcctgtgtattcaggtcgctgttgggtattgctttcttttagtctgaagggcttcctttatttacatattgcaaataagaatatgctggcttagatgattaaaagatgtcccgtatgacacagtcaataagtagatagacgaagatcaatagcaaatcttctgtgaccaaggccagtgtcctttgaacttcaagttctaggagaaaaaaatacatccttcataaaaccattgagacgaagtaaggtcaccctacgtagtaagagttatgagacacagtgggaacatctgtgcttgtttttatagaaaaagaattgtggtatgtagtttctaccagtgaatacttagccatgatttgcttttgtgtacctacctgctgaagtggatggtagggattttgctcctaagtggtcataattagctttttcctgccattaagtagctgtggcattccactcagcatgggctatgtttggaaaaatgtcatatatccttcttttgtaattggagagaggaactttcaattactttatcattcagggagtctcttccaaaattttcctttggccagttgaatcaattatggaatgataggttagagttagagatgcaagtttttttctgtgaaagagatcttttttctttgaaaattttgtgtttaaagcattgtcattttcaaataaagtttcaaaattgttgttcacaaagatatgtatatgaaaaggaaaccaattagttaaggagttcagatttgcccttatttctgcctgagcttgctggatgggtaactatagtcttgtgaagtattttgcctcatcctcagcagaagttcctgaggtaccttaggactctacagagcttttgaagaaaggatccactgaagaaaaactattgtaaaggagagaattaggtttagtcaaatagctttggaacttccccactcaaatgttacaggctattgtttcaaaatccaaaagttagtcctctttttaaccaactgaaattctgtttccttagtatagagtctaagtgcctttcctgcagggtggctctgacagggagtacacatgactaaccatattgggaatacttatcaatcaatagcttcattttgtacatactgtttgcaaagcatggaacttggtattaagggtagaaaaagatatgacaagattgaaaaattcggcttataaagaccatcatgtgcaaatatatacttcagacttaccgcagaaaacaagtcagtttgatagcatgtatttcagagattacatcttttagtgttgggatgattttttaaatttttacttctgtcgtctaggccaatctcttaattttttttgcacttttccttttacatatttactgtgtgacttttagcataccattttcactgctttggtttaatttccgttgttggtccttattaaagtaacctatttttctaaaattccgtgttctgcaaagctataaagatcagaattttttctagttctgtgagagacaaatattaaatacagaagttgatagcagggatttatctaaaatatgaatctttagatgtaacatggtgtctttatacatcaccactatgaccttataccttttctatatctaatattataaattaataattgttttcagggcagcagactttttctaaagaatctgatagtatgccgggcgtggtggctcacgcctgtaatcccagcactttgggaggctgaggtgggcagatcacgaggtcaggagatcgagaccatcctggctaacacggtgaaaccctgtctctactaaaaatacaaaaaattagccgggtgtgatggtgggcgcctgtagttccagctgctcaggaggctgatgcaggagaatggcgtcaacccaggagcccaggaggcagagcttgcagtgagccgagatcgcaccactgcactccagcctgggcgacagagccgagactctttctccaaaaaaaaaaaaaaaccaactcagaatctgatggtaaatatttttggttcatagcccacacagtcattgttagccactcatctctgctgtttagaggaaaagcagccatagagaattcataaacaaataaatgatacttatatctcctcagtgtgtgtagatcaagaactagtgtctcatattaactcccttaatataataagagtacagtaggcaggtgaaaatatttgttgcttaaaacatagaggaagtaaatcttggaaataaactttacatttaattttttagattagtaaagttttaatttattataacatgtgttaggtaaattagcttattgaaattgtctctcaggtattcagaaaatagcctgatacagtgatatttctacttctactgatttccggtcacttcacacatttagtgtgtgaggtatcatctccagcattgagatagttcagttttctttctttcttttttcttttctttttttttttttttttgagacagagtctcactgtcacccaggctggagtgcaatggcatgatcttggctcactgcaaccttcatctcctgggttccagtgattctcctgcctcagcctcctgagtagctgggattataggcacttgccaccatgcccagctaatttttgtatttttagtagagatggggtttcaccatgttggccaggctggtctcgaactcctgacctcaggtgatccgcccgcctcagcctcccaaagtgctgggattacaggtgtgagctacttcgcccagccagagatagttcaattttcattgtgcatttgaattattagttttaattcctcacctattttatgttcttggagtatttgcttaatagcatagcagtgtgagaaaatacagtttaccttaggtttatcaggctgtaggctttaatgacgactttagatgtctaccccaaaagatcatataatctgcttccctgtagattgtttcaggccataccgggtgttactaaggctgatgttgattcacttaacaatacctgataaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatcacttgaggtcaggagtttgagaccagcctggccaacgatgatgaaaccctgtctctactagaaatacaaaaattagttgggtgtggtggtggcacctgtaatcccagctacttgggaggctgaggcaggagaatcacttgagcctgggaggtggaggttgcagtgagctgagattgtgccactgcattccagcctgggcgacggagcgagactctgtctcaaaaaaaaaaaaaaaggaatgactatttatgagttcagaaatgacggtgactttcttgaggctgttgtatccattggcagtactggcaccagctatatctgacgttccatcttaccagagggcatgtgctttgagtagttactgagtagttctagatgatgttggttacatgatagactgaagtattttattaactctgaattcagtctgagaattggaaacgtgctattatccagtgtagactgatggagttgatttcattttacttttcccctttttgttttcccttctatttaagagctctagtgattgataatgtctttccttatgggaaagattcatttttttacagttttttttcctattcttcttttcctcaatgtggctaaataacactatactgtttcttccctaggtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtaagttcttgtttgggttaggcctgaaggggttgagatcagtaccatgaaactattagataggagatatatatatatacttttgttttttttttttttggagacagagtctcgcgattctgctgcctcagcctaccgagtagctgggattacagggatgcgccaccacgcccagctaattttttttgtatttttagtagagatgggatttttccatgttggtcaggctggtcttgaactcccgacctcatgtgatccgcccacctcggcctcccaacgttttgttgttattaagcaaaatttcaatactgttgttatgtctaaaaaattttaataattccttaacagtttcgtaatatctagtgtttacattttcctggttgtcatatacatgtatgtatatctccgtttgtgcatgtgccattttgcttgttttgggatcgatgtaagctccgtgcattttgcttgttttgggatcgatgtaagctccgtgcattttgcttattttgggatcaacgtaagctccatgcattttgcttgtttggggatcgatataagctccatgcattttgattggttggtatgtctcttaagtatattttaatcaatttatttttctttgccttataaattttttgagtcaggaaactgaatttatgttttgtagacttttctcacagtctggattttgctgattctagctccatggcattctttaatattttcagccaggtgtggtggctcacgcctataatcccagcactttgggaggctgaggcaggaggatcgcttgagcccagtagtttgagaccagcctgggcaacacagtgagactccatctctataaaaataaaaaaatttttaaaaaccacttttcctctgaactgtgttttctgtatactcataagtaagtgtaaaggcttgattagactcagattcagtgtgactttagaggcagaggaatattgtttcacaggataaatgtccttttttgtgatgttagtgactaacgatgagcattgcctagatctgttaattcattagagagtacaaaagggtgatattcaaattttatcactcacttgtttattaggtggaatacttttataaaaagaaactttcccatgtcagctgaggaacagttcatgtaggaaaggcagaataagattcttttttacttttgccattttcaaaggaaaagatctacttttcttcaaaggttttgaccaatgagatttactttgatatgattatgaactcatcaattacacctatttatgtttaattctgttggagttaatatccatattcatgctctaacagtcccatttttagctagtgggaactcattcaagttggttgttgtagtccttttgacataaccgtaatagtagttgatagtttctttgctatctggaatgattaagtgttccacatccatcttgtacatttcctgccccagaactagagtcagccatttatccaagaagttctgcatactcctttactaggaaatgatatttgtttgtttctgtttttcctctgaaaatagtttaatactgtaaaatgtaaaaggggaaatagtgttaccttagtaacaacatgaatgtgtcagttggtcagtgctattttgggtgttgattgatcatatgatttttctggcaactctagatacttccagtttacttaagttgatttagttgagtttttatcacttgcaatttaagagtcctggctaatattctgttgccttcaggctgcacaacatgcaggattggggaaagcactagagagccaaagaaagtgagcagagttacttcagggccaccagcgttccccgcaatccctgtcctcaggcataggcccttctgctcttcccactgtagagcagcacccatccccaccaaacctcacttctgggtgtgacttcatagactgtcgtgttctgcagtaccctcgagtccgaggctgttgagtctgaaggatcctcagaagactggcctctttctgatggtttatggactatggcaaagatgaggaaatggtatttggagaccacatactgggccctaggggtgctctttgcaactgcaacaaacatggacagaattgggaaatttgtttttaatggtaaaaatacatgatgaacagtaccacagagattttatttgatcttactgatcttatgccatactaaaaatctcacttcccaaccacaccaagctaattcattctatacatacaacaaagctaatactaccaccaacaataagaatagtaaaaacaggttaagattttctttttttttttttttttgagacggagtctcactctgttacccaggctggagtgtagtggcacgatctcagcttactgcaacaggattttctttttacaggttttgtttttacttttttttttgctttttaaggttatataccacaagaagtggaaaagagttttaaagtactcaagatagtttttcttctgtgtctttaggcaactaatggttacatagatttatttatttcattttagttttgatttttagggattgctttaattttgtttttaaattatagtatttgtagatttccaaaggcaaagctacaaagcctggtatgttcaaagaaatgtagcttcagtccctcttccctccattctagtccatctttccccataggtaattattattattattttttgagatggagtttcgctcttgttgcccaggctggagtgtgattgtgtgatctcagctcacctcaacctccgcctcccaggttcaagtgattctcctgcctcagcctcccgactagctgggattacaggcatgcaccagtacgcccagctaattttgtagttttagtagagatggagtttcatcatgttggtcaggctggtctcgaactcccaacctcaggtgatctgcccccttcggcctcccaaagtgctgggattaacaggtgtgagccaccgcacctggcccataattattattattttttaacattttaatgcttatccttcctttaacttttaattattaaataaaagcaaatgcattttaactttgaatatcctcctttctcttaggtaagtggtagcataccgtatacacttttctctgccttccttttttccttaatgatacatggctgaagagcaccccatagtagcttatagagataggcctttatgatgcatagtgttccattgaggttatatagtatggtttattcaaccagtttccttgtggtaggcacttagattgttttacctacttttataaatagttctggagtgaagaccttgagatagattcctaaagtgtgatttctaagagaagcatgaagaaattgcgccactcaggaaaaaatgtacttttactattttggagtttgtggttaaggaatatacatgggtatacatgaatatatctgtatttctcctccaaatttgggtagaaaacatactgataagttattttgtcagataaaatactcttttacaatgttaaaatgggtatgtagcctctattttatggtatatttacatttatttaacctcataatgttagcttatttccaatttttatatttcagtgaagagtgtttcagtgacagtcattttccattcacacatgcacacacaggttgagtctcttatcaaaaatgcttggggaccagaagtatttcagattttgggatatttgctttatacttactagttaagcattccaaatctggaaatcagaactgtaaaatgctctaatgagaatttcctttgagcgtcatactggcactcagaaagttttgagtgccattttggaacattttagattttcacatttaggattctcagcctttgtgtacacacacacacttaaatatgtataaagtacatgtgtgtaaatatgtaaaatgtatgtatgtatgtgtgtgtgtgtatatatgtaaagcatatgtgtgtgttgtgtatatgtagagagagttgttttcttctagtattcctgtgttcagtgaggttgaaatatccagcagaatctttaacattcctaattctgactggagatgtgaaagatgtatgattagatggcaggagatacaaaagaaaatattctttgcttcttaaacttttttaggcctctttttttctccacaatactactactatctcttatactcttctggtacctacaactttctgtttttttgtatctagtagtatcattatcattttaatttgcaggtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctggtaggtagttcctcataattactttctcaaaaaaaacgcttagtttctctaggtgcttttcatcagaatgctctatttccttgttggtgacctatcaaggatcatcaaaggaagctttaaaaatgggagagaaaaggtaactaagaatgatttggaaagtaaagtatagtatcaacagatactgggaaaaagaacatttcgggaattgctggtcaagcaggttgctaagggcttcagaaagctttaagatgatttttaaaatatggatttgtagagattagggaagattaaaatttgtgtttcaacataattattggaatgtcttttaaatcttcagtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccaggtaaggtgatttcagtaattgctgtggggggaatcaatctctctctccgcctcccctccccaaccttcctacactgggttgtatgctttgcttgttaaagtaggaagtaagagttttcttgtttcaaagaagttaaggttaagattccagggggccgggcgcggtggctcacgcctgtaatcccagcactttgggaggccgaggcgggcggatcacgaggtcaggagatcaagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagattccaggagggtcttaatttttacttgcatgcctttaggctaccatatgaaagtggtcatgaggagacgattctttttttgaaggtgggtggggaggattagagaaagtcaaacggggcaagataaaaaaaggatgtcagatggcatcttattgcatgtgtatggtgaaagtagagaggaagtaagtgtgagctcaattccaggagcccaaatcctagaaggagagggcagtatcagacattccccccaaaagttgaccctggctgtgaggctgggaacatagcagaacactgctacttaaaaccttgctactccctgaagtaagtgatgatggcttcccctattttctgtggagttccttaactggagttactgtcttcacacagttatctcctatggggaaaatttcttccgcatagtaacatttttctaggtgtatataatctagtagaaacttattctctgatctatttatagacacatagacatatacgcaatttaccttgtctcttggcatgtttatagtgctttgatttttaagatttattacattttttttaaaactttgaatggatgaactcttctaccaactcacataattatgttgggattgaagaaacttggaccaatgattatctcctaagaaggcccacctttgagactatcagattgattatctttcaaaataccctgaaaggcattgttatatccataatatcttatatggtctttcagttgctgtcttagaatatagcttaaggctgtgcttgttatcaagaaacagcctattgcaaaaagtcacttctctgtcagtgaatcgaatccctatgagctttcattcctaggaaatcccgtgataccaagtaaatcaagaatgcatcgtttttctctctagggaatagataagcttggtcagtgacttttagataattaatgccctctactaatgggaatattaaaaggcggcattaggttttctgatttcaagtaaaggctctgaatctcccattgaatacgtcttcggtttaaggctctgagtagagtagtcagtgagaaagaagtaagggactcctcacctgtcagttgacttgagttaggtctggtgggcaaagttctgggtatgtaggcccttccacagagtctgctgccagccaagtcacctttcaggttagttttgccttctgtaaaatgaagtattttgttcatctcaagtggtgattgtgaggggatgaaatgcaaaaatgattttaaagagtaagaaatgctttataaaatgtacagcatgcaggtgataattctttagtattttatgtgtcaatggtttctctatggtgacattgtattgcatgtagaactgacatatgttctaataaaggaattgtgtatgctaataaatgccaggggctttcttgaattctcatgtagtttagctgcttgaacactttactatgatttcagagtgtaatttttggcaaagctgggatatatgatcaattttaacattttcaatgattcagcaaaatgtttttcaaacaaaattattatataaataaatttttggtttgtgtgacactttaagtgatagttttagccacattagctaagaagcatcatttttctgcaggagcttattattgggtgacccgtggtcctatttcctaatctctgcagtacctacagaaacagaagtaaacccagcctccaagcacaggttgggttttcgtctttctccttttaggtcctggcagccattctgatccttggctaaacctggacagccctttgaatcagaagcttgtaaccttgagtctgtaactggagagctcaggtcgagtagggtagggtgtgcttcttaagcacagcttcttcatagcgctttgccagtgctttgcagttatttttactcagtgggtgttcaggtgataaaggttccaagtctgctgttctattctgagtgtagctgatcttcctatcttacagttttcttgtggtttatttttacagcgtctggatggttccatcaagggagaaatccgaaaacaggcactggaccacttcaatgcagatgggtctgaggtatactatgcatggctttgttatttgagcaacttgggctctgcatcaaggggaaagtctctctcgcttaatgtattctgtttcagaaacaatttatagtgcaattcttttgccttgagaagaaaatgagaaatctctcatataaaagatggtgttttgttgtcactccagaaaaataaatatgtgcttatttatctcccctgttctgggttgacaacagagtggttctcctggtagcttccagataccaaatccttgggcgtggaagagcagtaaggcaggagtaggggagagttgggcaatagaattaatataagaaggttctgatctctgtactcttttggtgactaagtcctgaaaaatatatttgccatgtctcaaatttgttggacttctgatacagtgtggcttaatgttcttgctctcgctaacagcaacattttacaatcagtgtcgagcttggatttggcattatgaagtattttgtttggggggcacatatagaagagctacttaggatgaaatagaaggtatgacaacattgtagtttgtgcatatcaaatcatcagatgccatgggatttgagagaagtgggagagaaaagttttggtgtgaataaaactgtaataatgtgtagagctaaaggaagcagtggagacaacctgaagtagaagtgtttcacagagaatgctaatttctggagcctgagccactacttttttttttttttaaacagatagaacagacttagctttctgaagagctttaaaaactcttgatgcctgtgcctgttactacagaatgctctgctgtctgcctttagagtgtagaaatcctagttagactagtattctggctacttctgtagtctaaacatttacttcttgaggggcttggggcatttattcagagccaaggctctggttcattaaggataagaggaatggaataattaaagacatcggtcatcaactaattcccattcctcctttccttgctccttgtttcctcagctgtaaaatcacaatgattctgataccccacttcataatattgctctgaggattaaatttggtaatcaacataaagcactgatcacattgcccagtgcatagtaagcgctctaaatatctgctatttttatcatgtagtgttggttgaaattggttttgtgttctccactcttagtttaaaaaatagtatgagtcgaatgtttcatattgccctgtctcaggggaaaaaaaaaattgctttttgcatagctctcagttgattcccactcactatgatggctatatagaacacaagttctctaccatttctgcagtattttaaaaattcctttaaaaaactaaatatttattgtgggacaaaatattatatgcttacttagaatattgggaagatggtaaagaatacaaagaaaaaaacaattgtacccctcattctagacacaacttgctgttcacgtctttggggtgtatttccattcctactagatggaaccatttatatgtttacctaattcggatcatgttgcatacagttttgttcccttcaaaattatactttgaggctaggcgcgcatagtggctcacacctgtaatcttagcactttgggaggccaagatgggggaggatcacttgagaccaggagtttgagaccagcctggtcaacatagtgagacctgtctctaccaaaaaaaaaaaaaaagtttccccatgttattaaagattttacaaaatttaatttctaggcccatagcaagaccctatctctacaaaaaattaaaaaatgagccgtgcatagtattgtgtgcttgtagttccagctgttcaggagacaggcaggaggatcccttgagaccaggagtttgaggctgcagtgagccaggattgccccactgcactccagcctgggtgacagaatgagaccctgtctcaaaaaaaaaaaaaaattttttttttaaatttctaaatttttcttatgcttgtaccatttatttatttaactaccttaccgttagtggcattgagttttataattttttaacctttttcaacttgatcatagatgcagacgacatattataatccacgttatccttgctaaagagtgatatagcagattgttggttgataggatctttttgactccagatttcatttgttttagatatctcatcttaaattgtccactgtttatctttagacttctctttggagtgtggtggtgcttaatatttctcttaagaatcacagattatgtgcctggacactcctgttgatcacttctttattggaattgtttaattaaaattcttgtgaagcagctgtctccatttttatttctatggcataatgttgttgaatgtgactattagaacatggagaccttttcattgcatctctatgtgtatgctaaatatacccatttatcaagatggaactcaggactaccagtttttcaatgctgcttctctctgctacaaaggcatcagcttttgacatatatgattaaattccctgaaaatagaaatatttcaccttttccccccggcttatatattttattctttttctcctgcccccatatttttctgagcactcagacgcaggcaggtgtgctgtgcttgcccagtgtctactgtcattgctgtggatactgcagtgtcagtgcctgggtggttccacacatcgctctccagccaaacctgttttgatttttttataattttggcatgttttgtggtaattgaggatcctgtggttctcaacacttaccatatatgatctctttagtgcagtgtttctatatttctcgccagcctaacaaacataaatatttatataataaagtatctctgtttatactaactgacttacatggcataatctaccttttccctaaaaataattatacaggtgacttcctggagttaatgatctccatgataattgtttgtctgtttttattattgttgctgttaacttcttgtatattagttgtagccgggaggtagcactaattctctcactcccattgccttattagagtctactctactcctgttcatggcactgactttgcctcttaatcaaatgaaaattcattctaccatcaagtccctgacattcttttagcctccataaagtttgtccatcatatctcacttttcttcacacctgcaggggtttccaggtgtaagggcttattggactgtgaaactgtttctgagaaggccactgcataaagtagtatattgcattgtgtacaggacttctgtttcctgctctcgacaagggctggtggcctgggaatcaatttggcttcagcggacacagtcgtcatctttgactctgactggaacccccagaatgacttgcaggcacaagcccgagcgcatagaattggtcagaagaagcaggtcagtatggagaggcttctggaaattgctttagggtggggggccagggggcttgttcagccctttcaggatgttaataaaatgctttttccctgttttgcttttatttcccctgaagcattgatttctgtttgttaactagcacagagatgttgtctttgggcccaagatgaacctattaaggaacttttctttttctctgtttgaaaagtacaacatcagcgaccttctatgtgtttatcttgagagagatatatgatgaatagacttagaactgaacattttctctattttagtatggaaaagttaaatatcctattgttcaagatggtttgtttttattatacatgacagtgttagctttaaaggtactttggaaaaccacacacttttttgtttatgaatcttaaagtctgttctatattggataacccgtaagtttcattcttggccaaagattctgtttttgtggaactttccatcactgaagcacgatttttattgatggaacaggccataacgacagatctttagaggcaattttatttaagactgtaacctgctgcacatagtaaaagtattgcatctacttaagctgcctgcttggatggcttacagtcttctatggttagagaataaattctgttaaaattttcccctcttgggttttgacagagctaatccttctctctttttttgggggggttggggggtggttcaggcataagcataacagttccttttcctacaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaagtaagtgccaggaagattgggaggtaggcagaatcaaattgattctacatcactgttggatataataggattttctaccacagacattagtctgttcattacctggaagatgccaggccagaaccacaaataggatagcattttcactttgagtttcttggttcctttttttgcccatcaccccccttcttatgtgttttcctctctttcttgccctctcccttacctttgcttttggctgctcatgtgacatatgacacagcaacagcagtggagttgtgtgttgggtgtcagcctagcataatgtcacctttgacttttctgcagtgagaatccagattggattggcagctgttttttttttttactattggcaaaaatgtttgtgtggagattgttgtgcttccagaagggtgtaaaaagaaagtaatgaagttttaattggctttgggaagaggcacagctacatctcctataaagtttaattagccaggcatggtggcaggcgcctgtagtctcagctacttgggaggctgaggcaggagaatggcgtgaacccgggaagtggagcttacagtgagccgagattgtgccactgcagtccagcctgggcgaccgataataataataataatatcaaaataataatatcaatattatcaagataataatgatatcaaaataataataaaaataagtttacattttgagcagattgttgagtgtcttctgtggtggtgtttcagctatgttttttgtttgtttgtttgtttgtttttgagatggagtctcgctcggtcgcccaggttggagtgcgctggcacgatcttggctcattgcaacctctgtctcctaggttgaagtgattcttgtgcctcagcctcccgagtagctgggactacaggtgtgcaccaccacacctagctaattttttttttcttttttttttttttttagtagagacagggtttttccatgttggccagactggtctcaaactcctgacctcaagtgataggcccacctcagcccctcaaagtgctgggattataggtgtgagccattgtgcccgctgcagctatgttaaaggtgtattcaaattagcccttcctaaataaaatgttttcagatagttttctgtttaagaggaagctagatgagaaaagcctagctcttttattttggaccggggttgagaaggttgaaaattcttggtgaattataactttctgagtaaaaggccaaaggaaagagctccattctataacattgctagtcacctttctggcttacccatgcaataggtgaaccagtaggactgtaactaattttctattctgctggtttagggttaccatcacagactcatcctgtagatagaaaatgcgatgtttgagaaatcatttttcttgaggcagagtttatattttcagcagttaacttgacctctttctgaaggatagttattctgaagtagaacactttagaggttatttgatgtttctaacaactacattttacttccacagctcaaatccttttaataaagaagagctgacagctattttgaaatttggagcagaggatctcttcaaagaactggaaggggaggaatcagaacctcaggtaattaacaatgaggagagggaaatttttttgagaagtatgatctgtgagagtctaacttttctgtaagaagattctgttagaggcttttgtaaagaaaaagtaattacttgaaggacagtgtgtttttctttcgtaggaatctcatagctcttaccaaattgagtaggaaggaattaataaagcattcgagtatacttttttgggttgtttttttctcccatttctgttcgttttaatttttgaagtttcaccttgtcatttgtataaattatagtttgagacattagatgtaaaagatgtagagttgaaactgaaagtaaatgaaatatcagaaaggagaattggtttatttgcaccaaacatttttagtaaatacgaataatttctgggcaactaggcaactcatctgttgccattttattctattcgtgttggcttttgttcttttaggaaatggatatagatgaaattttgcggttggctgaaacgagagagaatgaagtgtcaacaagtgcaacagatgaacttctatcacagtttaaggtatgaagatctttgtgggagagagttctcagcattgattcattaatgatgactaatgtttatgaacgctttctttgtgctaggcgctctgcttttctctttacctgaattgagtcatatcctcaatattgttctctgaattgtgagtatgttgtgaatgtaggttctacagtccgcacaaaggtaatcactgaagtgggctatcctatgtagagtcagtgtgtggcggaaaagaaatcactgaagagagggctaggtagagagccaggacagagtgtagaaccaggacgtgtggagcactgtgggacacgtcaatagatcagatgccaaagagaggtcaaagataggaaaagagtagatgacaattagaaggttctgatgacttggtgagattttagtttgttttttgtttggtaagtgagagaaagaggtgtcagtggtgtctcatataacagaaaattacatgaaatgaggactaaacacaaaagttgggcaccagacgaataggaggtggcagcacagagtatcaatgttattaaaaagcttagtgaaagagtacagggatgctaaattatatggctagaaggttgaagcaagacaaggtttttgaaagatgttaccatgtttctagtttgaggaaagaacttgagtatagggagatattgaaggttctcaggaaggaaatgatttgatggcacattgccccagaggagactggaagggatacagtcaaaagcacagatggaagacttggccttggaaagaaaaaggacaagtacactttagggaagaggaggaaagagatgctgtgggagtttaatttatgctcttaatgactagtaaagtaagtgaggtgtttgcttgagaagtggaaaagatttgggacagccatggatgaggcagaaagttgttgggaggaacctgatagggagtcagctgaattgagatgatacagctttgccgtggagccagtcagcagggtcatatgactttctccagcaatacttttgaggtcagagaaattggatcagttggctatcccaaggtgggagattggcttgggaggcacaggaaagtcaaaatagcaaaggttttcaagattcatgtgacagcttggaaggaaggattgaccatgggttgattccatggaggtagagaagcaagagagacctgatgattacaatgatggctaagtgtagtatgcccattaggattgaattgaattaggggaaattgtgtgaagtgtttggaaggaagcaatattgtgtgattagctccaaagctggccactggtagaagttgtttcaatggaagaacaaggatggaattgagtgggccagagagccctagattaatgggttaggatgcagaggatggggtagagaagggggaaggtgatttattagtgttcgtcatagtcggtttgggctcctgcagtaaaataccgtagactgggtggtttataaacaatagaaatgtatttctcacagttctgaagatttgaagtttgagatcagggtgccaacatggtcaggttctggtggaggctctcaggttgcagactgctgacttttcttatcttcccatggtagagagagagaagctagagagctctctgggggtcccttttataagggcagtaatcctattatgagggctctaccctcatgacctcctaacaccttacattgggagttaggatttcatcctatgacttttgggaagaacataaacattcagtccattgcactgtttcagctcagttccacctctgtgactgctgctcctttcttcagcaataaaaacctgcacttgtgtaactcttactgtgtttcaagcactatcttaagttaagggccagagtctggcctttaaccacgatgtcccttttggaaaagttaaattccttactgcatgaaccactaacgtatgtgcatatttacatcaatcttaattttagttaattttagccaaaagtcataaagtaagagtcttaacttgacttcactgttggctccaaggaatggagcctccagaagctcatttataccttatgactgtctcaaaggctaggagggagggaataagaagaatgcggagccaggctgggggctgcctgccactgctcagatgctgtccagaggtggtagatgtttctgtgtactcctcctctggttctttgaaatggatacacttagatggctttctttctgggatacctactgttttagtacaaatacatatcggatattaaataatatttgataagaaatgaagagagtattcttctagatttatttaaattttttctgttttatgttttcattttatttcctaagactaaagtgcacttgtgagcatatgaaatcaccacacatctttaactttcatatttttgataaaaatgaataaagcaaccagttggctagatgataatgagtgctttgagttatgcattgtttcaaatgaactctatacaacttatagaaatgtaagttcatcatggagtattaggtattaagcattttaaaatctaaataaatctaaattttatcattagtattatatttattagaacatgtatatgatttataacagctcattcaataaaacttataaaaacaatttgtatctttgtagctgtttctctgcttttcagtaaaatttatgatgtgatgaacttgaggacttgacaagttgatttttgggggtataaaggaaaaattaatagaaaattgattatctgattatgtaatatcacaaaagtcctattattcacagtgtctacttagataaaaacactggataaattgttttagtagatggtgtttagaaatagggaaatgtcagacaatgggttgtctgttttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggtgatcaagtgagatgaaagatatgaaattatttcttatgttgtgaatgctacagaagtgttgattattcaaagaagaggccttgcattgttcccctgacacagaggcttcaagagcagagttgatactgtaggaaacttaacaaaggaaagtggagaaatctgcagagctcctgagcacacctgtgagacatcggatttggtctttgcaaattggctctttgtgaagctgataaacagggtctgaaatttccagaagtttgcattttgcctttgagtagtcctcacagtttggctgttaattgccactgccttcaactttcagaaagtcacacctctgtttgtccataacagttcacagcacttgatataaatacttagtaaaggattatataactataaataagaaacatataccaacttgacagttcacaaagctccatcacagacactatctaatttgatttttgtaacaacattgaaataggtagaacaagtttttttacccattttgttggaggtaatagacacagatttgttcaaggtcacagtaaatcagtatgaggtaacactagctaccatttattgagcccttacaatgtgctaggcatacttctaagtgctttaacttactgaaaaccatctgttataggtactattgtcttcatttttcaaatgagaaaataaaggcacaaagagtaaaattacttgcccaaaggagtaaacatgaacctgttttataacgggatattgtaaaaatattcatatatttttaatccagttcacttatcgttatattacaatgtctctgaaagtatgactgtcctaagtgggtatttctccaagacctgtctccccttatttgtcaaaggaaaattgacttgtctgatatggtgagaagttctgaatactaaagaattaagatggccttctcttagtcctttcaccacttgaacttcgcacttgttacagtgtgactttgcctcgatctttctcaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttggtggaggctctgttctcactgagcttgtttgaaagtgcgtactgtaagtcttgggttgactggatcctggacatcgtgacagggtaggcagaggctaatacctacaaaaaaggaaagagaagctgggtcctgtcccagatctgtaggatgatccttccttctccaaggtttctttctgttgagatcacttttatttgttgttcatctctctatttctctcttattctctggttattcagaacattttcacaaagttcagctcggggaaggagataattgacatacatgtatatacagacttatgtatctgtatataaaagaaatatcaaaaataaaaatggtacaaataagtctaccctcactacctctcccctccgccacaatcccacttccacctgtgttagtactgacatcagtttgctagtggtttgctttgatttataagtagtatgtacagcatgttgttcagcaccttgctttccccgatcccatttaaaatccattttagacatctttctatgtgagtgattactatacatttcttggtatctgattcaaatgtctctatcctccataaaaaaatctaaaattgttgcttacaaattattttttttccagtttccatcttttttttttaagcctgaagaaaatagaaagtataaagatggttttaaggcctaatccatattataattatattaaatagtcctttaagtttcatgtatttgaaactgtgaggtgtttcttttcacttaaaggtcacacctattcttctttctttgtttaatttactatggaaaaatagaaatatttcaaaatactgacagaatagcatgtaacacatcccctcttgtgcttatcatcttaacaattttgaatttgtagccaaaattgtatgtatatatacacaccccacctcttcttgctccctattcccagtattattttgagaagaatgtgttttctgctatggggcagtatgttctatagctgtatttggcttagtgtttttcaggtctttaatttcttcattgattttctgtatagttgtggttattttggtagagtcagaatcttgctctcttgcacaggctggagtatgatcctatctcactgtaacctcacactcctgggctcaagtgatcctcctgcctgagtgcctttttcactcagcctcccaggtagccaggtctacaggcatgtgccaccatgtctggctaattaaaaatttttttttttggtagagacaaggtttcattatgttgcccaggctggtctcagactcctggcctcaagtatcctcctgcttcagcctcccaaagtgttgggattataggcctgagccaccgtgcccagcctagttgttctacccattattgaaaatgggatgttgacatctctgttactcttatatgatccatttgttcttcaattgttagtttttgcttcatgtgtttttggactcttattaattgtatatattttttataatcgataggtcttgattagcctttttattgtaacatgtatttctgtctgtagtaacaatttttgttttaattcctattttcagtttgatattagtatagccactccagctttctttttgggtatttgaaattttaaaaaatggtatttggccaggcatggtggttcacgcctgtaatcccagcactttgggaggccaaggcaggcagatcgctggagcctaggagtttgagaccagcatggtctcaacatggcgaaaccctctctctactaaaaatacaaaaaattagccaggtgtggtggtacacacctgcagtcccaggtacttgggaggctgaggctgaggcacgagaattgcttgaacccaggaggccaaggtttgcagtgagccgagatggcaccactaaactccagcctgggtgacagagcaaaactctctaaaagaagaaggaaaaaaaaaaaagatggtatcttaaaattttttaaaaatattttttctgccaatctcttttttttgattgcagtatttaatctatttacatttaatgcagttattataaagtaggaattatgtctgcattttgctatttgtcttctatatgtcatgttttttttgtttatttccccattactactttcctttgtgttaaatatataatataccattttaattaccttaaaaaaaaaactatttttttcacttattttcttagtggttgccctagaaattacaagtaacatcttagaacaatttactttgaattaacatcaatttaatttcaatggcattataaaaactttgccccagttatagctcaccatccccatttgtgctgttgtcgcacattacatctttacacattttaaacccatcaatgcagttttataattcatactttatatagttagttgtctcttttttttttttcttttgagacggagttttgctcttctcaccaaggctggggtacagtggtgcaatctcggcccactgcaacctccacttcccaggttcaagtgactgtcctgccttagcctcccaagtagctgagattactggctcctgccaccacgctggctaattatttttgtatttttagtagagatgggatttcaccatgttggccaggctggtcttgaacttctgacctcaggtgatcggtgtgcctcggcctcccaaagggctgggattagaagcgtgagccacccacacccagcctagttagttgtcttttaaaatcagatagaaggaaaagagttacaaaaatgcatgtatactgtttttatatttacttactctattattccatgggtgcttttatttcttcatgtgatttgagttactattttatgtcctttcatgtctgcccaaaggactctcttttagcattttattttgaggcaggtctgctaacaatggattctctattttggcttagctcgcactgttaatttcatcttcatttttgaaggaaagtcttaatttctttttttctgtttctcacgtgggataatctcaattggcctatcttcagatttggcagttctctcttcttcaggctaatatctgctgctgagcctcaccagtgattttttttttcatttccgttattgtagttttcaactctagaatttctatttcactctttaaaaaatgtccgtttttaaacagcatttctgtttctattgatatcattttcgacctttctttttaattctctaggcagactttttttaactcttgtaaatatttataatagctgattagcatccttgtcttataagcctacatgctagacttccttagggatggtttctattacctgctttttttcctatgtatacttcatacttcatactttttttttttttttttttttttgagatggagttttgctcctatcacccaggctggagtgcaatggcgcgattttggctcactgcaacctccgcctcctgggttcaagtgattctcctgcctcagcctcccgagtagctgggattacaggtgcccaccacaatgcccagctaatttttatatttttagtagagacagggtttcaccatgttggccaggctggtctcgaacgcctgacctcaggtgatccacccgcctcggcctcccaaagtgctcggattacaggcgtgagccaccatgcccagcttactttttggttttctatatgtcccgtaatttttcccgtgaaaaactggacattttaaatcatatggcaactctggaaatcagatctcccctcccagccatgtgttgtgtttgccgctgctgttgtatttgcttgtttagtgactttcctgtactagttatctgaagtctgtattctttgtcatgttatgtgatccttgtcatgctatgtgtagtctctactcctttagcttagtggtcagctaatgattgaacagagatttccttaaatgctttgagcctgtaagtctaccagcctttgttgaagggctgggtatgtgttgttggggcacgtttcaatgctctggaaggcaattgacaactctgccttaactttcagttcctgcttgcacagttgctcaaggtctttctcaggctcagacaaatgacagtgactctgacagtgagtccaagaggcaggcccagagatcctctgcttctgagagtgagacagaagagtctgatgatgacaagaagccaaagcgcagagggtgtcccaggagcgtgcggaaggaccctttgagatctttcctctgcatggacacagacctgcacatgtcagagcttttcagagtatctatcctatgaacatctttcctcccagtttttctttttgtctttgttcaaccttttgttatttccagttggtaatgttgcctcaggccgtcatggtgttaaatctttgcatctaattgtttttgaccaatgaattttggacagggctattcacacagtgagttctgggtcagtccaataaagacaagcctgagaatggagcttcttagggtgctgttagccaggtccagtcattctgggggaatagggcttttggagaactctcaacctcttctttaccctccagtggctgctgtgctgctggttacacagctattgtagttgcagaagtgttagttttgaaggctgtcatgcagctggggttaaggggtgggaatagtgcaagttaaaaaatgccttgaagcttgctgagccattttcttgaataaatttcttagatggctgcacgcatttggttaatttccagagttgtgacaatactgattgtgaccgtttatgccagcattcctattgcttttatgggggagcagattttcacagacccttagtctgtcatttcggaagtgttgttatttagacataaaatatttcagtgtctgtcaagaaggagaaatgcagttaaggagtaatcctcaggttttgttcatatataatactttcctaacctttgtatctgcgctgttcctttaatgttgtttttagctattgtcatattcagtcccattttattctgtagccatgtcttctcatttccatttttcccttagcatctgtccttacatggttatataacccaattatcatagtaatttggcatattacatgatgcccttaatgtgtcatgaagtcctggtttttagtggaaagtactggtgaccagcctgtaggaatggggatgatggcatgagttggtatgtagcatagtttagggtagagacttgcaggaagatagattggatttttgggaggagaggtcagtagagtttccaaaattgtttgcctaagaagttttaaatcatattttactgtgccttattccaaaaactatttgagacagtcaaaaaaatcttaacagctgaaaaatcattggttttctaataacgaaaaatatggtattgaaggtaacagtggtgaactgaatacgctgatgaaacgatataagggtttgtcacaatagagtcgtgatgattgaatcctttatgacacagtgaagtctataaacttgtatcttctaaaaaggatattagagctaagtcacagttctctagcatgttatctaagcaggtttatgtacagtcactgagaataaagttgatctttaatttgaatagatttttagcagtcattattttaagttgactagtttcaaagacattcaacatttattcatttttttggtagtgcaaggattgagtccactctatttttgacaatttgcatggctcatatgtcatcacaggatatgctagcatcaacataactaaagtaagtctctgtttttttaatatgttttattgatcctattcttaggttcatcaaggcttataagaagtttggtctccctcttgaacggtaagttcagtgtaatagtcccttatcttcctcttttttgcttttattatatagtacgttcttttttggtaaatttttccatttaatactaatgctgggaacatttttttttctggaaacatttatttacaaacatttatatattgggtgcctgttcattcatgtctctctgcagagggatgacaaagatgataaagacaggccatccataaaaagactttcaccttcgtgagggagataaagcaagtatattcaaaaccatagtgcgtgaaataatttccagagagatgttcatgtaactccagttgaaaagaatgtatgtagttattatttgtatcctagttcttagatttaataatgtcaaaggtaaaaggctctttatgattttataatcttctgctaattagcaggattttatgaggattaaatacaaaggacttaacatagccttgactataaaaacttccaaaagggtagctgttgttactattctataagcatttagaaaataattcagaagttagattttaacagaagactctatttgaaatggttcggtactttacttcctataaaatctaaaaagccctaatttaaaggaaatactgggctcccttctctttcttctgataaacttcttgagtgggtgaaaattacaagcctgtttttgtttggtcctctccatttggcgaggaggtagtgatgtgtagcattaagccacagcaaggccaagaaggtcagttgcatctttccaggactattgctgaccacccaggggtagactgtctgtttttgggccagttaccgtaaaagccaatagaatgtggaaaagggggcttgacaccttttgacagcctgttttttagctgttaatgtagttgtgtgcttcatatgacatggagatcaactaaacatatagtagaagtagctatactctgcttctaggagcattgcagtgaatgaaagtaggctggagaaaggaaagtgaacacaaaagaagcaagctagtacggatggtgttcaggcacttcacctgctgccactaacagcctatttatttaataaactttgctttgcttgtttctttctttcctctctgttttttggaattattttgttttgtggaatattcaagacacaattctttatgatggaaaatgaatgtgttagccttcagtcaatgtccaggggttcttgttggagccttagaatgaccactaaaggaacgcaaagaaaagtgtctttgcaggagaagattatgtgaggcctagtggcatctcatgacacttaagaagagtgggcacagggtcctaaagtgtccccatatttgttcctcctcaggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggtaagcgaagttggctttagtgagtcttcgcaacctggcactcttggactggatttctgttgctaaagggcgttttaaggacaggcttgaggaccacacatgcctagtgatttcaggtgtttattctgagctgcgtttctgtgagcttaatattctactctcctacaggtctactcacaaatgaagttgatttgcagaaggtgtagagtgaagaaaaagatgaaatggtttttttttgtgttgctgtagaaagtttaaattcgtcggagtgatgtaaaaacccaggggcagagcttggtggacacctctgtattttggctgcaaataagaggtgttatagatcacaagcattgttaattatcttggatatatattgtgcgttatggcaaacacaaaggatttagagaattaattggaataaataaaatattggatgaatatcgtaaacatttttgggttacgttgagattttcatgccactagaatttgttctcattggattggacatgcagtgtgttttctctttgataccagaaagtgattttgcctgtcctgtgtgatatctttaaaagcaagaggtataggaatgcttgtgaggagagaactctgaagtagttattggtaaggacaccctcatagtgaactttaaagaaacgaagagaggccaggcgcagtggctcacgcctgtaatcccagcagtttgggaggctgaggccagaggatcacttgagcccaggagttcaagtccagtctgggcaatatgtaagtgagaccttgtctctacaaacagtttaaaaattagccgaaagtagtaggatgcacacctgtaatcccagctacatgggaggctgaggtgggaggttcgattgagaccaggaggcagaggctgcagtgagttgagatcatgccgctgcagtgagttgagatcatgccactgcacttcagcctgggtgacagagcgaaaccctgtctcaaaatataaataaattaattaaaaaataaagaaatgaagttattatcattctacttctccagactgtggtttatctgtgccatttctgcattttttggggacagcctttacttaggtaaggctacccttctgcagctttgttgagctgtggttaaatcttcaggctccagagaaagaggcagtcagttatctggaattttggttctaccacttctagttataagactttgggcaagttatatcccttcaactgtctcatttgcaaaatagagtaatagtatctacttcaaaggatttggataattgaataattccatacttgtaaattgtttagcaatggcgtctggcttgcaatgttagctgttattaagaagtgagtatttgtgctttgaaattttctttttttctttttaagattttaataataaaaaattattttattattcaataataaccttaatattattgaatttgatataatttaaaaatatcttcaagagagtcaaaacttattttaagataatgttcttttttgtaaaagacaaataacttgtatggtttgcaaaatgatctgaatatgtgcttttataacattcagaatacacccaaaagtaaactttaggtttaatgtacagtatgttttctatgtaattgttttgaataagtaatacatctacatggcttaaaactgaaaaacgtattcctgttacttcttgatgcttttgagaaatgaataatgttttctcccttttaaatggtagtacagcatgcacacttttctgtgcttgcttttttatctcatagtatcttgtggagctgttttcttaacagtcccttctccccaaagtctcccttttttttgtgcatgtccacattctggatctggctgattgcttcttcctggtattaacttatttcctcacacctgtatttcctgtaaactggtattcagcatattctgaatccaggctgacatttctagatcaaatggaagattattgataccttttttcccttaggttgaaatttttgtttctaaaaatgttaacataattacatatttgctttatcccaaacatatgtttccaaataccaataccaatcttactgttaacaaaagaatgctgaaatgcgaagtgtgatttctttgcatttctttttgatcttagaatatatcacactaacaatataaagtcaaaatatatgtttaaattattcaaagttattcctttctctgtgtggttaatgccaccaccttaatatatagttagactcttttgttttcatttattttcagtacttagggactgcttttctcatttagattcgatttaatttttttaattatgtaaaaacatttacatggttcaaagtcacaactataaaacaaggtacatttggagcatcttgttttcgttttttgttccccagctgccttctcttcctccttaataggtcactgtttctattagttgtaagtttatctttgattgtttcttttaaaatttaagtgtgtgtgcgtattttccttcttacacagaagagaacatactcttttgcacctgcttattttcatgactgagataaattcatatcattatgtagagatcatcctctttccttttacagttgcagagtattctaccatgtagatagatgtcaattcacacttcccccctagtatttaatatttgggttgttttcggtcttttgttattataaagaaagtcacaatgaataatgatctaatgaatataccatttcatatctctgccagcatatctttgggataaatttctagaagtgggattgctgggtcctgggaaaatgcgtatatactttgcttcgatattcccaaatccttctgcataagtctggtgccacaatgtttgtcacaagcctcacaaacagaatatattgttaaacgtttggagttttgccagtttgataggtgagaaacggtatttcatttttcttttaacgaacaaggttgtacatctctaagggtcacttgcattttgttctataaagtgtctattcatgtgtgctgcccattttctattgaaaggagttttcctctcacaggtagcattatctcatggatttcaagttggactatttggttggggcttcatttttacttctgtgatcattttaatttgaaatttgggttagggtaagtttctttttttttttttttttgagatggagtctcgctccatctccaaggctggagcacagtggtgtgatctcggctcactgcaagctctgcctcctgggttcacaccattctcctgcctcagcctcacgagtggctgggactacaggcgcccaccaccacacctggctaatttttttgtatttttagtagagaaggggtttcactgtgttagccagtatggtctcgatctcctgacctcgtgatctgcctgcctcagcctcccaaagtgctaggattacaggtgtgagccaccgcgcccgcctgggttagtgtaattttcttaagccaccacttgttcatcatttcacatgtgttagatgtgaacttaagctcatgtgttttcagtaatagtgttgtgaagatcaagttcatttttaaaacacttgagagttttttgaccttcgctagtgggatgggtaggaaaacaaaaagagaaaccttcagcactaatattataccctcagaatctacttttgttcatttggaaacaaagtagtataaaacaagcaggaagattaaaatacaactataaacatcagtgaattaaaaaagaattccaaatcttaaaagactgaatgttcagaggttattttacagacattagttgagaaaaaaatttgtcttatagattatatcttcaaaataacaataagccagagatatattcagagagactaagaggtcagggttcgttgatacatgttttctgtggaacttctgcagattttcatttaactaatgtgaaactggtatttttcaggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaagtgagtatattttgtgtacatgcttagatggtcgtaccgtaagaaaatagatttgaagttagactttgtgtagttccatagtatttttactgtctcttctttaacataccaaaaaggcccctcttctaatgtcttcctgtttttaaactttctttagatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaagtaagtaaccctaccatgctagagatttctagaagatttgttgtgtaatatttttatatcgattacttatttctaactattttcgagggggcatcaaattagaaattagtatagtcattcttggaaatacttccatctttagcagattgtggcactgtttcacggatgaagataaagggaaaagacagtagccaggtgaaattttggggaaactgtaggagaaatcttaaaattctggtatttaattataggtcagatttcattacaataaatacccaggtgagtttgttaatgataaaagcattccttggccttagttattggccctttgtttaaaagtacatttgaaacaaccatatttcatttcctcacgtaaagattgaatgtcaccttggtattctttgtaatggaattaaacattggctgttcttctcccacaaaatcgagcctcccaccctatctgttgcaagtagcaaggccatggttggagctataagcagggaaggctgactggctcaaattttggtaggatttgctccatgttgtgctcctggcacgttcaacagtgctcatcccatctggttttaggagggtgacagcaccctgccttaagcactgagaccagattcagtctggcaagagacccagttgttgtagcaaggaacagatcatgtcctggcgtagctcagtgctctccggcaatgctctaagaagcattttcaatctaaaacgaagctttaacctagctccagggattccctgctcctggaaggaggaaatccacgacggctgggatgctctagcagatgaagccacaagcccctcctacctgagttgttctaccctgttaacagcacaggtaggagccattgggagagctggatttctccatcccattttgtaaaatgagaacggctcgtgagggattttcagtgactgggagccatggacatgagataggatctgaggctttatctatattttgggtggttggggagggaaaggactgtgctcagtttttgttgtctctgtttatcctgatccactaaccaggatgtgggtggtggcgggtgcttctcttcctttcttgttgaagattctgccggtggagacagataaaaagcctcaggggaagcagctacagacccgagcggattacttgttgaagctgctcagaaagggtctggagaagaagggggctgtgacaggtggggaagaggtgagtacgctgccagctggttgtttttcaggggcctgaggctcctaccctgcagaattaggtaggaagagagaggccctctctgagcactgcacagaatgtcaccttctcatgggcatattttgtttttgaggttccagtaatgatggtttgcttggtaataatagaaatgttcatttaggcctggcgcagtggctcatgcctgtaatcccagcactttgggaggccgaggcgggcggatcacaaggtcaggagattgagaccatcctggctaatatggtgaaaccccgtctctactaaaaatacaaaaaaattagccgggcgtggtggcacacgcctgtaatcccagctacttaggaggctgaggcaggagaatggtgtgaacccgggaggcggagcttgcagtgagccgagttcgggccactgcactccggcctgggcaacagagcgagactccgtctcaaaaaaaaaaaaaaaaaaaaaaaaaaaaaaaaaattcatttaagaccacggcatcttggcagctttcttacaaacccatccttctgaaatgttgcttcaaattcatcctctgctccccagtcccactattccacacatactgttactgtttctttatcctactttctcaattttggaacatagttgcagttactgcattgaatacctgtgggtttgcctgttgttctgtctgtctctgtggttcttgtaatagtggatcccagagataaaatggacagttgtaatgcacagttaattcagaaactagaccttacttgctgtgtgaaataccaactaaattctcagtgaactcagctgagctttatctccttttgtttccccaatttataatttcagttcaggcccagaaagatggaatcccagctaagaaatacaagttacaccctgtactagcagcccatgtgtgcatgttctttaagtgctcttgcagctatgtcatttatattgatttccctgtattattataagcaaagcaaatttgaggaaaaaaacccataataccacacctcatttttttcaagtaatagggtcataagtctcattcttcatataatatgttgagtatgcaatatattatgtgttaggctctggaaaggcagaggttagatcatgttacagatcatatctgattaggcagataaacagtattttaaccttttccttattatatgtaacttgctttcaggttttttaatgttactattatgtctttaatatattatctttatttgtacttttgtatacagagtgattttccttttttaaaaaaaattgtgtctttaggatggattccaaagatgtggaatcagtaggtttaaggaatatggatattttggctggcaaggtggctcacacctgtaatcccagcactttgggaggctgaggtgggtggatcacctgaagtcaggagttcgagaccagcctgaccaacatggcgaaaccctgtttctactaaagacacacaaaaaattagccagtggtggtggcatgtgcttgtagtcccacttagctactcgagaggctgaggcaggagaatcgcttgaacccgggaggcagaggttgcagtgaggcaagatggcacctctacactccagcctgggtgacagtgcaagactccatctcggaaaaaaaaacgaaaaaggaatatggacattttaatgtggtataggccatgtataaggcctataggtttttatttgttttggtttggtcttgtgaggtaaaatgagttgcactcttttgatttctttggaattttcttgtttgaattatatggctgctactgctttaaagagtcatcatgttgtttggttatgcttttgagtgtcttgatttgtattttaatcatcattttctctccttttccaggccaaattaaagaagcggaagcctcgggtaaagaaggaaaacaaagtgcccaggctgaaagaggagcatggaattgagctttcatctcctaggcattcagataatccatcagaagagggagaagtgaaagtatgaagtggggtttcggttgagggttatttatttattttagctatacttatcatgccagctggaataaaatcatctgaaatgtgtttggtttacgagtggattaaatggaaatagaatatgtaagtcttcgcttaatctgtcagcgaggatagtttaagtcagcaactgcaaatttgtacataatggaagtaaatgaaggggactatgacatttttgttgttgttgtttgtttgtttgtttttgagatgaagtctcgctcttgtccgcgaggctggagtgcaatggcacaatcctggctcgctgcaatctctgcctcccaggttcaagcaattctcctgcttcaacctcccaagtagctgggattacaggcacctgccaccacgccaggctcatttttgtattgtaagtagagatggggtttcaccatgttggccaggctggtctcaaaactcctgacctcaggtgatcttcctgcctcggcctcccaaagtgctgggattacaggcgtgagtcaccgcgcccgtcctaaagttttaatgataaatggcgattgacacgtagcctcattcttgcaaatgacggggagtggtcaggactgtggttaaccagagagctcatgcctaatgtaaagggggcagctgctatggagttctgttaacaaaactcctgtgggtcaggtttggcttgccagtttgtaacctctggtctaagtaaagtgaatagtaagttggtatcatttagtgtgctatttcagtgacaactttatggaatttctgagagtgtaattgtacttggatattagctccaagaggatcagcagtgtgtacaggaactagcatggatttgagtcatacatacagatatttatttatttattatgagttgctttttgagatggagtcttgctttgtcacccagggtagagtgcagtggcgcgatctgggctcacagcagcttccacctcctgggttcaagtgattctcctgccgcagcctcccaaatagctaggattacaggcacctgccaccacacctggctagtttttgtatttttagaagagacagggtttcaccatgttggccaggctggtgtcaaactcctgacctcaggtgacaggtctgcctcagcctcccaaagtgctggaattatgagcatgagccactgtgcctggccaatacatacgtacatttaaatactagcaacctaatcagttattagctgactttgtataggtatataatctctttggtactcagtttccatccgtgaaatgagaataataaacttacgttgaagggttgctatgagaattaaatgagaggatatcagtaaagagcttctgcctctacagttgtaactggttattactggaaagtttagacttctctgagtcccttgaggctatttgcttgaaaacaagcttctaagtatagacagtgatgaaccactgggggcagtgcttctttttccagaaagtacataagtagatataaaatttgtagcaaaaattcatagccctgttttgtttcctaggatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaaggtaatgatgcccttctgttcatgcagatatccacagcctttgcaattcgccatttggatttagaagtagaatgagatttgagggccctggaataattgtctttttatgggtatgttcaagaaggatgggtggggccgttgatgggatacctgcacctgtccttgcagagagaggggaacctgcaagtttggggtgttctttaaaaaagaaggcctttacttggtcttttatgacatatttcagggggaaatgtttgaatgagataggacaggtgagagaaatctgcatttacatgtaaatacgaaatacgttctcagattcatattagaggagcacaatccacaactgaatttgaatacttgaagagtttgagtcaaaaacaaatattagcaagagttattggaatataaatggatgaaaagccttgctattataacctttacattaggggttttatgaagttcattctaaaccaaagaatttggtacagtgttgcagtgtatacttgctgacctctgaacacagtaaaatcattgccaaaacacaaacaactgctgtaattctaatatccagttgataactctaatagatttcttgataagtgcctttgaaacttttactttgaaattttatattaaatataaaataaacttctatttaagaacaaatataaaaatcagattaggctgtttgggtagtttttcctcctcacttagcagtatatcacaactttccaagtgattaaatgttaaagtcatttttacagccttggcaacgtagggagacctcgtctctacaaaataaaaacaagcaaaaatctagctgggcattgcggcatgtgcctacgggcccagttgcatgggaggcagaggtgagaggattgcttaggcccaggagctcgaggctgcagtgagccatggttgtgtcacacttcactccagcttgggcaacagaggaagaccttgtctcaaaaaaaaaaaaaaaaaaatcatttttaatagttggggaggattctgtttgggtgtaacatgttagaagcaatttgaatttcccattttgaaatactttctaatttttgatgttaatagaccatactgtgataaataacctgtgcatttgtgctcccacagaaagacattatttttcttaaagtaaaatattaaaaaaataaaaaaagagcaattttagcaaacatctgtttatccactctccagataccacaactgttgttaatattttttcatgtttactttaagtggctttttttttttttttggcggggccaggcggggggagacgctgatatcttttgtatttcatgaacatatgactgatactgttgaagctgccccctgttccctttccctgattttattactcttcctctgttttccccataaccactactgtgaagtgggtccgaaaccttcctgttcatgtttttatatttgtagtacatattatagtgtatatccatataactataaacaaagcatactgtatgcttaaaaatgtacatgaagtcaagctaggcgcagtggctcacacttgtaatcccagcactttgggaggccgaggtggacagatcacaaggtcaggagtttgagacctgcctggacaacatggtgaaaccccgtctgtactaaaaatacaaaaaatagctgggtgtggtggcgtgcgcctgtaatctgagctacttgggaggctgaggcagaagaatctcttgaacccaggaggcagaggttgcagtgagccgagatcatgacgctgcactccggccaggatgacagagcgagaatctgtctcaaaaaaaaaaaaaaaaaaagtacctgaagtcattttatatattcttctgcaacctttccttcaatgtaattgagatttgtatagagttcatttacaataatgtagttaatacagattcctaaaccaaagggtatgctgttaataaaggttgctacatgatactctagagagttctgccaatttacaagcttaacctcttgatgacatttctgtgcattttacggataaaggagtaagaagcccaaaaatagcactgatgaaattgaagttataattgggtacatttagagatggaaatgggaataatgtgtgagtaagctgctaatcagacaggtttgtcttcatgatgtttcaggattttattttactttttaaaaaataaactgagaccatcatatttacccattttaataacacaacataggtaagaaacctaaatcgcacggtaggattgcacaaatgacaatgactccttgtaactcttttttaaaagcctaaaagtggtgatgccaaatcttcgagtaaatcaaagcgatctcagggtcctgtccatattacagcaggaagtgaacctgtccccattggagaggatgaggatgatgatctggaccaggagacattcagcatagtaagtcttgaaatcggggggtgccagtgtctgcagccgcggtacttgctgtggctctgccttttataggtccagccagagcttcagttgagctaagcaatagtacattacttgggaaacacattgcttacagtatcggaagaccatgtgctcttcagcaggctggcaggaagagattttcttgtcttttattgaggggaagtttaaggagtggatttcatgtcttgtgctcctagttaagagaggctctcagggcccttagaggcatttgggaaagagaagtgttcactgagcaagtatttattgaatgttttctgtgttccagcccccagagttaccatgttgaatagataaccatttctatcatcgtaaactgtacattggagtaggggagttagataactacacaaatcatgttggtgcccctgtgacagggctctggaggagagagagtgcatactgtggagatcctgtgagaagggaatttgacctagtcaggggttgccaggagggcttgtgtaaggaagtgatgtttgagttgggttctgaaggaagaataaaaggtaacaggagaagaggggagggcaaggcgatggggagcgagtgcatggaccaggtcttgcacgggattggatacaggccagtgtgtcctcaaggtccctttgcccctggctggagctgcaggtatagatttcactgtgccaccatcccttccccacctctctgtggtctcttctccccatacttccacaaatccattaatcaaacggctcattcaggctgaaagaaaaagcggttttctttcaaatttgaaaatacttccatcctgtggcagcaaaggaccctgttgaccctgtcctgtaacctctctctgacttctttctctgagttctctaaaacctatacacgtatgtatatagatattgttttctttgcacttaactctgttttcttaagtctcttttttgcctgtgagctctctgaggacaagtattgttttatataaaggtcatttagatgctagaagtatatcaataaatgagtaaattgaataaatgaataaactaattacatagccagctaaccaatctgtttcctagtctttcttttccgagtgtttataagagaaaatgatatctaatgttctatggtaccatgatatttaaaaaatgctcttacaaatgactcatttaatcttgtttttatattatgaaatctttaaaagatgcagagaaatttcagggatataatagtcattgataaatataccatgaagttttgtcaaatctgaatttttttaagactcaaaatataaagctgaatcccttggtgttcctccctctcaacctatgctttttctgtctctctctctcttttttttttttttttttttgaggcagagtcttgctctgttgcccaggctggattgcagtggctcaatctcggctcagtgcagcctctgcctctccggttcaagcagttctcctgcctcagcctcctgagtagctgggattacagatgcgcaccaccacacccggctaacttttgtatttttagtagatatgaggtttcaccatgttggtcaggctggtctagaactcctgacctcatgatctgcccacctcagcctcctaaaatgctgggattacaggcgtgagccaccgcacccggccttttctctctctcttacctcccagacgtaaccatgattctgaattcgatgtttatacttaacgtgtggttctagagttttactgcttaagtctgtaaagatgataatagctcacattaatagccagttactgtttatgtgctttatatatattttttccacaacactcctgtgaggtacgttagtgtttccattttacatatttaaaaataaggtgaagagagttaagtgatttgccctgtgtcacacagctaagacatagaacacagttttgacccaggcagttcggcatgagaggttgggtccataaccattgtcctacgtagcctcccacatataaacaacatagaggattgatttccatgtcttaaaactgtaattggcacttgtgtatcctgtaacttgcttttcctctcacagcagtcacatttgttgagatttatctatattaataattgtggctgtcatttaagtttcatgttattctacaatttattcttccacagtttaattttttcccgtattggtggacatcaggatttttccaaatgtttgctactacaaataggctacagtgaaattgttgcccatattttcttgcactacacaagtgagaacttctctagggtgtatggcttgagcaaaaatggtgggtcattcattaggtgtacacatctgccactttattagatactcgagttcctcttgaaagcagttgtagagattgcatgaattatagcaatgaattcaagttctgattgctgaccagccttagaaacagttgttaatttctgactcagttaacagttgttaatttttgctaatctgaggactatgaaatactgactgaaggtcgttggacatttattttcatattttagtggtcattcatgttccttgtgaattgcctattcagttattcaaaattgacatatttggaataatttatctttcttaccttttctgtaggaattctttttacattcttaatactaatcttttattttttatagtcattacaggtgtcttttagtttttggtatattttttattttatgtcctttttaaaaattgaagtataacacagaaaaatccacaaataataagtatgtagctgtggaaatgaccacaaagtgatggggaatttgtagagttttcattatttgaaaatttcatgaccatgtgtcttacttagttcattgtgccagatactcagtggctgacaaccatgtccctacaccattctgtgaaattttcttgaattatatggtggtaattttctctaagttcccagttttacctttatggaatttcttgtgtttggatatcgaattctggatattggtccctaattttactttttaagttgttcatttctgctttttactctactttctgggagattgcttcaactttgtttcacattatttctttccaagatctttttcctccaccgctctcgaatatctttatacttctctttgctttccattgttcacgttacacactttgcttcggtggctttgctgaccctcagttgtcagctcatgtttaagagtggaggacgaaacatgtgattggaagtttgagcatgtgggtggtggggcttgatctcctttgaaagttttcattataggatgatgtagcagaaacttctgacagatagtcaggatcatttggtgtttcctctggggcggtcacattttgtgaagaatgccccagtttcctgactctccagagcgtgaaggcctggctccatccactctggaatgtgagaggcagagacctgggtgtgggtcatcctgtgtgactgtgctcatgtgctcaggtaatcctgttttcagtgtggtgggctcagccctcatctgtgcctgtgcagtcccgctcagaggtccttttatccttttctggagaataagtctttatatttgctgctggttggagttagagatctgggtatcttatgaatctggatatgtgttacttcttaagcagtttttaaaccgctccccattttagccctcatccttccttctgaagacacctcgccgttgggggaattttgccgtgtaagtcaggttagttctaggctgtcttccctcctggcttcgaatttcattttctcaggtctgttttgtcatttcccgtgctgccaatattttgttgccattatcctctctcttgttttctcttgtctttgtgggcttgtctcttttaaggacagtccctttaccattgttttagtgggattggggaggcagagaaaagatgcttgtgttctgtttaccatcttatctggaagcctttctcttgctttctttcaagcctgaaggatttgcaaatattatatcccgtatttttagacagtttctggtgggagaatttcagattaggtctgtaatactgctgctcattagatcttcaaaatgggcttgtgaggcatgccatgcctctcttgcagatgaggaagcagtatttagagaggttaagtaaggcgtgaagggttatcacataactctaagcgatggtgctggcactgcacttcagggttttctgacttgaatacttacacttactccactgcactagctttacccactcttcctctagcaattatatggcataggggtgggctgtgttttcatcgagagcacagtaagcaaaggacaagacttattttctgcagattgtttatgtctttactctgttgtcctgttgcagtgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggtaaccactttggcctcgtctgcccagtttgatttgactgagtgtgggagtggattctgttttcttttaataaaaggtggcatagccacctaagaaatctttttcccagcacaactcatctattggcaatatacctgcaggctttaactccctttccatgaaataggccattccactgagaccagccttttgaaggggtaggacgatgtcattaatttattttatgagagaaagatagtgttactggatttgctggtctattctcagaaataaattttctttaagcctacaaggggcaaaaatcatctggtcttaactactttacccatctcaggttgatatccagatattcagatattactgtatctaatacaactaattggttggttctgtaccaacacatggtgacacaaagattaaaaccgcaagaactatgagttctctattctcatatgcttttttagtaattaaagtagtaatttggattaagttaatctagaacttcagtgtttaaggcatcatggtttataaatgttcctttatatagccactgaaacttttttaaaagatttcaatagttttagggaaacaggtggtgtttggtgacatggataagctctttagtggtgatttccgagattttggtgcacccatcacccgagcagtgcacactgcacccagtgtgtcatcttctatccctcagcccccttccccccagagtccgttatatcatttttatgcctttgcatccaatgtttggttttccattcctgagttatttcacttagaataatggtctccaattccattgaggttgctgcaaatgccattattttattcctttttatggctgagtagtattccatggtatgtatgtaccacattttctttatatacttgttggttgatgggcatttaggctggttccatgtttttgcaattgcagattatgctgctataaacatgtaagtgcaagtgcctttttcatataatgacttcttttcccctgggtggatacccagtagtgggattgctggatatatatccactgtccactttggatattttaagaaaacatgactggaaatttttttttttttttttttttaaatgagacagagtctgactctttcactctatcgcccaggctgaagtgcagtggcacaatcttggcactgcaacctccacctccctggttcaagagattctcctgcttcagcctcctaagtagctgggattacaggtgcctgccatcacgcctggctaatttttgtatttttagtagagatggggtttcatcatgttgaccaggctggtctcgagctcctgaccttaggtgatccgcccgccttgacctcccgaaatgctgggattacaggcatgagccactgcgcccagccatggctggaaattctaaaaggcaattgtaacattaaatctctttccattaatcacagttacttcgtttttattttattttagactcagagggtacatgtgcttgtttgtacataaccacagttactttgaacttgtatatagttcatggataatgtgattatctttgtataatatgtccaatctcagaggactggtttttgagtgaaaagtggatttaagaaaacttctgcatgatggtgtccacagcatgcttcacacctataaagaaaagatttaattttcaaaatggtacttttttttccgcttaacactgttaccaacttctttctttacctagcggcatctggccttttttttttttcttctttttaaatttaacactgattagaagatagcaaaaggtcatcccagtgaacagacccatttttaaatgtgccaggcactgtgatcttggctagcagtagtttataaggtcctcgccctttacaagtcaaaaaagtagtacaaggtaagccctcggagaaactgttcgtcatgaggcagcaaatgcaagcccagatagagtggaagtgttgagaaggaagtgcgtgaagagtagtcaggaaggaaggtcttctgagaggcaggcaggtgcacttgaactgagcatacatgagctgagtcgaattgctgagatgaacagagttctcaggcttcagcaaaggcttgaaagtgggacagggaggggactgggtggtgttcaggatttaaagacagtttgctaaaaagactgaagctctttataggaggctttagacaggaaggtaaatggctcttcacctgatgcagcaggcttactagttagggagcctgtacaggtggtcctgtcagcagcaagccatggtgaaactacctgttaggaagtttgagaagatatgagactcctttatctggctcactctgactacctgtgcttactctttctaaacacctgtctcatcatatcattcccctgttgcgcagtaacaccatgctagggtgaacataatggaattggagggaaaaagccactgagagttttaaggaagaaatgaaaggttgtggtggcgacaactgggaggaaggaggggcagcaacacagagatgaccaactgaatggaggccacaacctgggagatggtggtgctgatggatttgtggtagagtccagaaagtgaaggaaaacttaaaaggactggagtctggggtgtcattgatagaaatttggaggagttctaggtattgatagagccttagtctctaaatccctctgtcagactcttttggcagaaccatgtaaaggtgtacggtaagtcctcacataacgttgtttccttcagctttgtttcattataacattgatgagaaaaaaaattgattttgtttcccttaaagttgcaatttccaagaacctatcgacaacattaagttaggacttactgtattattaatgcaaatacctgaaataatatttctgtagcttaatttctatgcttagggagtataccacagcaaaatttaatagcttgccatccatgaagatcataaaaaattgcttttctaattctataattcaccagaactgttcatttttctttttaggaacctatggatttttgtttccaagtttacagaatttgatgctcgaaaactgcataagttatacaagatggctcataagaaaaggtctcaagaagaagaggtaaagtacaaattcagtcctaattcatacaaacaaataccaattccacagaaaaatctcttaatttttgtttttccatggggagatgatcacagaatcatgggttattgctggtgctaatagtcaaacaataagaccagatgggtgaaatagccaatgtattggagcctaacatggttgaaattctgacaaagagtgtttaccctgtgtttttaggtcctaaaatcatttgttcaccaggttttttcttccatttgcatttttcttctgtacatgtcagtagcttataaatgtggctcctaggaagtaatagggtggtgggcagaaaatactttttctcttcttttctggaccatctatttggtgtccttccagcttttgtatggaaggggtcctgctactcacttgtgagaggtgctcagaagttgcctctcctttggaatagggggatgggtgcagaagtgacatggaggaggctgcagaggcagtgctccttgtgtgggtgtgcccatttgcagatctgctgacttgccacatgggctgtacccaagttggacattgagttcaatctgtgagcattaaataccacctccactaatgcgtcagctccatgaagacagagattttatgtctctcatctactgctgtgttctcagcacatagaatggaatagaatggtgctggggacagggaagcactcaggagtatttgttatgctgtgcccagtgctgtgttggcctgtgaagcagcaccctcaagtagttgataatttaattttacatggaagaatatgttatagcagtaacatacaggaatcatatactaataagcattataaaaagtctataaatggatagtccggaaaggccccaggagggaatgaaatagttaggaaaggccctttagaagggagtgaaaattaggaagagggtctgaagttggacacataatcatgaaagacttcattcatttagggatcagaatgaataacaaaacagtataagctgaataacaaaaacagtggtatcctactagtgggagtatacattgtcacaacctttctggaggagaattcagcaagatttattaaaagactaaagcatgcagttttgcttccaggaatttagttttgagaaggagatagagatttaaacatgtttataatggaaatggcttggaagcccaacagtaagaaatacattcaatgtggctaggcgcggtggctcgtgcctgtaatcccagcactttgggaggctgaggcgggtggatcacttgaggccgagagttcgagaccagcctggccaacgtgatgaagcctcatctctacataaactacaaatattagctgggtgtggtggcacatgcctgtagccccagcccctcaggaggctgaagtgggaggatcgcatgagaccaggaggtggaggtagcagtgagctgagatggcatcactgaatgcctgcgacagagtgagactctgtctcaaaaaaaaaaaaaaaaaaaaaaaaaaatacagaaaacaaaaacattcagtagttcatgatatatccatattggggagtattaatcagttattaaacataatattgtagaaataagtatttacatggaaagattttcacaatacatgaagtgaaaaatgaataccaaatatttttgtttaaaatataactacaaaaaaaagcttagaaaaatacgtgccaaattattaacagtaattcccttgctggttaggatttgggtcactttattttttttattgtgtgattttttttatatcaaacatttgacttgtgtgataaggagtaatgttactccaacattcagatatttagcttgatgacttgggcataggagttagttcccactggacagtcgagggttgtttgttgtggttagccttggaaagttggtagtcttggttttacatggtccaggatgatcctctgagagtgccgccagcctgggcgcctacaccataccctgtacagtgacatctagcagtctatgcatgtgttcttgcaggtacttagcagtaatggtcaaactcagcataaattccactgagttcccccagcaaatagcctaacagtggaatttatgagccttttttttgttaggaggtagtaaacgccagttcagaagtttaagaaggacaagaaggagctgtttagaggtgatagcctttattcttctctggggaattaagcctgggatcttgagcttctttggtttccttttactctttaggagcaaaagaagaaagacgacgtgactgggggtaagaaaccatttcgtccagaggcctcaggctccagccgggactctctgatatctcagtcccatacctcacacaaccttcaccctcagaagcctcatttgcctgcctcccatggcccacagatgcatggacacccaagagataactacaatcaccccaacaagagacacttcagtaatgcaggtaggtcattaagtggagtttttaaaagaggtgccaaaagataaaaaattcacacagccgtttcattttccaaagacactggctagacttctgtgctttattatcttctaacactttattgtcctctcttttcttaatgagagaaagcatgaaataaagatcccccaatttttttttttgtttgtttgagactgagtcttgctctgtcacccaggctggagtgcagtggcacaatctcggctcactgcaacctccacctcctgggttcaggcgattctcgtccctcagcctcccgagtagctgggattacagatgtgcaccaccacgctgagctaatttttaaatttttagtagagacagggttttgccatgttggccaggctggtctcaaactcccggcgccatgtgatctgcccacctcagcctcccaaaatgttgggattacaggtgtgaaccactgcgtctggcccccaggactattatttcaacttccgattaagaagaacccagctaacatgaacaaacgaaaaagactgagggagaagtttacattctgtatgacagtgaaatggttaaaactgctaatcttgaaagagctcttgtaaattgagaacaaaacaataactgaatagaaaaatgggcaatcaacagagtgaagagacagtttatgtaaggggagaaaatattaccaaccgtacatctgataaggggataatatccaaactgtgtaaggaactcagctccttatgtagcaggaaggcaaatgctcgattaaaaagtgggtaaaggacctgaatagacatttctcaaaagaagacatacagattgccaacaggtatatgaaaaaatgctcagcatgactgatcatcagggaaatgcaaattaaaagcacgatgagatatcacttcacacttgttaggatggctagtaccaaaaagtcaaaagataagggttgccaaggatgtggaggaaagggaacccagcgcattgttgctgggaatgtaagttagtgcagccattatggaaaacaatgcagagatgcctcaaaaaaatcacaaacagaactaccatatgatgcagcagtccctttaccaggtatatattcaacgaaaatgaaatcagttatgttgaagaaatgcctgcacttacatattcattgcagcattatttacgatagccaagatacgtaatcatcttaagtgcccatcagcaggtgagtggataaagaaaatgtgtatatacacaattgaatagtattcagctttaaaaagaaggaaatcctgtcgttcgcaacaacatggttgaatctggagggcatttatgttaagtgaaataagtgaggcacagaaagagaaaaactgcatattctcacttatgtatggaatctgaaaaagtcaaactcatagaagcagggagtagaacagtagttaccagggtcggagggcaggggagaattgggaagatattaacaacggagataaaatttcagttagatatgaggaataagttgagaaatctgttgtacagcatggtgactgtagttaataacaatgtattatataagtgaggtagtgcatatgttaattaggctgattgagccattccataatgtatatgtattttaaaacattgcattgtaatcaataaatacatacaatttttaattgtctattaaaaaatttgtacagtctgggcaacatagactcagtctctacaaaagtgtgaaaattagctaggcgtagtggcgtagtagtcccagctacttgggaggctgaggtgggagaatttcttaggcctgggaggtggaggttgcggtgagccaggattgcaccactgcgctccagtctgggcaatagagtgagaccgtctcaaaaaaaaaaaaaaaaaaaaaaaaattgcagttttgaaacaaaactcaaaggaatccagattgaattaaaattttggaaatttgattagaaaaaaactctgtggagcttatccattgttttaaaacaaaatgagcaaaagttatgaattagacagttcatgtaaaagagaaaattcaaatggccaatatgacgagatgaccaaccttgctactaggaaaatataaattaaagcaacaataggttaatcaatttttttacccattcagatcatcaaaaattaaaaagggaaatacacaccgattgctaagagtgtgaattgctataatctttgcagaaaataatctgaaaacccactctgcgggttgtctgttcctccagcagtggtccctgcctgggaaagacccagatccttagcctgttgcaggtgctcaggatcactgatctcttcagtggtgacagaagtcatctcttaactctttgaggttttctgctctgtggaatcttagtccttctagtcctcattgctttagctgctctttgatgcctttaaacacttctttctttttttgggagatggagcctcgctctgtcacccaggctggagtgtagcggcggcacgatcttggctcactgcaacctccacctcccgggttcaagcgattctcctgcctcaacctcccaagtagctgggattacaggcacacaccaccatgccgggctaatttttttttttttttttttttttttttgtatttttgtacagacagggtctcaccatgttggccaaggtggtcttgaactcctgacctcaggtgatccattcgcctcagcctcccaaagtgttgggattacaggcgtgagccactgcgcctggcctaaacgcattctttttaatcttccctttctcattgtttttggcaggatgtaattctgctacaagctaccctgcctggaagcattacgttctatgttctgtaatcttaaaaatctgagttcaaaattatttcatcaccattttgttgagggaaagaaagctaatgattttgcagaatgattgggaaatgtttccctgttcttagatgtagttgcatcagttatactggcttttttctagtattaggctgtttttgtgttttgtatacgatgtcacttattttatattctgaatcctttacaataacttcttactaaatacattcttttatttaaaccttggattcctcacccatctttttaatagctcaatactttgtaacctgtgatttacctcacagagggtttaagaagaaagaaaatctctttgatttactccagaaaaaatgaactagcttgagttttaagcacctctacaaaaccacagacattgacaccctgttagaaatctcactttccatttgatatgaagccatcctcaagtgatccttcgcatatttagaaggtgtctctttttgttgttatttgttaattcttagggtgaatagtcaaaagttttttactttgtggtgctctcatctgatctacccaggtcagccatgaatttaagccactggtggactgtacatcatattaatgctatcagtttctgagctcagcacttccttaatggtgttgttcttcagctctgtagaaaaaagctggaaggccagtaaaatgagtagagacacttatttggtggcatgtctttgatcttcacataattatagacagaagatggatttttccatgaggtcataggttccttttggttagtcctctgtattagtttcctagggctgtatataacaaagtatcacagactaggtggcttcaaacatcaaacatttattttctcacatttctggagaccaggaagtctgatatcaaggtgtcagcagggttggttccttctggaggctccgagggaaaagctgttccatgcctctcttctgccttctggtggctggcagcagttcttggcgttcttgactcacgccgatttctgcctccatctttgcatagccttctcctatgcatagcctgtcatagctccctctgcctttattttgaaaggatgcctgtcctggaatttgtagcccaacctaaattcaggatgatgtcatctagagatttttaacttaattacatctgcaaagacctaggtaaaatcacactcacaggctctgggtggacatgacattttggtagccacagtttaactctccatccctggacttctgtgtcttcactacattttctgattcaagtgagtatgattcttttccttaggagaaaaggaaggctacagaagttaaaaggattgtagtttggccttaatccgtaagagacagagcactgatccaagctcaaagttagagaaattacttttttataggaggaggtccatttttgtgtgtgtgtgcagaatagggaagaataatagaatcggtgagtgtagtctggagagattttcagagaccaggcacagcaggtaccagcaggtgaaataaacgttagatgtgtaaccggaggatattactcgcagccgtgaaactcagcggtatcattttctgaattagtttggttttgttgttaagagtctgccacagattggaaggttaaacaggtatggagagtgaaaagcggtagttgttaagatttcagaaggagaggagtagtaaattttgccttaaaattttgttggaaagaatgtttaggagtcattactgatacgttagccagcagcaacaagaccaagaagaaagaaatttaatgtctgtttgtaacatgtgtcaggctttcagtttgaacttcagcaaagtagtgcttacttcagcagcatacctacaagaattggaacaatacagagaagattggtgtggaagaaaacaaaaataaaaaataaggctgggcgtggtggctcacagctgtaatcccagcaccttgggaagctgaggcgggcggatcacctgaggtcaggagtttgagaccagcctagccaacatggtgaaaccctgtctctactaaaaattcaaaaattgggcaggcatggtggcgggtgcctgtagtcccatctacttgggaggctgaggcacgagaatcgcttgacccaagagatggagattgcagtgatctaagatcgtgccactgcactccagcctgggcaaacagagcacgactccatctccaaaaaaaaaaaaattgtagtgaaagtgaaattcatccatttcttgcagtcatcagatcattctttcttttcctgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggtatgcaaaaggctgtgagacaccaggtgccaacctttgccaggagctgtttctagggagaaagtgacgtatacatgaatgtatttatctatcaaattactgaagatctcatcatgcatgtgtcagccacagcgaatcccatgtcttggttataggttttatgttttgttttctgggtcatagggagcacatttcacctgtgcaggaaaagagttttctgccgtcttttgaggaaatctagtgaagaggtcgccataaaatattagagtcaacaaccaaaattattaagctctgtgcgaggctgtcagccacactaggtatcagggatcccgagatgggtaccagcccacagtccttacctgccacgagcccataattgaagagtcaaagtcttctgaagctgcaccctctttacttcagtacaatgccaccagtagtacgatgagccaaagctttacattgtgagagtagcaagtccagggagagctaaagaggttttatctgtatttcctaatttcaaatcttggataatttaacctcatagcagctttggttttccctgggctgatgatgtgcgtcatttgcactgtaccttgaatttacagtgggaaaatttcatataaacgtgtcaaagtcgtgctttgtttttggaagatctggtaacagcagcccgcattagcagagagctgtagctgagtagctgccacctcgttgggagactgcccctcgctcccacccttctctattgtctggacccagtgggcatcttgccctgcgttcttctagtaggtctgtatttctatttgatgtcactttccttttgcctgaaggactttttctgctggtgataaactctttcagtgtttgtatatatgcctgaaaaagtattttgccttcatttttgaaagtagtttttgctgagtgtatacatttttggctttacagtttctttcagtgctttaaagatgtacctctgctatttacttgcattgttttgtgatgaaaaatctgtcatccttatctttgttcctctttacataatgttccttttaaaaaaaatcactgattatgatgtgccttggtgtatttttccttggtttcttgtgcttggaaatttttgaacttcttggatctgtgggtttattgtttccataaaatttggaaatttttacaatcttcttcaaatattttttctgatcccccactctctcttcttctttggagattctcattacacctatattagcttgcttgaagttgtctcacagctcacttgtattctgttgacttttaaaaaattatgctttctgtttcactgtggatagtttctattgctacctcttcaagttcactaatactttccttttcaatgtcaagactgctgtgaggcccatccagtgtactttgcattttatacattgtagttctaaaagttcggaaagttgtttttgggtctttttatatatgttctgtgtctaaccttttaaaacctggaacacagatataacaatggttttgatgtccttgtctgcgaatcttatcacttgggtcagtttcagttgatacctcctcactgtgggtcttgctcccctggtgctttctgtgcctagtaatttttgtcagatgccagatgtaacatttaccttgttgggtgctggatatttctgtattcctgtaagtattctggagctttgttatgagttgcaggttatttggaagcagtttcctttttcaggtcttgctgttaagattcgttaggtagaaccagagcagtgctcagtcaagggctaatgattgcccacccccaaggtaaagagcctcattgcactctacccaattgcgttagtctgttttgcaggaatacctgaggctgggtaatttatagagaaaagagttttatttggcgcacagttccgcaggctgtacaagcatagcaccagcatctggttggcttctggagaggcctcagggagcttttactcatggtggaaggtgaagtggcagtaggcgtcccatggcaagagagggagcaagagagagaggaggaggtgccagcctcttttaaagcaccagctctcacgtgaactcagagaactcactcattatcacaaggacagcaccaagccatttatgagggatctgcccaaacacctcccactacaacattggaggtcacatttcaacatgagatttggaggggacacatacccaaaccgtatcaccatctggaggtctttggtgtggctggtgagaacaggcacgatgccagttctttgtgagcacagggcactgttaccttcagtcttttcgggtggtcctttccctggccttgggtagtttccccacatgcacatcctaagcagtattcagctgtatacctgggaaccctctgtagatcttcaaacttctttctctgcagcactgtcttctctcatgccatgccctgtgaactctggccaccttggttccccatccctcaccttgggaagccaactggtgtctttctgggtttccttcttcctgtgtcacagcctgagggactatctcatgatagtgaacaggagccgttaaaaggctcatttcattagtgtccattcctcagggatcactgttcttcattgcctgatgtctggtgtcttgaaaaccactgttctatacattttgtcccttttggctgtttcaggcaggatggtaaatctagtccctgttattccattttgactggaacttgagattgctcacttcttcctccctctttctttcattgaggtgaaattcatattacataaaggaactattttaaagcgaacaactgaatgaccttagtgcatttataatattgggcagccaccacttctatctagttccaaaacactttcatcagtcagagaaaaccctataaccattaaataatccttccccattattccctctccccagcctctggcagccaccagtttgcattctgtctctctggatttgcctgttctagacatttcatatagaaagagtcatacaatatgtgaccttttgtgtctggcttctttcacttagcataatgttttcaaggttcattcatcagtactcattccatccttatggctgaataatatttcgttgtgtggatatataccacattttgtttatccattcatctgttgatggacatttgagttgtttccatctttgggctgttgtgaataatgctgcagtgaagattggtgtacaggtacttgactacctgttttcagttttggatatgtgcctgggagtggaattattagtcatattctttacgtttttaggaaacaccaaaatgtttctacgatggctgaaccattttacattcctaccagcaatgtgtaagagttgaaggttttccttatctttgccaacacttatttcctgggttttttttttgtgtttttttttaatgagtatctccatcttcgtgggtgtgaagtagtctcattgtggcttgaacatgcatttccctagtgattaatgacatggagcatcttctcatggttttttttggccatttgtatagcttctttggagaaatgtctgttcaaatcctttgcctgtttttgagttgggttgtttttgttgttgagttttagtaattctttttttaatggtatcatgagcagtttaccatggtccaagctaaaaattttaatactcttcacactgagttggtttttaagataattttattaactagtcactcacttgttgcatatttaggttgatggtgttattaataacttacaaaataatttctgtggctctttttctcatgggctgggtccaggaatatggtaatgtttatggat

SEQ ID NO: 14732 - DNA, 21914 bp, Human; identical to SEQ ID NO: 14626
  misc_feature (1)...(21914): n = A,T,C or G

SEQ ID NO: 14733 - DNA, 21914 bp, Human; identical to SEQ ID NO: 14626
  misc_feature (1)...(21914): n = A,T,C or G

SEQ ID NO: 14734 - DNA, 6556 bp, Human
gatcatcaagaaataaccagaaaaatgggcaaccagcattgagttcctttactttcctaacaaacttgctttcactttatggcctcgccctcaatctctttttttttttttgagacggagtcttgttctgttcccaggctggagtgcagtggcctgatcttggctcactgcaacctccgcctcctgggttcaagcaattctccagcctcagcctcccgagtagctgggattacaggcgcgcaccaccacgcctgcctaatttttgtatttttagtagagatggggtttcatcatgttggtcaggctggtctcgaactcctgacctcaggttatccacctgcctggcctcccaaagtgctggactcgccctgaattctttattgcacgagatccaagaaccctctcttggggtctggatggggacccctttcctgtaacactgggattataggcgtaagccaccatgttcagccacctttgaggcaggaaaatagggtctggaggcagggaacatataaggctgattcacacttcagttatgacaggaaatatcctctccttagggagtacaccctaaatgactttgtaactttacttcatcctcttcatttacatatggcatatcccaaataaccaatggaatcctccaaagggtatttaaactccaacaaattctgtaactgggcccttgagcacctatgctcagccggccccaacactggagtgtactttcattttcaataaatcgttcattccttccttgctttgtgcattttgtccaattctttttttttttctttttctttgagacagagtcttgctctgtctggagtgcagtggcgcaatctcggctcactgcaagctctgcctcccgggttcacgccactctcctgcctctgcctcccgagtagctgggactacaggcgcctgccaccacgcccagctaattttttgtatttatttttagtagagacagggtttcaccgtgttggccaggatggtctcaatctcctgacctcgtgatccgcccgcctcggcctcccaaagtgctgggattataggcgtgagccaccgcgcccagccgttttgtcccattattttagatgccaagaacctgtacaccctccaccggtgacaccttcacagttttgaggagtattcatggggtattttgtaaaatgtttctcaattgggatttgtctgatgtttttctcatgattagactggaggcagctgggattacaggtgtgagccaccatgcccagtctccaaaccctgtttacacaaaaattttaaaaaactagccaggcttggtggtgcgcgcctgtagtcccagctactagagagcctgaggtggatcacttgatcccgggagggggaggctgcagtgagcggagattgtgcctcgctggctgcactccagcccgggcgagagagccagaccttgtctcaaaaaaaaaaaaaaaaaaaaaaaaaagcctaatatggctgagggcggtggctcacgcctgtaatcccagtactttgtgaggccgaggcgggcggatcacgaggtcaagagctctagaccatcctggccaacatggtgaaaccccgcccgtactaaaaatacaaaaattagttgggtactcgggaggctgaggcaggagaatcgcttgaacccgggaggcgggggttacagggagctgagatcgcgccactgcactccagcctggcgacagagcgagactccgtctcaaaaataaatatatacaaattaaaaaagcctaatatacaaaataaagctaggaatcttccctgagtcctcttgcctacggaatgaagtccacagacttgggggagcgttcgaacccttctaaggccacttcctttctccagcctctcgcgcccagttgactcccggcaacacctcccgccgccacaaggagacgcccgaggacttccctccgacaaagccaaaaacggtattgccacgtgacccgctccgcatacacgtgaccagcttcgcacccggtgggcgtcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtggtgagtccggtgcccggggcggggcggagggagccaggggaggtgggtagagcccgaggccccccagtagccgaccctggcgtcgcgctgtctccccagggggagataatcgagggctgccgcctacccgtgctgcggcggaaccaggacaacgaagatgagtggcgtgagtgacgttggggggcgggactaaggaacctgagggcgaggggcgggagtcaactgaaatcccgggatggggaggggcgtctggaattatggggcgggcgaggcgcagatactttgatgaaggggcgtggctcttagctgctccgagaggtacagggcggggcctggaaaggggtggcacttgtgactgaaggaggcttaggagagacctaagtgctggagcttagggatccggcctgggggtggagttcaggtcgtggaagggtggagtctcatagcctggcctgtctaaggcccctgtctatgctattctcatagccctggccgagatcctgagcgtgaaggacatcagtggccggaagcttttctacgtccattacattgactgtgagttctgggcctgaggtggggcatcagggtagggttgggggacagtctttggcattctgtcctgagccatccccactgctacagtcaacaaacgtctggatgaatgggtgacgcatgagcggctggacctaaagaagatccagttccccaagaaagaggccaagacccccactaagaacggacttcctgggtcccgtcctggctctccagagagagaggtggtgagtaggtcccccacttcaccttttctctcctgcctcctatttctcttgtctgttggcattaggggctcctggatgggcaggaggcggctccctctcaccctgacttcatcttgcaaaggatgggggccaaattgcacatgtagctcccagagtccagtagctagtcctgtgtccttcagaaggcgagggtggggtttgataattttgaggtgagggacccctcttccccttccccatcccactgccatccccgccccagaggaagaccctggacctatctctacagccggcctcggcgcaggccagcgggaagaccttgccaatcccggtccagatcacactccgcttcaacctgcccaaggagcgggaggccattcccggtggcgagcctgaccagccgctctcctccagctcctgcctgcagcccaaccaccgctcaacggtaccctcagcaattccagggaccttgctttcttctcaggtcccaccttctctaccttctgacccacctttgttggtttctctctgcagaaacggaaggtggaggtggtttcaccagcaactccagtgcccagcgagacagccccggcctcggtttttccccaggtgagttccccaaaccatctcttgttcccttcctctcttctactctctggtggcttttttcaggctcatttcacagccatcccttcttttcctactatctcggcagaatggagccgcccgtagggcagtggcagcccagccaggacggaagcgaaaatcgaattgtttgggcactgatgaggtgggtctggggagcagcagaagggaactgggtgaaaaggaagggatgcaggcagggtggagagttatttagtgatgagtttaaaaataaagaaggggtggtgggcagagctagtgttggtgggattaggagacaggcagaacatggttcaaatgagtcattggggccgggcaccatggctcatacctgtaatcccagcactttgggagtccaaccaaggctggcggatcacctgaggtcaggagtttgagaccagcctggccaacatggtgaaaccttgtttctactagaaatacaaaaattagccaggcgtggtggcgggtgcctgtaatccagctcggaaagctgaggcaggagaactgcttgaaccccggaggtggagattgcagtgagccaagatcgcgctactgccctccagcctgggcgacagactgagactccatctaaaaaatggggtcattgggtgatcttttccacatcatcgatcctttagggtttcaggttttttatctggaaattggggatcatggtacctcccccttagggttgctgttaggcttgaaggaaacctgtcaaagggctgtgagctgtggtgtcctgctgagctgtctcttacaacctggtattttccactggccctgggcaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttggtatgaggggtccagggaggctgccttcccagcaccctccacgttgcccttgttcctgatcctcctctcttccccagaccaagtgtgacctacgacatcctccaggcaatgagatttaccgcaagggcaccatctccttctttgagattgatggacgtaagaacaaggttagtgcttgagaggcagtgaggcgctggggtgaatcaaatgacagcttcttcttgctcaggtaaacactgaccagtcaagccagcagatcagtccagcccatttttattgagttcctgctgtctggcaggtgctggtagccaggaatgagacagtctctgttctctgacagcttagtccatgggagagacagtcataccaatgacctctagctcccagtgtcctaagtgtcatgaaacagagggtaggttagcaggacccaaaggaggtggtcagcagagcttcatagagggttacctttcagccttggtggatgacaaagtggctgaggggatttcttgcagtggtgttctgaagagtaggcatggatgcacaaaggtggtctttgtgaaaggcagagatcattctggttgggaggcagaaaagggaggatgagggaaggctcgtacatgggacagagcttaggtgatgaagatgctgtgttaaccaccattttgtaattattaatgtggacctgggcatccaagtggcagtacccagcagcaggcggttaaaaagcaattcctgggctgggcacggtggctcacacctgtaatcccagcactttgggaggctgaggcgggcggatcacaaggtcaggagatcgagaccatcctggctaacacggttaaaccctgtctctactaaaaagtacaaaaaattagctgggcgtggtggcgggtgcctgtaatcccagctactcgggaggctgaggcaggagaatggcgtgaacccaggaggcagagtttgcagtgagccgagattgcaccactgcattccagcctgggagacagcaagacttcgtgtaaaaaaaataaataaataaaaagcaatttctggctgggcacagtggctcatacctgtaaccccagcactttgggaggccaaggtgggccaatcacttgagcccagaatttcgagaccagcctgggcaacatggagaaacccccaggtactcgggaggctgagttgggagaatcacctgagcctgggaagtcaaggctgcagtgacccacgattgcatgattgcaccactgcactccagcctgggtgacaggagtgagaccctgtgtcaaaaaaaaaaaaaaaaacccacaatgtctgaaatgcaggagaaatcgtgtgcagaagtaaagcagcaggattcataattttgctggggtaaaccctaaggcagttattttgttaaattccagaattccttaactctgttgtagagtagcagatcagttcccaggaggtgtgactgtggatgtagaatgttaggttttttaacagctagactcccaagactgttagatagggagtcagtggtcagagtctcactttggacacattagtttgaggagccgtggtcagagtctcactttggacacattagttcgttggctgctgttaaaaaacattaaaaggcagtggtctctcctggtcaggcttagaatggaggtgtgcggagcaaggcgggaaacttgcctgactgagcagggaggcactcagacaccatcacacatctggcacacaggcttttcaacactgaggagcagccctgcctaagctgcgggctggtggagtgggtcaggcccagccagggaagaacactc

SEQ ID NO: 14735 - DNA, 60137 bp, Human
tttcatcttagcattttctatggtaaatcttccctgaccaaactccccatccctccccagtttggaatattcctcccctatactgctgtggtacccagtgatgccattagccaattacttgatcatactccctgccattgactgtagctgccactggacagtctttgtccttctccttatgttttatccaccagttcctaacactgtgtctggaacacagtatgtactcagtaaacatttgcttgtttcttctaatagcctatctgtgaaacgcgttgccaagcagatatttaactgaatcagtgattgatgactgtatttttttgtctaggagtatatagtagccagagaggaatgtacccccctccaaaaatgaatatatacatacatcttcatgttctacatcatccaaagtctctgctctatctcaccaactgaacaatttaaggctcatttttgcttagtttcagaaattggatcacttatcaaaatatttttatggaagcttcaaaaataaagtaatatttagtcattatctgcaagaataggctttagatattttctagtgtaacatgtgttaaaacagttgtataaagtggaccttatgggctgggtgcagtggctcactcttgtaatgccagcactttgggaagccaaggtgggtggatcacctgagggcaggagttcaagaccagcctgaccaacatggagaaaccccatctctactaaaaatacaaaattagccaggcatggtggcacatgcctgtaatcccagctactcgggaggccgaggcaggagaattgcttgaacctgggaggcagaggttgtggtgagccgagatcgcgccattgcactgcagcctgggcaataagagggaaactctgtctcaaaaaaaaaaaaaaaaagtagaccttatagtgtatgtgtcaagtgttttaagggaatcaagaggctgggcatgctggctcgcacttgtaatcccagcactttgggaggccaaggcaggggaattgcttgaggccaggagttcaagaccagcctggcagcacagtgagatcccatctctacaaatttttttttttttttttgagacagagtcttgctctgttgcccatcctggagtgcagtggcgctatctcggctcactgcaacctctgcctacggtgttcacgccgttctcctgcctcagtctcccgagtagctgggactgcaggcgcctgccaccacgccggctaattttttgtattttttagtagaaacggggtttcactgtgttagccaggatggtctcgatctcctgacctcgtgatccgcccgcctctgcctcccaaagtgctgggattacaggcgtcagccaccgcgcctggcaatttttttttaaatgaatgaatgaatgaagataaatatgcctagaaactagaacctgggcgactctcctccatgaaaccgatctatgaaagcactgttgattgtgagatctgagactgaatccaccaaatctgagcttctggattagactttttggttcaagcagaatttagctcatataacctatttatattttccttgaaaaccttaccaaggatcttaatttttcattttttcttgactttttaatggtttttaatttatagctctaaaaaaattgtcatttaagaatcgcttgaacccgagaggtggaggttgcagtgagccacgatcacgccgttgcactccagcctgggcaacaagagtgaaactctgtctcaaaaaaaaaaaaaaaaaaaaaaaaattgtcctttagtaaaaacgacaaaaatatatctgaatagtcatccttttatttggcttgcatttttttccttttatctaggaatgtgatggcattttatcctactttgtttgttatctgatgtgaatatgctttgtctgactctgtataattggcttttgtcatttaacgttgataataaatttcgtactgttctaactggagtttttctttgtttttttttttcctctcctatctagttgttgtggaattataagctgaacctaactacagatcccaaatttgaatctgtggccagagaggtttgcaaatctactataacagaggtaagttgtcaaagaattttgtagacaactaatggcttagaggagaaaattaccagaccagcccttatgagaagaatgactcagttacattacttttcttagaattcacatctgtcttggttgaaaattaggaagttggggggtgtaattagactctttttgttaatgtccacctacgcttacattaggatactattgattgaggcagttggaaatcaggttctattggtctcaaaacagcaagtaaaagtgctgaggtatcagtgctactctcacacattggacaacatgctgtgtctgaagcatatcagcctggttacaggaggtctgtcagcattcctgttttggctatgcagctggatcaattgacccacagaggtatatacttcaaataataggagttagtgttaaaaaggttaagattttaaaaattatttatcttggcccagtgtaaacaacaaataatattagtgaaaattgtggtactttaaatttcttttttttttaacggttttttttttttttgaatcaataatagaaactccaggaagccagagtttctgcattctgaaatatgagaatcacagagaaaacagttgctatttttccaccccagaattaacagtcatagatctcacaccatactaattgtcctcaagctggccctattgatgaattaagtcagggccacattcttcagagctcttaaggaagaccctgtctcatccagataaaccatcagcctgtgttccttgtgtcattatggggattcgtagaacctgttttctcaaactttctaatactagatcagttatgttttattcttttaaagcagtgacccctcatatttaccttggggcttccgagcagaaaggcatgtcgttgaaaaatttatctttagctcctagctttaatattctacatctcaaactcccttagctagctataggactaaacctctaactttaaaatatcaagggcaaagatgtttgcttaataactaaactaaatactaacaaattattcctaggcttgaactttaaatgtttgtattttccctctatattgtggtactatacaattgtaagtagatttttttttttgagatggagtcttgctctgtcgcccacgctggagtgcagtggtgccaccttggctctctgcaacctctgcctcccgggttcaagcagttctcctgcctcagcctcccaagtaactgggattacaggcacatgccaccaggactggctaatttttgtatttttagtagagacagggttttgccatgttggccaggctggtctcaaatcctgacctcatgtgatccacccacctcaacctcccaaagtgctgggattacaggcatgagtcaccgtgcccggccataagtagtttttttttaaaaaacacattggagagatacatatatatatacccgcatatgtttgttttgccccattttgtgtcccattaaatacataccagtttgattggcccagggaaatttagttgagtatgtacatattcactagaataatttcactctttgcattaggctggtttccatataatgtgtgtatcacgatggtcctctgtgaccttttggggtgttctagttttgtaaaagattagcattaacaaggacacttctccctcccacaggaagattatactggagtcagggaaattaaatatcaggaagaacacagtctccagcaaaacatttcattctgtattttcattctatcatctttcttaattttggaatcctacttccagggagaaaaacaacatcacaagaatacctgtaaactattaatacaaaccaaacttaatctccaggattgagctaaatcctgcctgctttccttctggctccagtcaaaaaatagagtgactgcagcattttgctcatggtaccttttcaatctgctccccagccacttcagagtttactcctattcttaaatatgttgatgatgatttagtgccccttttttgctgttcatcttagaagtttagtaagatagaaggaaaaagtgctatccagcagaatgaagaaacatgcaaacttctcattctaacaccacgccctgttgtaatggatagtgagctgaaaaatgagtaggtgccacatctctgtttcagtaaaatctcaagtgattgaagctaaaatttacatttagtttcttattgaggctacagttcaaaatgtgctcctggtttctcttgagtttttttttttttttttttttttgagacggagtcttgctctgtaacccaggctggagtgcagtggcgcgatctctgctcgctgcaagctccgcctcccaggttcatgccattctcctgcctcagcctcccaagtagctgggactacaggcacctgctaccacacatggctaattttttttttgtatttttagtagagatggggtttcactgtgttagccaggatggtctcagtctcctgacctcgtgatccgcccgcctgggcctcccaaagtgccgggattacaggtgtgagccaccgctcctggcctcttgagatgttttaaaacttttggttgctcaacattagggcctggaaaaatgtttctctgtttcattaagtgggtgtctgccactagtcttgttttgtatccagtgtttttctgtggttgaattacaagtgctgggattttcaagcatctattcctcctttcacttttcaaacttaagtctgttttgttcggcaaaaaaaaaaaaaaaaaaaaaaatcttttccaggaaatacagtcctggccctcttttttttttttttttttaagatggagtctctcattgtcaccggggctgaagtgcagtggtgcaatcttggctcactgcaacctccacctcctgggttcaagcaattctcctgcctcagcctcccaagtagctgggactacagatgcgtggcaccacactcagctaattttgggttttttgtttatttgtttagagaaggagtctcgctctgttgcccagggtggaatgcaatggctcaatctcagctcactgcaacctccgcctgccgggttctagcaattctcctgcctcagccttccaagtagctgggactacaggcgcacgccgccacacctggctaattttttgtattttattagagacaggctttcaccgtgttgcccaggctggtctcgaactcctgagctccggcagtccacccgcctcagcctcccaaagtgctaggattacaggcatgagccaccgcacctggccaatttttgtatttttagtagagatggggtttcgccatgttggccaggctggtctcaaactcctaacttcaagtgatccacccccctcggtcttccaaagtgatgggattacggacgtgagccaccgtgcccagccatggccctcttttaggcatcacaaaaacttacttggggttaaactgaaagaatttcattcatcttgactgttgaaaatctctgctgtctctgaaaccagtgtgagactattatttactaaattcccaagtttgcccctttagaagtaaacacaactttcttttctgaactgagttatttacgtggtctggatttgatactggagttagaggtgaagacaacctgttgcctataggataattcctcggtggtgtgtccttcatccagcaccttttggaagaggagattgtgtttgttttgccctatgggcatgcttgtgatagataggcctaatggggagaatgctctctattgcattcaaaggacaaataaagcactgtttcttgtttatattcaaaataaacattcccatttaactccttcctcttgtcagaattgccacttcagtttgtcttaatttccccaaatgcaataggctcttttccaaacacccttctctgttttataatttaagcttataattctattattaggttttacttttgcctgaatttcagcatttgggggctagtttgctttattagcattttgtggtttggaatgcactttgcaggaacaccaccatgcagaatcactctgtgcctgatccactagatcatatgtctaaaccacccaaactaggttccccttcccaaacttcttgctaaactgcactgaacattattttaaacatgtttcccagaccacgtgtgtcccagaccacagcggttaagtttggattctactgatttcaaaaacacatgttcaatccatagttaatttagaacacattaatgtcatgtcaagaagtaggccaggtgaggtggctcacgcttataatcccagcactttgggaagccaaggtgggcgggtcacgtggggtcaggagttcgagaccagcctggccaacatgacaaaactccgtctctactaaaaatacaaaaattagcctggcatggaggtgagctcctataatcctagctactcaggaagctgaggcaggagaatcacttgaacctgggtgccaggggtttcagtgagccgagatcatgtcattccactccagcctgggcgacagagcaagactctgcctcaaaagataaataataataatgtcatgtcaagaagtaatattacaccttccctcctgtctctccttggcccttaggtttgcctaacaataatagttttctgtgtagcttggcttagggtatgcagctggacttcacttttgcacctgtttgtcaaatcttcctccctagattcatcccctcgctgtctcctgcattttttgcatggttacaaggacttcataggaccatgccaaagctgtagatgttaacagctcttttcactgcatttagaagtgagcattacctaagcatttgatatgtaggtatttttttgcaaaacacattaatcaggtttttctagaaggcacaacagtctgagtagggatgacactatttttctttaaaatgaatgtattcctaaatgttttccttggatatatttctaagcatttttctttttttcttccaagtaaagaattaggaaatcaacaggaaaatttcagacatttttctctttgataaatattgtttgatacgagcatggaacacttttgtaaaacagctactttattttgagcagattaaagaatgtgctgatgaaccggttggaaaaggttacatggtttcctgcttggtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggtatctaatactacgttagcttcaacaaaggggtcttaaaatttggtgtatgaaaagctttgtataactgacatgggaaaaatttaggactggagtgaccttaagttgaaattgaagaaacttgtccagacagccctaagagctaaggctggttgacaatgtatttcatgtgtttgtagcaaaatttttcagtactgtatgggaagcagaggaattaatacctgcaaagagtggtgttatcttcacaatattagaccagctgctggttacctgtaatgtgcctctggcaaaggagagacctgagttctctaatattttttttttgaaacagagtctccctctgtttcccaggctggagtacagtggtgggatttccgctcattgcagcctcagcctcctgggttcaagtgattctcctgcctcagcctcctgagtagctggaactacaggcatgcaccaccacgcctggctaatttttgtatttttaatagagctggggtttcgccatgtcggccaggctgatcttgaactcctgacctcaagtgatctgcccgcctcggcctccgaaagtgctgggattacagacgtgagccaccggtcccggccaagattcagtaatctttctctgcatatgtcccactgttagtataaaaaaaattactggccgggcgcggtggctcatgcctgtaatcccaacactttgggaggctgaggtgggcagatcacgaggtcaggagatcaagaccatcctggctaacacggtgaaaccccgtctctactaaaaatacaaaaaaaaaaaaaaaaaccaaaaacaaaattagccgggcgtggtggcaggtgtctgtagtccagctacttgggaggctgaggcagaagaaaggcatgaacccaggaagtggagcttgcagtgagccgagatcgcgccactgcactccagcctgggagacagagtgagactccgtctcaaaaaaaacaaaaaaaaaaattacttagcacactggctgctgtccatctataaaatatcagaaaattttaagatatgtgaaggtacttctagttagttggaagaaaagtcctctctaaatgtgatatattattaatcttcatctcagaagaactgattttagtaaagacaggaaagaaaataactacctagctagtttcttcttccacagttatatctgatcttattttttgacttagtctgctgaacagaaggtcacaatagagatctggccaggtttattctgaatttgtttgctcagcaaaaatgaaaaaaactcctgaaaagtaatggatgccagtgggagagggaccctgagacctgtggcatcacctattagttgctgctgctcattaatctactgttcaggaaatatgatggaaaataaaacccatttgtccctttgccctctatttgttcatggttggcaggcgtctatcactgacaaaggggacatggtgttaggatcctggaactgagcacacagttcaaatgaagggtttcttgctgtgtatggtctggctgtcaccaaagccctgatgccctttccttaatatgagcacagggcctgatcccttatccgagtgtaccactgagttggtcttgaaaaactctgtggcttggcataaatctttcaggcaaataaagaaaggacagctttaataaagaacgcagtgttttccttcccagcagactctcaaaatggcacaaaagcacttaagtcactgatgattcaggaagctcttctgactttatttaggatgttgaaaattatatccaattccaaacctggctccttttaaagtctccacagggttccaaacatacttttcaggaatcagaaatgaggctttttcaccctcgtgatgagtgctccatgcagtaaagccaagcgtttcagtccctctgtggagtagttcttgcctggtaaccaccaaggtagcagctgattagcctccttctagctctctgaattgtcacctccatgtatgagttactaagtctgtagtgactgaaacgattgcagaaaatagtactgctggagccaaaaggcacgacaggattgtttattcacttagataaaataataaaaattgttcctatggactaaagatagaaatgacacttttgtcatttaatctttcagtatgtctaccagttgggtgaaatttcagtttataccaggtcactacaccagcatcaaaggctttcttgtattttggggacggtgagatagactcacacatgaacttctgaaaaaacaccttccttcctatatcattcactctgtactacagccaaatttaaaaaagagggaggcatgttctcagctcttctctgcctttttctaaaacccgtagtttgcttttctgaagccagttattcagatagaaaacttatactgaaaattaacaaagcagcttctgaacacagaaaacaacaggcttgtcagtttcaaatttgctgccactgaagcttgaaactcttctatgactggctttgacttggcctcctccagaggaccgaggagaggattcatggttaatctgtttgtaccttgcctttgtatgaacacataaatgtcatgatttcaaaactatgattttttcaaatgttcatataaattttagaacaaagaagatacattaataaaggctttagaattttatataataataaatgttgtcaaaatgaaagggcagatttccaaaagtaaagatataaatgatttacatcatctgaagaaaaagactgtggctgccaacaaaggaacttaattgcggacatgtgccacagtattagtacttttatgcttttctctcggtagctgtatcatttattatttattatttcatttattatttcctgcttttaaccagttaatttgagtaattctaatattcctttttcctttatctagtgaggtagattacagaagacagcagaaggattgaaatagagaatggtttatagcagagataaaaactgagttcttgcctactatttagagattagtgttagcatctgttgttggtttttttttttgtttttttttgtgggggccgttgttgttaaaggacacggaatatggggaagaaaaatactgcctatcaaacttctaaaaacggatcaaggcaatggcagtagattttaagcagatgtttttctaccataataaagttaacaaaaaattattgtaagttcatttataggataatttattactcatatgccaagcctgtgtattaataactttttaaacctaaatgagcttattttctcataatgtgcaggtgtgtagttcacctcactttaattaatgtttggtaactaaccatgcagtcttcgctgtcaaatatttatatgcctttcagttataaactccaatgcactaaaagctcagagactccgaggaactcctgaaatacccttatttgaaaaaaatatttatctgaaagttacaatgaatggaaacatctagtagagaagtattgtttttttttattttggtgttgttgttgagacggagtctcactctgtcgcccaggctggagtgcagtggcacaatctcggctcactgcaagttccgcctcccaggttcatgccattctcctgcctcagcctcctgagtggctgggactacaggtgcctgccaccatgcccggctaattttttgtatttttagtagagacggggtttcacagtgttagccaggatggtctctatctcctgaccttgtgatccacctgcctcggcctcccaaagtgctgggattacaggcgtgagccaccgtgcccagccagaagtgttgttatgacctaatgccagtgtagttacatttagtcacacgttgcttatcgatgaggatacaatgagaataccaggacacgttctgagaaatgtgttgttaggcaagttgatcactgtgtgagtatcatagagtatagcctactacacacctaggctatgtagtatagcctattgctcctaggctacaaacctgtacagcatgtggctatgctgaaatactggagacatttataacacaagtatagtatttgtgtatataagtacatataaacataggaaaggtacagtaaaaaacacagtgttccatagctgagggtggtggtgtgtgcttctagtcccagctgctcgggaggctgagtcaggagaatcacttgagcccaggagcttgggactgcagtgagctgtgatccctccactgcactccagcctgggcaacagagcaagaccctgtctcttaaataaataaaaatgaaagttaaacaacaacaacaaacaagttttaggagttttatagactccacccactcacccagattaaccccataaataaataatggactgttagctagacacttcatgttctacaactcaaatgagttagttaactcctctgagcctctgttcattcatgtccgcagtagatatcagagctgtgtcctttcttcatatgtgtgttaggagataacacgaaagctttcatggaaacacttggaaattaaggtgctatagacaaatcctttaattaaaatagaaaaaaatacattctttggttgatttgaaattttgtctgaagtagatgttacgctacttggttttaggaatctttttttttttttttttttttttgcctgagacggagttcactcttgttgtctatgctggagtgcagtggcactaactcagctcactgcaacctccgcctcccagattcaagcaattctctcgcctcagcttcctgagtagctggggttataggtacgtgtcaccacacccacctaatttttgaatttttagtagagacagggtttcaccatgttggccaggctggtctcgaactcctgacctcagatgatccacccgcctcggcctcccaaagtgctgggattacaggcatgagccaccacgcctggccagaatctttttattatatgcagattatttcatagataggtattttattataacaagattttaattgcgtgtgtataaatgatagcactatatataaaatatatatataaaatataatatatatatatatatatacttttttttttttttgagacagagccttgcactgcacctcccagtctggagtgcagtggtgcaatctcggctccctgcaacctctacctcctgggttcaagcgattctccttcctcagcttcccgaatagctgggattacaggtgcacaccaccacatccagctgatattttgtatttttagtagagacagggtttcactgtgttggccagactggtcttgaactcttgacctcgtgatccgcccaccttggcctcccaaagtgctaggattacaggcatgagccatcgtgccgggctaatagcactatattttaagatgctttggtttgctatattagtggttataccttaaattgttgaaacatatcttgtaagtatagattaggactcttgaatagaaaatatttaggggaactatctcatattttgcatgaatgaatgtttgtggttgctatggggatgatgaagtgtacaattaaagataattggatggtttttaagaaaactctcagaagcgttttgtgtaaacagtggtaatcttgttaaatcccattaagataaatccagaacatcaacgtgagtattaaacaacagattctacatattgggatgtttgtggacaccacagagtagggaaaggagcaagaaagtctctaacttcttagtggattatgtggtttgttggtttttaacttgactgaaagcactgttggccgggcgcagtggctcacgccagtaatcccagcactttgggaggccgaggcgggcggatcacgaggtcaggagatcgagaccatcctggctaacacggtgaaaccccgtctctattaaaaacacaaaaaattagccgggcgtggtggcgggcgcctgtggtcccagctactcaggagactgaggcaggagaatagagtgaacccgggagtgggagcgtgcagtgagccgagatagcgccactgcagtccagcctgggcgaaagagcgagactccgtctcaaaaaaaaaaaaaaaaaaaaagcaagcactgttatttgggaaatgcctggtttttagagacaaatgaacagagatttcagcagtgtaatttcagtcttgacatgaactatgaccagaactttgagccgatgtggttttttttgtgtgtgtgtgtgtgtgtgttttttttacggagtttctgtcttgtcgcccaggctggagtgcagtggcacgatctcggctcactgcaacctccgcctactgggttcaagtgattctcctgcctcagcctcctgagtagctgggattacaggcgcacaccaccatgcctggctaattttttgtatttttagtatttttagtacagatgggccttcaccatgttggccaggctggtctcgaactcctgacctcaggtgatccacctgcctcggccttccaaagtgctgaaattacagacatgagccaccatgcctggccctgttgtgtttcttatgaatttttgacattttaaatttttaaaaattcaggttcttatttctagtgctaactaaactataatacttaaactttccaggatctctgtttccatttgtagcatgcaagtattatattctaactgaagattattgagagcattttctttaacttccacaatgtggttggttcttacttgatttcttggtagaacgttaataagtcaactctatgatggggttttattactttgtgtgtgtgtgtgtgtgtgtgtgtgtgtgtgtgtagccaaatgttgtttatttgaaacccatgtgataaaagttttaaaatattaatatcctcgctattttaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatgtgagtcagctcagaaactgttcttttcttccttttatttttacacatatataattttgttttaattaatttaattgtgttgttttttgagagattgagtcttgctatgttgcccaggctggtcacgaacttctgacctgaagcagtgctccagctcagcctccccaatttttgagacaggatcttgctgtggtgcccaggctggagtgcagtggtgtgatcatggctcactgcagcctccaacttctgggttcaagcgattcttctgcctcagcctcccaagtagctaaaaccataggcaagcaccatcttgcctggccaatttttttaaaaattttttgtagagatggggcattgctgtattgcccggactggtcttgaacccctggcctgaggtgatctcctccctctgtctctgaaagtactaggattataggcacgagccactgtgacttaaatattttttaatactctattctaacgtaaaataagccatcaagaaacctcacatgtagaaaagccacagaaatggaagaagaaattggtcccagtatagcagaaagtggtaactggatgctcaaccttgatgactgaacatttggttaacagctggcttctaatgatctccacttagtattttttctgctttatctcacttctcaatttcagttcttggaagtctgttttatctataggaattttattttacccaggatcttatttacatctattcaatggctaaaactttgacgcattatatatttatgtgtttttggctaaggtgaagaaaacagcaggtggctaatctttaaaaccaaatccttgattaccacctgctgactctacagaacagccttctaagtctttaaatagaatggtctctccatccttacaacaaagtactgaaagtaacttgtgtacacttccactctgcctgctggtttgcattaacagctttaaccatcagagccactgatgtaagagtttcgttaactctagcatacacttgtaagaaagaagactcagaggctgggtgcggcggctcacgcctgtaatcccagcactttgggaggccgaggcaggcagatcacttgaggtcaggagttcgagaccagcctgaccaatatggtgaaaccccatctctactaaaaataaaaaaattagttgggcagggtggcgggggcctgtaatcccagctacttggggctctgaggcaggagaattgcttgaacccaggaggcagaggttgcaccgagctaagattgtgccactgcactccagcctgggcaacagagcaagactgactctatctcaaaaaaaaaaaaaaaaaaaagactcagactctaacacttctcttggttccctaattaacaaaatacatctgagaacaaatgacaaactccaaatatcatgggaatatttttttcgtctttactgcagtcactgtttttgttaaaagcctattaaattttataaatggaagcgctgtttgtccaaaggtatgtacgattataatcgtttaatagaaagctctatatgagattgtggataatgttcagcataactatttagctaaagtaataataatgtgtatgttccatcttatagacacaagctggtgagggcagagtgtataagtgcctctttaaccataaatttgaagaatccatgagtgaaaaggtaagtattattttgaaactaatgaatgttttatttgttttttaaaagctttctcagccagacacggtggctcacgcctgtaatcccagcactttgggaggctgaggcaggtggatcacgaggtcaggagttcaagaccagcctggccaagatggtgaaacgccgtctctactaaaaatacaaaaattagttggacgtggtggtgggcgcctgtaatcccagctactcgggaggctgaagcaggaaaatcacttgaacccaggaggtggaggttgcagtgagctgagatcgcaccactgcactccagcctgggtgacagagtgagactctgtctcaaaaaaaaaaaaaaaaaaaagctttctcaatttctctgaaacaatatttcttataatcttataccgaaacgtaaatgactgataaagctcaccgctttcagaggtgaggtacttgggttttaagcatatttggctgaaaccaagaaaatgaaaccctgattgtgatatctagatagtgagaagccaagtagggttctcactgtggtggtttttttaggtgtttttgttttgttttgtttttgttttttttttgagtggagtctttctctgtcacccaggctggggtgcagtggcatgattcggctcactgtagcctctgcctgccgggttcaagcaagtctcctgcctcagcctccctagtagctatgactacaggcacctgacaacacgcccagctaatttttgtatttttagtagagacggggtttcaccatgttggccaagctgctctcaaactcctgacctcaggtgatccacccgcctctcactgtggttttatataaaatcctcagtgtgattttatataaaattctcagatattactttgtttggggagtaaaatcagagaattttatataaaaccacactaaggccagccctgcctcctcaagaagtttaggttaaccaaatcaatgtgctttctaggcaattagctatttaatttttcagcagctatatcattaagcatcctcttttagttctttttccctgaatgaatgcaagaacagttgatggcttttgaaataattaattttgctatcttgtcatttactttcctgtgtagctgaagaaatgtttctcatttcctttttcttgtatcatttgaacaatcttattcaaatcttattattcagatgatatagaataattgaataattgtattttaaagcattgaacagaatatcccaaatgttatgttagttgccagtttgatgctagtgaaatttatgttcggggtattgttaaagtggaaaagaatgctgtgtgtcaagttaacatattgggatctgtgagatatttacatgttttggatagctgctattgcagcaacaactagcaagtgactacagaatttctaggttccccacccacttacccctgtctcatgccacactagtttagctcaattgtgaacattttaaccaaacttaaagatagatatgttggtaataactgcagttgttgacatgtacttggctgagtcgctgtgctcatcttagtggtacacgtcaacagtaaagttacatgagtggtctcacggctgttgctgtactctttcctcagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagaggtagcattcatattttttttttaattatcatttctgttcctttttggattcacactctaaagctttatatatataaacgttagtttcctcccatatttgcttttttgagtatttttcttttttttttttttttcttgagacggagtctctcgctctgtcgcccaggctggagggcagtggcgcaatctcggctcactgcaagctccgccttccgtgttcacgccattctcctgcctcagcctcccaagtagctgggattacaggcgagtgccactgcgcctggctaattcttgtatttttagtagagatggggtttcaccatgttggtcaggctggtctcgaactcccaaacttaggtgatccgcccaccttggcctctcaaagtgcttggattataggtgtgagccaccgcacctagcaattttttttttttttaatagagatgaggttttgccacgttggcatcccgggtctcaaaactcctgccctcacgtgatcctcccaccttagctcccagagtgctaggattacaggcgtgagccactgtgcccagctgaatagttttcttgtcttttcttttttttttttttgagacagagtctcgctttgtcaccaggctgtagtgcagtggcacaatctcagctcactgctacctccgactccctagttcagcctctgaaatagcttggattacaggcacgcaccactatgcccagctaatttttgtatttttagtagagatgggatttcaccatgttggccatgatagtctcgatctcctgacctcgtgatctgcctgcctcggcctcccaaagtgctgggattacaggcgtgagccactgcgcctggcctagttttcatttttgaaatacacattgtgcaacattttgaggagactcagggtagcatgatttagcacatgggtcagacttggcttcaaattttggctttatcactaaacaaaccgtctgggtgacctgtttttgttttgttttgttttgttttaatctttttgttttaagttttcctggccaggcgcggtggctcacgcttgtaatcccagcactttgggaggccgaggtaggcagatcacgaggtcaggagatcgagaccacggtgaaaccccgtctctactgaaaatacaaaaaaattagccgggcgtggtggcaggcgcctgtagtcccagctacttggagaggctgaggcaggagaatggcgtgaacccaagagacggagcttgcagtgagccgagatcgcgcgctgcactccagcctgggtgacacagtgagactccgtctcaaaaaaaaaaaaaaaaaaaagttttccccattggcatttacagctcaaagaagttgggggagcttatagtgaatatcttaaatgtagtcttttctaaaagctttaattgtgtaggccaatggagattgttctttggctttcatttttaccctaatagttatcttattgataggatttccatgggcaaagcatttgcattattagtgcagtagtataaaacctgtttcatgcagaacagtgacaggagaagcctgaatatctggagtctaagcctattttatgctgctaaagcttttgctaattctaaacttttcagatgttagcatgtctgataggtatattgtattacagatagaaatatgtacttttaataggtggtgatttctgatgctaatacatagcatcacccttcgtaatgttatgacttacatcctaacttagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcggtaaggagacattgctattgccattttgaatgtcacatttatcagctgaagagcctcttcctgatgctgtcccaccttgctttatatggatcatctgtggtatcacattgaacattaggtactaatgatcagagactgaacgttgcttcttcaggcatatcttagtaagaatgtgacatttgctacagagcaaaagtttgagctcataatcaataaaaagaattgtcttcttagatagatagaatgcattatttgctagagttcctaaagaaagggcagcttgctagactggatttcctaaactcagaatcaaggcaaaccaggttccaatcaatgacgacaggccctctaccaagagagaatttgcctgttgtaatagatttgattgagttgaggctgaaaaagagttgatatgaattgaaattttttctaagtttctaaattttttctgttactaatttaccgcatggcatgaattcctggcctgaaggatcaagagagcatgtcatttttgaaatcacactatcttttcttcatatactagggcaactatgcatggaagagccattttctttttaatttaatttaatgttaagttccaggatacatgtgcaggtttgttacatgggtaaacgtgtgccatggtgggagtcctttttctatcactaaacctcacagttagcatactttgcttggggagataaagttcttcttgatctagcgtttataaacagttgaataactgtaggtcaggtacaaaacacaagttaatgtattagagatttagtacatccctttcattcctgttgtccatgttgattactttttactggataggagtcttagagcaacttaacgtaccatgtgcaccagtgtgccctgtgcagtgaactttcctttggggagcacaagagatagtttcgctttatatcctagaatagtagaaacttgaggctctcctccctcagtgtaactttagaaagccacaatcagtctattattttatagttagcatttttattaaaaactggatatcaactcgaattttattttcctgataatcgtgtaaaatcagatttttacagtctgaaacaaaactttgcggtctgaaacacaacagttttacagaatttggatgtggagtaaaattatgtcttagctttagttactcaccttgacccagagtagacaccagtgcatgtgtgcacgtgtgtctgtgtgtgtgtgtgcgcacgcatgcgtgtctatgcatcccatggtgggaaaacagacaaatgtaacttctttaaaataccaacctgggcaggagggaaggcttctggaatctgccgtttgattttgccacagtgttgtttctagggtgcagttgttactggtgacttccttgggaaacctctgtgccagtgtgggtcctgggacccagaccaaaaatgaatcaggagacagcctatatttgcacttcatccttaaagcagcacagaaaggttgttgtggcgggggttaggaatgaacctaccttttttttttttgagacagagtctcactcttgttgcccaggctggagtgtaatggcgcaacctctgctcatagcagcatccacctcccgggttcaaatgattctcctgcctcaacctcctgagtagctgggattacagttgcccaccaccacacccagctaatttttgtatttttagtagagatggggtttcatcatgttggctaggctggtctcaaactctggacctcaggtgatcttcccgcctcagcctcccaaagtgctgggattacaggtgtaagccaccatgcccggcctaaacctgtctttttactgaggctacacttgtagtaagggatacagaaaaaagaaaatagactggtttgactttatttcgaggcacctaattcacacccagggctttttaaaatgtagcttgttgaaagaactagtgactcagcttgaaagatacataagtacttcccacatcaccctgtgtgtccagaagaaaagtactttccaaatctagagggtggcttcaagtagtgaaacatatggttttgcccatattaaatttagccaagtgaggctgggcatggtggctcacacctataatcccagaacttcgggaggccaaggcaggcagatcacttgaggtcaggagttcatgaccagcctggccaacatggtgaaactcagtctctatgaaaaatacgaaattagccgggcgtggtggcatgcacctgtagtcccagctactcgggaggctgaggtaggagaatcgcttgaacctgggaagcagaggttacagtaagctgagatcacactactgcactccagcctgggcaatagagcaagactccacctcaaaaaataaaaaattaaaacattaaaataaaataaaaaataaatttagccaagtagggaagaagcgctttatttttatttttatggacccagggtttttagcttttgcccacaaaaattgaaggcctaaatgatccaaagggagaaaaatgtccttagtgttctactacagtagccatccccagtcaaattgacgaatgttttaaagtaattcattttgggggagcttatttttatttcttttttgttgttttgttttttaagtgatggggtctcgccgtgttgcccaggctgttctcaaactactgggctcaagcagtctgcccgttttggcctcccaaactgctgggattacaggcatgagccactgttcctggccccttttttctttctttttcaaatttttcttcctaatacagcagacttccatacctgtctgtggttgaccattagttttccctgttctctgcttggtgattgatttagtgatttctcagcaggtagtaagctgtaaagcgtaagcataattatcatcttgttcagtacttactctcccaaatgcaccataatcatgaactgtgaaattctcttcgttcatggctgagtaagtgtgggcccaggctctcctaggccaaagataactgccagtcttattctctagtcatctctctgaagcattttcccaggttttcctaggcatgccaggggctggaataggtgtataatcatgtagcagttcacattttcagtgtttatttcccacgctactgtcactaaattccagagtggcaatgataatgatccctggagctgttagcccactaggctctagagggcattcattttcgcctgtaaatatttgcagtctagtgcatgtattgtttcttgacgtttgcctgtcagtcatggatatttaactgatacagttcttgcagagacttgcagactcccatgttgcttccaacttttctcagaaaaagatgtaaatgctttggtctttgtcaacaaatgtcataagtaacattggtaatcattcgatagtaattttcctaccagctaaccacagcattttgtaggtttcccaaattgccaccaataagttttggtataaataacttctatcgtagaatattggaaatctttcatgtttctctcttctggattaccagcttctttcaggataatagaagtttgtggttttttcctttatttccttttgattatggttctctgataaatttgtgatctaacctatgatcccacaggtgctccagtgaaggccctgtgggatcataggttagatgtataaggatcagaggacaaatcagtgacacaacagggttccagttttttaacttggcaaaagggaacgcaaaccagtaaggattatagttttcaaattcgctttctattattaaagatttctaccccaggtctgggtgtggtggcttacgcctgtaatcccagcactttgggagttcgaggtgggcggatcacttgagttcaagaccagcctggccaacgtggcgaaacctcatccccactaaaaatacaaaagttagccgggagtggtggtacatgcccgtagtcccagctacttaggaggctgaggcaggagaatcacttgaacccgggaagtggaggttgcagtgagcagagatcatgccactgcactccagcctgggtgacagagcgaaactctgtctcgggggggggaaaaaaaaaagatttctaccccaaaacaccatctgctacttatctgtagtaataatcatctttcatgtctgtaaaatgctttgcagtttacctaatattctcccatatattattatttcttacaattttctgcagttaaagaaactaaaacttagaggtaatcaatttgtccatgttctcaaagctaatctgtcagagccagaactattaatagaactcagttcttttgattttaatttagagctttttcatctatgccccaagtgccttaaaggcaggaaaaaaaatgtgaagtacctattctcctgtctttcctttgttccatgacaagatggaaaagtaaatgataaagaatatagtctcatttccagctgcataatgacaagtatttttctatgtacttagaatgagcaagctctggtttacctcttggttatagaaaaatagttgaggaaaatgggaaattataaataccataatcctgttttttgtaattgatatttctgcaagttaaatgaaattgcacatctgcttttaataaagcacagcacacttgacttaataccagtgtctttgcagcaaaattcaaattctagattcttatgacccaattaggtctctaagtgaaaatgttctttatttactcttttccacttaaatctggctttgccgggagcaccaggtttagtaatctgattaacaagtaggcagatgaaagcaaagaggcagccttcatattcatgttgtaaagacctccagggattactgagaacaaagataagcagtccccatcaatgactcaaacagaaaaacctgcagtcaaggtagagaaaccagttggaaaagtatttggcaaatgctcttgagcttggctagtgacaactgtagacaactttattggagtacattgtggtaaataggactgagcaactgaatgtatgaagacactgctcttacctagcacctaagtgactttctttcttccttcttaatttattttaattcagcttcaaacactgattcaggagactgaccctggtgcagattaccgcattgatcgagctttgaatgaagcttgtgaatctgtaatccagacagcctgcaaacatataagatctggagacccaatgtaagttatcttctccatggtatttatccatattgtatttcatttggcagcacagggaacattccttcaaatgacttttgggtggttgttgacatcttaactgaaattttgttgaacaagttgaacatacaccaacttttattaaaactagtattggaattaaaacctaggatctgcctcatccatgatatagagacacctagacccaatattgtgatggtgtttacggacaatgactgagcatatatggacctatatattaggttactgaataattttatatcacgatcaaattaaaatgaaagagagaaacactcaggataggtggtacatactttggcactctgtacttttcatcctagttgtatattgactcattgtatacattgactacctggtaatcatcagaaaatacttgaaacagaaaatagaaatagaaaacaaaatgtggtagttgaagggagtagtaatggacaaaatgaatactaaagttgcaaccaagatctagaaaagctgaataaatgctatattaaagtattctcattctttagttttattttttatgatgtaaaaacagctcttaaaccatggccggatgcagtagctcatgcctgtaattgtagtgctttgggaggccgaggtgagaggatcacttgaagctacgagtttgaaaccagcctgggcaatatagcaaggcaacataaaagtttttaaaatcagctggcgtggtggtgcatgcctgtagtcccatccccttgggaggttgatgtgggaagattgcttgagcccaggagttcaaggttacagtgagttatgatcataccactgcactccagcccagatgacagagcaaaaccctgtctcaaaaaaccaaaccaagccaggcgtggtggctcacacctgtaatcccagcaccttgggaggctgaggctggcggatcacgtgaggtccagagttcgagatgagcctctaaccaacatggagaaaccccgtctctactaaaaatacaatttatttttatttttatttttagacagaatcttgctctgtagcccaggctggagtacagtggcgcaatctcgcttagtgctgcctctgcctcccggatcccagttcaagcagttctcctggctcagcctcccgagtagctgggattgcaggcacatgacaccatgcccagctaatttttgtgtttttagtagagacagggttttaccatgttggttaggctggtcttgaactcctgacctcatgacccacccgcctcggcctcccaaagtgttgggattacaggtgtgagccaccacgcccggccaaaaatacaaaattagtggggtgttggtggcgcatacctgtaatcccagttactcgggagtctgaggcaggtgaagccaagatcgtgccattgcattccagcctgggcaacgaggaaaactcgatctcaaaaaaaacaaaaacaaaaacaaaaaaaatcagttgcaagtaagagcagctttcccattctgcaaaaatctttatagcctgcatttggccatacccaacaacaaagtgagtatagtccatgtttatctcatgctgctatgcaagaactcctgctgttcatgctgtgctagagaattagaaaatcatattcttcctcaaagctttctgtgtggttaaactaattaggaatatttacagtgtaaaaataaccacatcaagcaaagagggggcaggggagagggaagaaggaagaactgctacagatgaaaatacatttaagatacttatcagttaaccttttctggatcctgatttgaacaaacttgtgaaaaaaaaagataattgaaaatatctgggccgggcacggtggctcacgcctgtaatcccagcactttgggaggccgaggcgggcagatcacgaggtcaggagatcgagaccatcctggctaacacagtgaaaccccatctctactaaaaatacaaaaaaaattagccgggcgtggtggtgggtgcctgtagtcccagctactcgggaggctgaggcaggagaatggtgtgaacctgggaggcggagcttgcgtgagccaaggttgcgccactgcactccagcctgggcgacagagcgagactccatctcaaaaaaaaaaaaagaaaagaaaagaaaggaaaatatttgaaaactaacagggtattacatgatagtaaagcttttaaaataattgcttagtggtgtgataatggtattaagtccttatattttaaagaaacatgctgaaatatttacaaatgaaatgatggagtatctgggattttgctttaaaatatcagcaaagaggcctagagttaaaacagacttggcaacagattgataaagttatggggagggaaggtggctgttacattattctctacttctttgtgtgttggaaagttttcataaccagttaaaaatacagcagctgcacactgcccttgtgcatgcatagtcttcagtgctgagtggctctgaagttgatcgaaggtataaccactgtcaggttcagttaatttgagtgattcttagaaaaataaatctgattgccctaagaaaataactaaaagccgccttctacagaccagggaaatactatattgacatagagttctgaacacttctctcttgttacaattttacacatttaatggctaggatcttgtcgtgcctgatggaacatttatacacagagaagatggtagaagactgtgaacaccgtctcttagagctgcagtatttcatctcccgggattggaagtgagtattttgaagccaaagtaaatgtattgcctcagcctcttctcctgtgtagtcataattacctgtatttattaaaataatcagtaggaaactctttttgttcagttctgggacagctaacacactccaatcccctgaaaaactattctttatcactttcagaacattatctaaaagcagagtcagcccactaccagcctgtaccacacatccttgttcaccacgactttggaagtcagggtcaaaatgtttctgatactacaaagatctgtctagtaagaagtatggcacctgtgggggtggcaaaagcgccttcagatatgtctctaagaagataatagtgcagttgtatttttattgatttgcagtggatatggtaattggcttttatttatttattcagagttactgaattaagtctgtcttaaggggtttttgtcaataagtgacaacttgattatctaatttccctctcattctgttaacaaaaagcggtgggggtgggaggatgaactaggagaaggatccgtattacagccagaatcactgagttcattggctgtcattcccctcctctttccgcatcttgctttctctccccacctccaaagcagccagtgctggatccgactgcttctctagcttttcaagttcagtggcttctccattcggttgttaagccaccatggtgtggtagttaattttttttggtgattaatatatattttggccaggcacagtggctcacacctataatcccagcagtttgggaggcctaggcagggggatagcttgaggccaggagtttaaggccagcctggtcaacatagcaagaccttgtctctataaaaactaaaaaaaaatcagccaggtatggtagtgtgcacctgtagtcctagctacctgagaggctgaagcaggagattcacttgaaccgggcgcggtggctcacgcctgtaatcccagcactttgggagtccgaggtgggaggagaacaagggcaggagttcgagaccatcctggctaacacggtgaaaccccatctctactaaaaatacaaaaaaaattagccgggcgtaggtggtgcatgcctgtagtcccagctactcgggaggctgaggcaggagaatggtgtaaaacccgggaggcggaggttgccctgagccgatatcgcgccactgccctccagcctgggagacagagcgagactccgtctcaaaaaaaaaaggagattcacttgagcccaggagctgtaggttacagtgagctgtgatcatgccactgcatgttaacggtgagaccctatctcaaaagacgtgtgtgtgtgcatgtgttttgcccacatactttttctagaaagagattacttgaagattcaatatattcttatttctattccttcagattagctctggaaaggactacagaaagctgggctgtaatttccctttgcttactcaggccatctcaacctaaatagtctactgagtgtattgccttaatcaaaatcacgttttctcctctttaattccttcccccataataaaaaaaaaagtgctgcatagttactcattaaatattagttcttaatagttactcattaaatattagcttttttctcccattaactagccatctaccaaagttgacaatataatatggacagaattaagcatgccctggtctgatgtggagaagaagcaggctcattgtctaatccactgtctccagattcagagttaaatgtcaagtctcataaattgataagcacactcaagtaaccaaaaagataaccaccttacctggcacaggaagaagagagaaaactgaataggagactgtttatcttgccatttcctgatcttactgaatctaatacattacataggattgaacttcattcctacttagaaaaaggtatttagtaaaaagtattaagtaaaaagttgtgaattgcctggtggtggctataactctagttttctgttttcacccagggcatgtgagtgctgtctattaaaatgttaggtatctaacaaagccaagatatctttgagagagactttaaatcttctgtagaaggttaacaaacttctatagaaagttattctcctgcctaggcctcccacagtgctgactactgtgtgttcattaagaacaaaattcacggctgggtgcagtgccttatgcctgtaatcccagcactttgagaggccaaggcaggctgattgcttgagctcaggagtttgagacctgcctggacaacatggcgagactctgttctaccaaaaatatcaaaaaagagcctggtgtgtgcctgttgcctcaactgcttgggaggctgaggtgggaggattgccttcaagccccgggggacggaggttccagtgagtcaagatagcaccactgcactccagcctgggtgacagattgagagatcccgtgtcaaaaaaaaaaaacaaaagaacaaaattcaggaatatacttttacatatcttctgtctccacgcccctggaagtgattatcaatgagtatacaagcaaacacctcataaaaaccctgagcctgtgttagaaggaaatgtctattaattagtggttatcttttaactcttaaccttataggctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggagggtatgcagtgaatatcgacttcatttcttcttcttgtcatttgttttttaaattgtttgctgtatattcttctgatttcagtcatattaggaaaactttttagactattttgtggggagaagattgctgcacttctagaaacttcttccttccatgagtgcacttagagttgccctaccagcttctatcatctgattttatgtttttaacaaagtgggtgggggaagatttccagatttttttttttaattcccaaaatctgaatcacaaatggacagttaaattctgctgtcctaactttatttaggtttaaggatccattagaagcttttagccaggctacaaatggattttaggcttctcctcttggcagctgaacacatttgcattgtctgcccatggactggttggagcagaaacctccatacctcagtctcttggtatttgtctgccccaactgctgctttttgttgggatgtttgtgtgtgctggggtctcggcagcatcggctgcttcccggtgcgcactgacatgcacttgttctccacgatggctttctctaccttctgagatgctccattatcagtcctgcctttgttccggagagttgagatggtatcacttctcatccatccttagaaataccccttctgagcttaatgcaaaagcctggctatctcaaatccagaatgaggggactcagaaggaaatggcatacatcagttgctgctccctaacccagtgtttatactgctgtgtgagaaaacgtgggaatttgttttttttttttttctctctccatataatgagcctctcattaaccatgggggctcccacatcccggcatctttctggtcactatagtgactagggggtaggaggtttattctcttttaaataagaaagagttggagtctgtggtgctggttttcttttctttttttttttaaattgaggtgaaattcacataacataaaattaaccttttttttttttttttttgagacaaagcctcactcttgaatgtgtctcactgcaccccaggctggagtgcagtggtgtgatcttggctcactgcaacctcttcctcctggctcaagtgattctcctgcctcagcctcccgagtagctgggattacgggtgcctgccgtcatgcctggctttttttttttttttttttttttttttggatttttaatagagacggggtttctccatgttggccaggttggtcttgaactcctgacctcaggtgatccactcacctgggcctcccaaagtgctgggattagaggtgtgagccactgcgcctggccaaaataaccccccccttttttttttttttgagacggagtttcactcttgttggcccaggctggagtgcagtggtgtgatctcggctcaccacaatctccgcctcctgcctcaccctccagattagctgggattacaggcatgcgccactacgcccagctaatttttgtatttttagtagagatggggtttctccatattggtcaggctggtctcgaactccagacctcaggtgatctgcccgcctcagcctcccaaagagctgggattacaggtgtgagccaccgctcctggtcttaaccattttaaagagaaaaattcagtgacatttagtacatttacagtgttgtgtggtcatcatgtctgtctagtttcaaaacactccatgactccaaaaggaaaccctgtgttcattaaacagttactttccatccctcctgccccaggtatgctggcttttttttctttttttgcaagagagactaactgtatctgtcaataacagctttgtcatggcccttggaaaaatactagttttcacctgctttaccctctgctaattcttcatagctcatctagaagagtccagtcctatctcataatgttatatctacattttcctgctttttctgatttaggtcaatttgaactcatttctcctgagtcaagtgtatatgctctcttgaattggatctgaccttctacctggtgttcatagactgacacattagttttgctaagcaaaacaacaaacacaaaactttccaactaacctagtctgaatgaagccagttcacttttatcaggatactctcataaaagaatgttgtttatatagtatattagaaactgctgaatatgtataatcgcattgctaaagatatgggcttttcgaagcctcttgcacattttatttatttatttatttatttatttatttatttatttatttatttatttttttgagacggagtttcgctcttgttgcccaggctggagtgcagtagtgcaatctcagctcaccacaatgtccgcctcccgggttcaagcgattcttctgcctcagcctcccgagtagctaggattacaggcatgtgccaccatgcctggctaattttgtgtgtttagtagagacagggtttctccatgtaggtcaggctggtctcaaactcccgacctcaggtgatccgcccgcctcgacctcccaaagtgctgggattacatgcgtgagccaccgcacctggccgcaacatttaatttttattctggaagatatttgaggtataaaatttgggagataaaatacagggttatttgttagtttcctcatagcaggtttatctcatatctttgtgtttttgttttgttacctttcaagtatttagctcattttttctcatgcagctctcacgggagtgccgagctgaagtccaaaggatcctacaccagcgtgccatggatgtcaagctggatcctgccctccaggataagtgcctgattgatctgggaaaatggtgcagtgagaaaacagagactggacaggtaggtgacatcgctttctgtttgtcttacaataatgatgatgttaatgtttaacattttatgcagagtacaaacaccataaaatccatctctctttaccttacagatgtgatttgttgtattgttcaatattttctctggaagaaattctcaggaaaattttctctctggtctttgtatcaggaatagttggcagtgagtttgtgtttgcattatagttattgtattttgtaattgattattttccctcttcctgttgcttattaaaacttctagagccaatggtatggcctgcctcttacaggtatataagatttcatggtaggcatttttgtagaaagcttactactggctccatttcacatcctctttcctttcctttttgtttctcttctttattcattttactcatttttaattcattttctccattaagtccttttgagataagcagggtgtaaatctgtgcgtatgtgagtactggtctgcatgaatagtgggcatgccctagaacagtcccaaaaaacatgtagaaatggaattttttctcacctggttgacaaattgaagctcagagaagttaagtgtatacattcccttacctaaaattcagttcagttcattatatagcctctccatctaggaagcagagggaaggagcagcccccaaaaattccctgagtgctgtgattggctccttaggattgtgtcccagtttaagggaaagaaggaaagatgcatgactgcaggtcatgtgggaagctagctgtcttccatctgaatgcaggatactcagcagtaggaatactgcgtgtttaaagccacataaataaggagtgaactcaggtttctgggttccatttgtaccactacaaaaccccctctggaagtacagtatgaaaaagtcacacgtacaggaattggacattttaaaggagaaacatggttgcctactcaggtctgttgagcataggactatcatgttcagcagtctgtttcctgagcctgctacagttctgttgggtatattgttagaaaatgcttatagttgagctttctgttgcctctgtccaatgaaacaagggatatggtgatttggaatcccagaaaatagtttcctttagaaccccgagtaaagtaaactttagaaagctgcactacattgcagcccgtcatggagaagctaaacttaagaattcttttttttttttattttgagacagtttcactttgtcacccatgctggagtgcagtggcacgatctcggctcactgcaacctctgcctcccgggttcaagcaattcttgtgccccagactccttagtaactgggattacaggcacctgccaccacacccacctgattttttgtattttagtagagacagggtttcaccatgttacccatgctggtctctaactcctgagctcaggcaatccacctgtcttggcctcccaaagtgctaggattacaggtgtgagccactgagaccagccaggattctattaataggatgtttctcttagccatttattttactcccaaaagtttggggtattttcctttagcttttttatttcttcttcttcttccattctggctgttgtataattcctacaactcctctcttcccctcacattctaattctgaaacagagagattcttgcagaatagtaagttaaacttgatcctttaacagagcactttgctaagaaatagctgttgatatgctttgtgaaagtgagctgatattatacttgaaacctctaaacctgtaaacctctagaaggaatagtaatagactaatgctacagatagctccagctcggtttccaaagcccacacaagatagcttttaagtacccaaaccctagtgtgttcacttgtttttcttcagaggacccttttgatgtgtactggagttagaatcccagatctgacttgcaggagctatcagttgtatcctgtgttccagacccctggttcccaattactttgccaataaagagtcttaaaataatctgtgctcttcactgtgaatttgtctgatgatcattattaaagtgcatatttaaaatgagagatgagaaattatcaaagcacagattgaaaatagaatcaaggcctgataaggtttttagactttgaggacacttgaagattgattctccttgcacttgtagatttggtcttctgagggatttgcacagctctttttttttttttttttttttttgagacggagtttcactcttgttgcccaggctgcagtgcagtggcacgatcctggcttactgcagcccccgcctcctgggttcaagcaattctcctgccttagcctcctgagttgctgggattacaggcacccaccaccacacccgggtaatttttgtatttttagtagggatggggtttcactgtgttggccaggctggtctcgaactcctgaccccaggtgatctgcccacttcagcctcccaaagtgctgggatcaaaggtgtgagccatcatgcccagcctttgcatggctcttgtgcccacttggccctcataaccaacctgctacatgaagtaattatcttttcaacaatctcagtctggggaattaaacaaagcttttgtgtcctgttcagtgaggtaattttaaaaagaagagaaaggaggaccactgaaaagggaagtgtcatgacgctgatatctccccttgccttgttcatgtatgtgactgataaatgccagtggcttgcctttatatttgcaggagctggagtgccttcaggaccatctggatgacttggtggtggagtgtagagatatagttggcaacctcactgagttagaatcagaggtaagtggtatgcagcttactcattggaggagagtggctgccagcatcctggccttttgtgtttgattctactgtttctagactcctgagagtgcagattttctgtcaatcaaaagaaacctgatcaaattttccatgtttgctttataaagaagtatattgtgttgctttgtgagctccttccctcatttctctagaacaacactctatacagccctttggttttcttcataaattaggtttatcatagtcattagacttgcctctgtttctcccttaagatagcagctgtacggccgggagcggtggctcacgccttgaatcccagcactttgagaggccgaggcaggcggatctcgaggtcaggagttcgagaccagcttgccaaacatagtgaaaccccgtctctactaaaaatacaaaaattagctgggtgtggtgaaacacgcctgtagtgccacgtacttgggaggctgaggcaggagaatcacttgaacccgggaggcggaggttgcagtaagcctagattgcgccactgtactccagcctgggcaacagagtgggagactgtgtttcaaaaaaaaaaaaaaaatagcagcagtacttcacatcacagtcacattcaagagcaatctacacattcccgttctctcatccctcgctcttttagttaggtcatttggtaatgtttgtgtgtttcagaacataaaagctgaggacttccagctaagcatggaagattgaatacgtatgtttatccctgttccatcctgaaacccactaaaatattttaaaaatgggattagaggccaggtgcagtggctcacacctgtaatcccagcactttgggaggcgaggcgggcggatcacaaggtcaggagatcgagaccatcctggctaacatggtgaaaccccgtctgtactaaaaatacaaaaaaattagtcaggtgtggtggcgggtgcctgtagtcccagctactcgggaggctgaggcaggagagtggcgtgaacccgggaggcggagcttccagtgagccgagatcacgccactgcactccagcccgagcaacagagcgagactctatgtctcaaaaaaaaaaaaaaaaaaaaggtcaagaccatcctggccaacatggtgaaaccccgtttctactaaaaatacaaaaattagctgggtgtggtaaaacatgcctgtagtgccaggtacttgggaggctgaggcaggaggatcacttgaacccgggaggcggaggttgcagtgagccgagattgcaccattgcactcccgcctgggccacagagccagactccgtctcaataaaaagaaaaaaaaaaagggggattagaaaccctcataaagcactgggatgttatttagaaatacagaggagggcagctaaacatgttaaagttattttgtggggccagaaatcagagaagtggggaactaccattttgtcttaaaccttttagtactctatttgaattgtcataatgtaaaattacgtttctcaaccagttcttttttgctttctagttttcagaagttcattgccttctctcatttcgtcgtcatctctcacattatcattgtcatcatggacttatgagagcagtctgggtgtatagctctttaaaggaaggtgttttttcaggagctagtgttgcacgggtttctctctttaaaggcattattagtatgtgttccccagtaacagtggtttggcatctgctttgagggcagtgctctggcttatgagcttataaactgaagatggatatcagttacccctgttttcattttgaactacttagcattttgggaaaatctgcaaaggctttgcatactctaatgttattgctacatgtgtttttacctcacttttcttaattctgccttctcatttgttcaggccgaaagggaatatgtctttaaaaatttgcctttcaaagtataacggaggagcagttctatatttattctggggctatctacttcaaatactagaatcgtttccaaaagtatgtattagattatttgcccatcagatattactgattcagaaagagaaactgctcctcctccaccctggctctttctaaagcagaagtattaatatatttaattttctacaggatattcaaatagaagccttgctgatgagagcctgtgagcccataattcagaacttctgccacgtaagtgatgtctggaggagcaagggttaaaaacagaaacaaattgacagggactctcccctgagtatctcagactcacctctgtctgcagcatgtattactcttgagtgttagccagctttgacaagttaaaattaaaaatgtaaacaggccgggtgtggtgaccaatacctgtaatcccagcactttgaagccaaggaggagcacttgagcccaggatttcaagaccagcctgggcaacatggcaaaactctgtctctacaaaaaatagaaaaaattagccgggcgtggtggtacacacctgtagttccagttacctagggggcagaggtgggaggatcacttgagctcaggaggtcgaggctgcagtgagccgtgattgtgccactgcactccagcctaagcaacagagtgagaccctgtctaaaaaagaaaaaagaaaaagtaaacaagatcgagagagagatgctaccatcctggaacctgtgtttgattagcttttgtaggtaaaaacaggtatgtggccagcagcagttactgagttgccctttttaagaagagatggaacagggaaacccccattagtatgcagggttgattccagtacatcagcctaggaattgttagcatctgcccaggaattgttagcagtaatagtggctccttcttccaactgtctcctagtacctcaatattgagtgaattctgactatttcatattcatttactgaactatttaaattgtgggagtgaaacatacccaggaaccattaggatctgacagttgggaggctatgttagatattgtcccaaaagccagctgcttttcggaaagtgaaaaaaaaagcgtatatcatgtcttatacggaacacagtgctgtgttagttttatgccactgaatgtataccattgtgattcttcaggcttattttgattacaatttatggtgtgtcttttttttgtgagggcttctagaactaaccttgcttgcatttgtttcggactgggctacaagttttgttcattaattgttaccaatgaagtgtaaatgcatgctgtcttccccaggatgtggcagataaccagatagactctggggacctgatggagtgtctgatacagaacaaacaccagaaggacatgaacgagaagtgtgccatcggagttacccacttccagctggtcagtgacacctggctgccaatatcccatcatagctgcctggatgttgactgaatcctttccttttttggaacatcagagcacctctgatgttctgttaaaagtcatttttttccagccaggcgtggtggctcacacctgtaatcccagcactttgggaggctgaggtgggtggatcacttgaggccaggagttcaagaccaacctgagcaacatggtgaaactccgtctctactgaaaatacaaaattagccaggcatggtggcacacacctgtaatcccagctgtttcaaaggctgaggcaggagaattgcttgaacctgggaggcggaggttgtagtgagccgagatcgccactgcgctccagcctgggcaacagagcaagattccatctcaacagcaacaacaaaaaaatcattttttccagccgggcatggtggctcacgcctgtaattccagcactttgggaggctgcggcaggctgatcacctgaggtcaggaactcgagaccaacctggctaacatggtgaaaccctgtctctacaaaaaatacaaaattagcctggcgtgatggcgggtgcctgtaatcccagctactcgggagactgaggcaggagaatcacttgaacccgggaggcagaggttgcagtgagccgagatcgcacaactgcactccagcctggatgacaagagagaggctctgtcaaaaaaaaaaaaaaaaaaaaattacaaatatatgtcctatttttatttaggatggatggatggaaggagggagggaaggaaggaaggagggagggaaggaaggaaggagggaaggaaggaaggagggaaggaaagaaggaaaggaaggaaggagggagggagggaaggaaggaaggaaaggaaggaaggagggagggagggaaggaaggaaggaagcctgcctgttgtagggggagtactggagagatgagcaggtcgtgatgtctcaggtgtgggtcaagccatgcagggtcttgtaaacaggcttgtgagagctatatgaaaaagtgcgccctaccactactgaccacaagttgccacgaaacttctgactttctttctctttacctttcaggtgcagatgaaggattttcggttttcttacaagtttaaaatggcctgcaaggaggacgtgttgaagctttgcccaaacataaaaaagaagtatgtagcttgtagttgtttctttccactttcccgaagttcctcttagctccggaatgagtatgcgagatgttaggcagccctcctgctgcctcgtggggttagccctggaggcctcccgcatctctcctttgattagcgtggcaaacactcggactgtctggacagagcatctggcgatggtagttctcacatggaggtcccataggctaaaggagcatttttaatttttccaggtcaggccatctaactgaccaagtagggctggattgtgtacttagagaagcagggtgcagtgtgagtgaaagaggcgaactgacctcttccctgcgtcgtcccgttatgtcatctcatctaagatgcagcagtttttgtattggattagatatttagtgaagaaacagaatctttattcatttaagaattaagtctttttgaggaaactgatgagctttttcagcgtgactgtccaaattcttccatgttgctctttgaaaggaccatttctagaacacttgccctcatacaaaccaaattcccaatttgctcaggtttctctacctttcaggagtgagtttcacagtaggtcaaaagtacagtcctagagttaagagcagcattcctctgtggtcacatgtttttaacacagatgttgaactgtcgttgcacacatgtgccctgtgtggcttccccttctgtcaggaatgtagtcagcattcatgctgctgcctgcctttcatgacacccacagtcaaattgcagcttttagcaccctgaaaaaaaatacagtgagccttacaggaaagacattcccccaaagggcatcttgaattcttaatggtgtgaccccccccaagcccagctctcaggccatctgcccttgtgtggccccagccagcctcaagcttctttcgtctgcagggtggacgtggtgatctgcctgagcacgaccgtgcgcaatgacactctgcaggaagccaaggagcacagggtgtccctgaagtgccgcaggcagctccgtgtggaggagctggagatggtaatgcctcccagcctctgctcccagaaaccacagtgggccagggcttggaaagctggggagaggctagggcaagggggaggcattttatccactactgtgatggttaagacttgaagtcctgtgcaaaagttttaacatacgaccattagcttcctgtgtcattcttttgattttgaatgataaaacctttcttcccacatgtaactggaagtccagctgtaagacaggctctaactaagcatgtgatccaatcactggatcagtaatgtcctcaggggctgggtgctgtggctcatgcaggtaatcccagcactttgggaggccgaggcaggtggatcgcttgaggtcaggagttcaaaaccagcctggccaacgtgatgaaaccctgcctgtactaaaagagacttaggccagcgaggtggctcatgcctgtaattccagcactttgggaggcaaatgcggtcaaatcacttgaggtctgtaattcaagaccagcctggccaacatggcgacaccccatctctactaaaaatacaaaatttagccagctgtggtggcacatacctgtaatcccagctacttgagagactgaggcaggagaatcacttgaaccgggagatggagtttgcagtgagccgagatggtgccactgtactccagcctgggtgacagagcaagactctgtctccaaaaaaaaaaaaaaaaaaaaaaaaaaagacatttcaagctggaagatttggttccctaactttgagcctagctctttcattaaagtaataataaaagtagaactctacatttatataatggttttgactttccaaagtgattttcacatctcagcagtcctgtgaaggactaaataaggtgtttcagggtagacttggcattgtgttttgcaaagaaggtccaaggccatgcagctatttggtgacagaattgaaagtaaagcctgattctcttgctgcaaggcgactttgctatgtagaagccagggtcactagacaagatgcagtcaacaaataagtctccagaacatatgacatctccagcctaaaccaagctcacctttccatgctggctccctcatgcagacggaggacatccgcttggagccagatctatacgaagcctgcaagagtgacatcaaaaacttctgttccgctgtgcaatatggcaacgctcaggtaactttttgcttttcttttgtaattgtaaaagtaatgtgaaggtaatatttaatgttttctcaaaagctagtgcccataaggtaacattttagtcatgaattttttgctggtgagacaggacccatctcatcccttccaacctaatcccttcttaaactacatcaggctgcgtttccttgggttcttcacctgcactcctctctaactcattttcttccctctttcaggttacctcatccttccctaccttgtctgcctagtaagctcctaatgatccttcagatgcctcctcctctgtagcattctcaatgctctgcacctccaaaattaaccgttacttcactgtgttcccattgcacagaagttcttaactagacgtcacatcagaatcacctaggacacttttttttaatagacagaaacaggaccctatccagaattgtcaggagtgaagtacatacaaacaaatgatttttaaaaaaatgttctcgttactactcggctacctcttctagttaagggcattgccatggggcttcagcctttgagataattacttcattgtcctcttgtatcagactgttgctgatgcaaagtctgatgtcaatataagtctcattgctttgtagttaatctgtttctgataggttttagagtcttctctttgtctgtaatgatctgtagtttcagtgtgatgtggttaggtatggtttttgttttgtgtgtgtttccggttggctctttcaatctcacaatctatgtgttccttcagttctgggacattctcagtcattgctctttcacatactgctttccctttccttccttctggaactcgtgttaggcaattggagcatctgagtccgtcttccatgtctctttaactttttctttggtacttttcatttctttgtactacattttaggtaactcctcagttctctttcccagcatataatttattcttcagctttgtccattctgctccaggagaccaccaatcaagttttgtttttcatttcctagctttctcattgcttcttttcataactacctattcttgattcttatttactgttgtcttctgtgttgttctgaggattttaagtatattttaaaattctgttttgattgctctattacccctttccctcagtttttgactccttggttcattttatttatcatctttcttatgatattagtgttcctcaactagttagtgattcttggccatgccttgacgatttcccggaagtctcatggcttcctgcgatagccccagctgctgcaccttcccatctgctttccttctttcttttcatgatatctgaaggtttagggaagggaagatatcaggatatacttaattcactaccttaaaattcatttcatgacactttatgcttttgtattttgagtgataactcatctttttctaatcatagttacttgtttacataagtttgccctgtgtagctgtgaatttatcaggctgagaattgggtctgattcatatctagcatccagtagtctttctcaggtggtaaatagtgggttgaattgaacctcctggtttgtgcccactgtctagtcggagctgttgctctgggaaaatgcagagagcctatctccaaaatgaatgtggacaaggagcagctctggaaggcagaagaaaccagaaatcgtgggtgtgtttcttttccattagactggagcacagcctgccagtcatcctgagtttttgtctagttgggtttgctgtcagctgtaaggttgtaaatccttatctttggtaaggaaatcctgattccgattgcctgggaatgagaaatggataaagaaatgggaggcacagtggagctgaatgtttcaatcagaacacatggatgagcagtctctgacatctctcaacttgactataactcttttgccatagattatcgaatgtctgaaagaaaacaagaagcagctaagcacccgctgccaccaaaaagtatttaagctgcaggagacagagatgatggacccagagctagactacaccctcatgagggtctgcaagcagatgataaaggtgagaagccgacaccaaaggccgagcacggatgaacaacaaaacaacaaagcacaaacaatggcagcaacttcctcaggctcagctttctcaaagtgtggtccctagacgagcagcagcagcagcaccccctgggagcctgcgggttcctgggcccccctccagatctgctgaatcagaaactctgggagtagagcacgaagtctgccttagctgcctccctagggggttctgatgcaggctcaagtttggaaaccacagagctgggataactgacctcactttgacctgaggcacaagtaaatggatgtgcaataaataaatgattggttttgaggacgattaatagtagctgtactaagaaagtcaccatctaatgtcctgatcatccatctggcacattcagaagatttttctgttttacaggttgttttgcttcattccctcctccagcaggtattccctgcagcagggctgacctgagtacctagatgtcagttccctgatctcgccacacatacattaaactcaaggttcggcagggcacggtggctcacgcctgtaatcccagcactttcagaggccaaggcgggaggatcacctgaggtcaggagttcgagaccagcctggccaacatggtgaaaccccgtctctactaaaaatacaaaaattagccgggtgtggtggcacatgcctgtagtcccagctattcaggaggctgaggcaagagaatcgctcctgggaggcgcaggctgcagtgagccaaggtcatgccactgcactccagcctgagcgacagagtaagactctgtctcaaaaaagaaaaaaaaatttttttttaaacttaaactaaaggttctagctcctttatttcagctttcctttaaagtaaaatgctactttttacactatcaaataaattctagagagaattttgaaagttagaatgtaagtctttttaactggcctgatgaaattgagtcatatgtaaaaatggaaatgtcaggctctgatgtgagagagctttggaaaattttctaaaagtcagtgaacaatccatgtctccataacaagatgtcagcaggttataatcacactctttagagaactagaaacagaactaggaagagaggctcagtgctcaagtgtctcaaccagagtttatcagacactgtaacacttgaagacttgcggattagcagaacggatagggagtttattactagtccacagctgatccctgacttaaaggacagcagtaagtgttcaggaccctaccctttactgcttggtaggattatagccctgtaattaagatgaaccaagtgggtccttagcccacatccttgttcacattggttagtggagaattcctaggtttccccactagagttgggtaggtagggcttgagggctgtacagccacctggtacagtgttacattcatgcttaaacaataagttcctcagatgccattaaacttaacatcaccctctagatagggaaccaatcctgtgtaagaaccagtgaggcagtagaaagaaatgtgagaaatagtagagaataagaaagaaaggggaagttggggtggggtgctctttcaggcctacctgctcctcttgtaccacgtgatgccttcaggctgctgctttcatcagcttttggatagatgttaagggtgaccacaggctggtccaagtgcggtgctgtttacaactaattgatcacagctacttacagatttatttgttcttctacattcctgttgcttcacttgactagccttaaaaaaaaaaaaagtggccaggcgtggtggctcatgcctgtaatcccagcactttgggaagcccaggtgggtggatcacctgataccaggagttcaagaccagcctggccaacgtggtgaaacctcatctctgctaaaacaacaacaacaacaacaaaaaaaacacaaaaatgagctgggcgtggtgacgcacgcctgtaatccccgctactcaggaggctgacttgggaggctgaagcaggagaatcgcttgaactcgggaggcggaggttgcagtaagccgaattgcgccactgcactccagcctgggtgacacggtgagactccgtctccagaaaaaaaaaagtggtcgcagatggagttaatcgccatgtttagatagctgtttttatcaaactgtttctttgcagaggttctgtccggaagcagattctaaaaccatgttgcagtgcttgaagcaaaataaaaacagtgaattgatggatcccaaatgcaaacagatgataaccaagcgccagatcacccagaacacaggtaagatcttggcttggctctcctggccccgtggagtatctgaaaaggaattcagtggctgtagagtgacctgctcaaactcccagggctttgttgcctgggaattttaagggaggagtctgagtgtaagcagggccttcctcctttgaggagcatccagaaaaatggagggagagtcaggggagagaggaggccacaagaaccagaaaactgccctaaaagaacgttcagaaggaatcaggccggcagtccttggaaagaaaaatctagaaattcaataaaacttcatgagtgtgccaggagaatgtacgggtaatctgattcggaacagaaacatttcacctctgagttggaagacctcgtaagttaatggtcacagtgagttggatattgtatttctattttcagtgttctcaaaagtgtctgttatggggaaggttgctgatgtccccttgatttttctgaggactccttagagtattggagtctgcacaaaaccccgcagagtagaaagattcctgaggacctccagaagtactcgttaacaagtcatattgctgattaaaaacagtgtagtgagagctcagtaaatgtttattgaatagataaatccatggttgtagtcatgatcattgacataatatgctccctttaggaaggtggatatctaaaaatgtgtgaatcaggtggaatgttttgtcacatgctcactgctttctactctagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccaggtaaactggcctgggctctccacaaaggtgtatttatggagcctctgtccctgggaattttctcttttgaaatccctagcttgctcccgttttcccaagacctttttcatatcttcccgaacctggggggctaaggggccagatcaaaagcaggcattttgttttttcttgttctttttgtttttttcttgttcttgtggttgttgttgtttgttttttttttcatgtcctgcttttgtagaaaagcttcgttttctgatcagcccatgtatcctccctttgtcacatgcagcgcctgtcttcagactgtgaagaccagatccgaatcattatccaggagtccgccctggactaccgcctggatcctcagctccagctgcactgctcagacgaggtgggatttgcgtgcaaaactggttacgcacagagctgctcagagaagtttccactggagaaaagttgtttactttctctcccttcagccgtgaatgatctggtgaattgaaggccatcttctaggctctccatggtctgcattcctgttctttgtaacactgaattcaacttggcattagtcctgacactctaaagcgttgttccatatttctctgttgaacaagggtgttctttcattatagctctctgtaaatttgttcttcccttcttcttattctggatggtaaacccaagacctgccagaaagataaaagtgctttcagctgggcacggtggctcacgcctgtaatcccaacactttgggaggccaaggagggtggatcatctgaggtcaggagttcaagaccagcctggctaacatggagaaatctgtctctactaaaaatacaaaaaattagccaggcgtggtggcgtgcaccagtaatctcagctactcaggaggctgaggcaggagaatcacttgaacccgggaggcggaggttgcagtgagctgagatcatgccactgcaccccagcctgggcgacagaggaagactctgtctcaaaaaaaaaaaaaaaaaaaaaaagcccgggcgaggtggttcacccctgtaatcccatcacttagggaggctgaggcgggcagatcatgaggtcaggagattgagaccatcctggctaacacagtgaaatcccagctctactaaaaaaaaaaaacattagcccggcccggtggcgtatacctgtagtcccagctacccgggaggctaaggcaggagaatggcatgaacccaggaggcagagcttgcagtgagccgagattgcaccgctgcactccagcctgggcgacagagcgaggttccatctcaaaaaaaaaaaaaaaaagtaattctataatggccgtaaggaagtgcccatctttggagattattggacttcttagctagaaaaggccttgtggagagcgtgttcaacatatgttaatttcaggagctcataacaaaagctgttacaaaaaagctcactcataaaactgtccaaagaaacttaatatttttgtctttgctgtgggctgtgtttctcaactcctgtgtatgtgtgcgtgtgtgtgcgggtacgcgcgtgtgcacactttcaagttgagagtctggtttgaccctgaacctatgtgaatgtcaagcgtttgcttttcgtatttgatttggttatatataaccttgctcctgtggaatcaagtagcagccttctttttgacaagtcctgagatctgactcaagtctcagtgtttacagtgtaaagatatgacatttattgattttccactctgtgtgccagtccttgtgaagaatgaagcctggcatccaatataggaggaggggcacgaaacccccaggaaactgtttgtgatgagccctggcacaggtgtgggacgatcatcaaactgacatgtttagagaccaagggttctggtgatagcagtgctactgcccctggcttgtaaaacagcagtaggccagtgaagagggggcacagatcctgcggtgtccagagctgattggaatcaccggactcatctgcttttgaaactgtcagttcaggccgggtgtggtggctcatgcctataatcccagcactttgggaggccaaggtaggaggatcacctgaggtcaggagttcaagaccagcctggccaacatggcgaaaccccatctctactagaaatacaaaaatcaggccagttgcggtggctcatgccctgtaatcccagccctttgggaagccaaggtgggcaatcacctgagatcagaagttcgagaccagcctgactaacatggagaaactctgtctctactaaaagtacaaaattagctgggcatggtggtacatacctgtaattccagctactcaggaggctgaggcaggagaatcacttgaacatgagaggcagaggttgcggtgagccgagatcgtgccattgtacttcagcctgggcaacaagagcaagactctgtctaaaaaaaaaaaaaaaaatcagccaggcatggtagcacgcgcctgtagtcccagctactcaagaggctgaggcaggagaatcacttgaacctaggaggcagaggttgcagtgagccgagatcgcaccactgcactgcagcctgggtgacagagcttggctctgtttcaaaaaataaaaaaaaaaaagaagaaactgtcagttcatttctgtgctcagtggggtagctttgttttttgtgtctcctgaacagatctccagtctatgtgctgaagaagcagcagcccaagagcagacaggtcaggtggaggagtgcctcaaggtcaacctgctcaagatcaaaacagaattgtgtaaaaaggtaaccaccgtcaccttcttttcctcacttcatttctttttttttttttctcttcttccttttaatgctgtagtctgcctaccttggtaataaaaccaaaaatctcaaccttctgcccagcactcttttcttgctgttccttcttaccaaactttcatttgattttgactgctcatctcctataatgtgaatattcttttcttttctttgagacggagtctcgctctgttgcccaggctggagcgcagtggcgtgatctcactgcaacctctgcctcccgggttcacgccattctcctgcctcagcctcccaagtagctgggactataggcgcccgccaccacgcctgactaattttctgtatttttagtagagacgggggttcactgtgttagccagaatggtcttgatctcctgacctcgtgatccacccgcctcggccttccaaagtgctgggattacaggtgtgagccaccgcgcccagccaaaattaaccttttaaaaaagaatttcactgatgtcattattgaataattgagaacattgtgtgcacattttttcgtctgttaaaaatgtggaaagctagatccgtatattttcctttgcctcttttatcatcacatgatcccatataactttggggaggattttagaatattatttggcctttggtttttggtttttatttctcttactgttgttttatagggactagagtcttgtctggagcatactaacttttatttatggaaacatttctggcctatctttacctcccatagttcccttatgtataaatggagaatctgcagagttgatttcagttccatcatgttgatattcctctcattcaggacatctgtaaacacaaataagaattgctcttgtagtagatgttatgccctgtcctttctgtttttctttctgaggacaacagaggtaaagtagaacattttgtaaacaaatgtgcctttatctaattggtatttttttgtttttgtttttctttgagatagggtcacactttgtctcccaggatggagtgcagtggtgcagtcatagctcactggacctcaaactgggctcaagcagtcctcccacctcaacctcccaggtggctaggaccacagggcacacgattatgcccagctaatttttttttaaataattttctatagagatgggggtcttgctgtgttacccacacgggtctcagactcctacctcggcctcccaaagtgctgggattacaggcataagccaccacccccagtcccgattgagaattttaatatagcatattactctgattttaagatttcacgttttcatatttcttaaagtaacacagtaattgtatcacaccaataaaaatattaacgtttaggtattttaaaatgatacgacatgacatacgggaatgccaaaaacacaaatctgatcttacagtcacttacagtcccctgcttttttccaacacacagttttgtatccctaaaagtagttagttactcaattaaattctgcattctgtacatcatcaccaccttgcaacctgtcccaaagtggtctctgttgttagccctcaacttccccccttttttattagtatatgaagtatttacagacaacagatctgatgcatttccccttcaaaagctctgtctgcaatgaccctccctttccaggaagtgctaaacatgctgaaggaaagcaaagcagacatctttgttgacccggtacttcatactgcttgtgccctggacattaaacaccactgcgcagccatcacccctggccgcgggcgtcgtaagtctctgtgttcactcttgatcctgtctgaactcccttgggaagagcaaagactccctcttagacatcagttgcagctactgtggtctgtatggtctgtagttgtagcccagtcatagacaacattccctggggacctgggtgatgccaaaactagacctttatggcatcatgaatttaggaataagcctgcgagtttgaactggccttgtcatgactggagctaaagatttgatgaacagggagaattgaggtatttattagggaagcagaagttaaagtcatcatcatggtccttttcctggtgccgaaactagaagccagcttcacacacttccccggtgacgacagtggactcagtagacaggttctgtgtgaggagggagccaaggcaagtgtgagagttctttttgagccacgtatacccaataaaactaatagaagttgtttgtttgtatttttatttatttttttgagacagagtctcactctgtcacccaggctggagtgtggtggcatgatctcagctcactgcaacctccgcctcctgggttcaagtgattttcccaccttaacctcctgagtaactgagactacaggcacccaccaccatgcctggctcatttttgtattttttaagtacagacagggttttgccatgttggccaggctagtctcaaactcctgacttcaagtgatccacccacctcggcctcccaaagtgctgggattacaggcataagccactatgcccagcctgttttcgttttaattttttgaaacaaggtcttactataatgtagtctcaaagtcgtgggctcaagggatcctcctgcctcagcttcccaagtatctgggattacaggtgtttgccaccacacctggctctaaaaataaggaggttttaagagaggcttcggacgccaaccctggaggttacatatcatttctctccattgttggatcctggatcaagtttcctagtatgtatttaactttgttgagcctgcagatctgaattctctggtggttgtgcaccctcttcctcatctttacagaaatttctctattctgtacagtttcaggttcttcttattattcatttcctcccacagaaatgtcctgtctcatggaagcactggaggataagcgggtgaggttacagcccgagtgcaaaaagcgcctcaatgaccggattgagatgtggagttacgcagcaaaggtaatgaccaagagaatctccttttttaaaaaaacaaaaaaatatggaacacttcaccaatttgcatgtcatccttgagcaaaggccatgccactctcctcgctgtggctgtccagcctcttttagatatcgcactggtcttgtccttattgtgagactagcaataagtgcgtttgaaaacgtggtcagggccgggcgcggtggctcgcgcctgtaatctcagcgttttgggaggccgaggcaggcagatcacgaggtcaggagatcgagaccaacctggccaacacggtgaaaccccgtctctactaaaaaacagtaaacatggtcagtgtgcttttagaattccttggctgcccgtgagcctggagccgtctccctgtgcatcgggctgtctgcaaggctttgccagggccctcctttctcatttcgcccactgttcaccgctgaaaagtgagtcacccaaagacaaaagagatgtcacacccatggcaaaagaaagaaatccagcctcgcctatgatgaagcttgcttttatcattttacagtctttaggagaaaaatacatatttgaggccagtactcatctggtctggaacatggagaagaaggggatgaagaaagactgtaggacactcatgaatgtgtatgatacccaggtagacttgggctaggggtaatttttcctacagaggttcagcctcagtgagaagaataacagttcttctcgtgcatacattgctttgtagtttacataacgctttggtggacgtattgcctgatttgaactttgaaaccctgtgaggtaagtataatgactgtttcgtcactttacagtgaaggaaactgacttcagaggtcacgacttgcccagagtccctctggtttttagagccatgcttttgtattgactcatattgggatagacatctgcagtggcctaagatcaagagagtaatcccaggaccacccctccttcctggccaattttatcacccttttacttccaagtcaagggtaacaagtcaagaggaacaatcagagaaagtcttcataggtcgacagcaggaaggtacaagggagggctcctgtctgtcacagtagtcaacactctcctcacccttctgccaagggaagaaagttgcctttaaagccggtggctcagggaagcggcagcaggagatgctgcgttacttcattctgcctcattgtgtccagtcctttgagctgtgtattattgcttcagagtgactcagagtaattcacggcttgttttgtgttggcaactattggagctcaaatctcattcatctcacgcctccctactctgttctgtgtacgtgatatgagcatagaaacagcccagatgcctctgggccacaccatctcagcagccaggctgggatgcaaaagaatggggacatgtgcacctggggacccttttggtcctgattctgccatagcaggctaccatcaaggtccgttagggaaagcagtggaaaactgaggatgaaagatagctgaggttaaattataaatgtccacaagtggagggcggttaaatatattctgtcaatataagtcttgtttgcggtgcagtggtgcgaacatggctcactgcagcctcgaactcctgggctcaagtgatcctccttgagtagctgggaccacaggtgcacgccaccacacccagctaattttataattttttgtggagacaaggtcttggctatgttgtccaggctggtctcggcctgcacattgtttttgatgtgggaaatgcttatgatataatggtgaatgaaaaaagtcaaaatacaggctgggtgcagtggctcacacctataatcccagcaccttgggagaccgaggcaggaggatcacttgagcccaggagttcgagaccagcttgggcaacatagggagaccccatctctaacaaaaaaaaaaattttttttttttttttttttttttttttttttttggggacggattctcgtcctgttgcccaggctggagtccagtagtgcagtcttggcacactgcaacctccgcctcccgggttcaagcaattatcctgcctcagcctccccagtagctgggattgcaggcgagcgccaccacgcccagctaacttttgtatttttagtagagacagggtttcaccatgttggccaggctggtcttgaactcctgacttcatggtccaccatctcagcctcccaaagtgctgggattacaggcgtgagccaccatgcctggccaaaaaaaattttttaattagccaggcatggtggtgcacttgtagtctcagctactcaggaggctgaggtaggaggatcccttgagctcaggagtttgaggttgtagtgagctgtgatcgcaccactgtacaccaacctgggcaacagcgcgagaccccaactcaatgaaaaaaaagccaaaatataaaatttagaaataatatagaatttacaaggccgggcgcagtggctcatgcctgtaatcccagcactttgggaggccgaggtgggcggatcacgaggtcaggagttcaagaccagcctgcccaacacagtgaaaccccgtctctactaaaaataccaaaaaaattagctgtgcatggtggcgtgcacctgtagtcccagctactcatgtgggtgagggaggagaatcgcttaaacctgagaggtagaggttgtggtgagctgacatcatgccactgcacaatgcctgggtaacagtaagactttgtctcaaaaaaaaaaaaaaatagaatttacaaaatatagaatatgtaaaacgatgtcaacttttatctttgttttttaaagaaaggcagcaaacgcatttaaagagcataaaccaaaagatagaagaacccatggccttatagaagtcatttaaccacactcacccctgggcactgattctccatccagagtatgggagtggtgaaatctgcttgctaggcttggtgtgagtgctaaatgagtgagggcagggggagcccttcgtccagggcccgacacatcttcagtgtcctggtgttagtggtgatcactgtgatggaattgtgggtgactgcaccactttgtctctttctgtatttctaattttgtgcagtagacgtgtgtatagttttatgatcaggaaaaagagttgtagctctgtgttgatttttcttatctcctgccctccctctccaaaagaaaagacataaattaaactaggaactgagagggataagttagacctagcactgccaccagcccagtgctctctcagagaatcacattgccttgtgtcattctaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaatgtatatagtaacgcatctcctccaggcttgatttgggcaatggggttatgtctttcatatgactgtgtaaaacaaagacaggacttggaggggaagcacaccacccagtgtgccatgactgaggtgtctcgttcatctctcagaagcaccttggggcctcgccagggccgtggtcttcaccgaggcgtgggtgggcagccgttccccaggctgtgtggggtcctgctttcttctgctgagacagtgacgctttccagtttccaccctaatcagccactgctggtcacagccccacagccatgggtatttctgtggtctcctcgcttcattgaagcaaagcatgagccttcctagacaagggcagctggggaggggaagggaccggaagtttgtgaagttgaacagtccatccatctgcactgagaggctggatcctgagtcccggggcagcaggatcccaggaaccttcctcctccagggcagcacaggactcagccgtgtctggaccggccctgctgaggctacagtcactctggaagctctgcgcttcatcaggaggcaggactgtggcgggaggggtccttgaagatgggtgtggggagcagtgggtcaggaagtgggagccagaggtttgactcactttgctttatttttcaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgttttttttctttctgtccatttgctgcgtgtacccactctagtaggcattggctaaatgttgtattttggcgattcatcaacctttgcagaatatgggctttatagaagcaatattcttggccatcccgcctcattcctccagtgtggagatgacaagtctgggtgtgagagggaggggtccgggcatcatggttcagcgtggcactcctttggttgagtttggggcatgagatcacagtggctgcacaagagagcagtgtgtacagtaggagagacatttatgtaatatatattttattaacctgttagatgtccacaaagtattataaatcacgtgcctaaaactgtccatgtagaccaaggcctgccctcggcgccccccactcttgcctctgctctgcacagtccacgtgcactgcaggaccggagcgacacatgtcttccctgaagggtgttcagtacaaggcgtgtcagtttgtggatcagttgatccaagttactccttgtctaacctgactgacatatatttgaatactgtggttttctttcttttttttctatttgctgcccttcctggaggcagtgggttccagaagccaactgattgtccccctgccaagtcaccaagggaagctgctaagctgcttagtcccctcggtcctgcttgtagggtcttcctgattgtcaacagctgtctgggatgcttcagtctcctaaaactggaaacgcagggtgcgagcagcacacactgcctcccgccactgccagccggagtgagcggcccgagagtctctgcaggttcccctgggggctgggggccgctgaggcctaatatcaagagccaggaatgtcatgtacatggaggtgcctacggacgtgtctggtgtggtttgcaggtaggatggatgttcactgtttgaccgggtggggtatccttcctctctgcagtctccttcccagtatgcgtaaacacccttatagttctaattgtgttgatatttctgttctttctgaattgagagaaaatcccattcgttgtctgcagatttggaagtttgatgaggaatttggttcttgaaacatctgtctttttttttttttttgagacagagtatctctctgttgcccaggct

SEQ ID NO: 14736 - DNA, 84916 bp, Human
  misc_feature (1)...(84916): n = A,T,C or G
tttttgagacggggttttgctcttgttgcccaggctggagtgcagcggtgcgatctcagctcaccgcaacttctgcgtcccgtgttcaagcgattctcctgcctcagcctctcgagtagctgggattacaggcacgcaccaccacgcctggctaattttttgtatttttagtagaaacgtggtttcactatgttagccaagctggtttcgaacctctaacctcaggtgatctgccctccttggcctcccaaagtgctgggattacaggcatgagccaccgcacctggcgctttttgcctatttctttgagacctggggttttgggtcacaaaacaggcaaatgccatgagccaccctcctcctctttctccatcttcttgtgctgcctcaggtcagagcacttacctgctcctgccttctcactgggtttccttgtctctggcctatttgtctccagaggggtcaaaacacttcaaatcctcctatttgtctctgtccactgtcaggagttccagttcccagaaccccaattttgcctacaaaatagcgtgtcttttcacggggagaggatttgttgagttttagtgggtactcaaaaagatctaaagccagttgggggggttcacacatgtaatcccagcacttttgggaggccggcctgtgagggtcgtttgggcgcaggagtttgagaccagcctggacaacacagcaagaccctgtctctataaaaaataaaataaaaataattagctgggcatagttgcgcacgtctgtggttccagctactcgggacgctgaggcgggaggatcgtttgagcccaggtgcttgttgaattgagctatgagtgcactactgcaccccagcctgggcaacagagtaaggacccagtttctaagaaaagaagattcattagctagacgcggtggctcacacctgtaattccaacactttgggaggccaagacgggcggatcacttgaggccaggcgttcgagaccagcctggccaatatggtgaaaccccgtctactaaaaatacaaaattagctgggcgtggtggctcacacttgtaatcccagctattcgggaggctgaggcaggagaattggttgaaccggggaggcggaggttgcagtgagccaagatcgcgctactgcactccagcctgggtgacagagtgagtaccccgcctcaaaaaaaagaaaagaaaaaagattcatgatctgctaaagttgaagaagtgggggaaaacattggagtgttagcggcgtcaagatcgggcgtgagcagaaagggcacagcatttgcaaaggcgtggaggagtgattttattgcgttctatccctaggaagcaatgacttggcctctaccatttgcagagcgcattgggaccctgctcccagagctggtttgcagtctgggaactgagatgcgctctgggacttgtagttttccccagtgccaggaaactcaaaaatcgagacatcggatcccaccacgaggtgtcgcccttgagcgagtacggtgggatctatcctatacttcagaaggctgttgcagacatccaacaatcacaaggaagaacgggagtttttctgattgacagatatggttctcaatgatagtcaagattcggatgttaaagcccgccctcttttgcctggttggctggagcaacgaagtgatatttatatgaaccaatgggaaattcttagggaacgaggtagtagctcaatccccaacaccattggtccacattgtctactggcacgtctgcctgccaataagatggtggaacttcgccaatgggcagagccaacgtgcctttttcggaaacacccccttcctctcttgacaacttgctttctgccgctattggctgttgcacaacagtgacggttcttttgtccaataagtcagcaagacggtccccagggggaaggtttactcaaccataggcccgtgcctagtttttattggctagtgtatccgagtggcggtgcagcaggccagtcgcgtgcggcgcgagtgctttgggcgcagcccccggggccggggcgggaggtcgctcgggtcgggtgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccggtgagcgggcgcggcagggatcgcgggcgggtggcggcctagggcgcggagggcggaccgggaatggcgcgccgtgcgccgccggcgtaactgcggcgcttgcgtgcccgcggcggggaaccggacggggtcggggaggcgggccctgtgggacgccctgggcagaggactccctgcaggggctccggagcaggcccgggccccaggggcggtgtcacgggccagggcgccgtaggacaggaggtgcgctggaaccctgcggtccatctggtcccagctttcgtgggtgaagtctgccatctggttggccgtgggtctggggtagatccctcttctgctctttcgggctgtccatcagaggtgaaaccggccatctagatatctattggggcgaccgctgcggtctggctggcttgttcttgtatctggagctgcccccgccgtctggttggctgtctctctgtcctgggcaagcctccctgccaccaccatttggttgtccatctgtccagtcccacctggcagccccctgctgtctggctagctgtccagggtgacctctgctgtctggccgcccatccgtgcccctcacagactttaacactgagcagtccctctgttgggtgacaccagctggcctctactgtctgactggctagctgactcctaggggaccctgtttgattctctctggctgactcttacagcttgattcctggctagcgctggctcctctcttccgtgtgaattcttctgtctgtctggccatctcctagtctgcccatgactacccctgagtgtctggcacaacggctctggaaaggggtggtaggagggtagaggggagaacagagctgaaggaggaggtttggaccctacttcccctctcagctggaaggaggactctgggggtaccttacttcaggattcctttccgagtgctagaacacaggggcccgcctcccagctacagcctacaaattgggggccctcctttggagcctgggaaggggcttcttgcgtgatcaggcctcagtggctagcgctgggatgtagccttctctggacagccttgagaagccgcggtgtgcccatctgtccagtgggcaaactccactctctggggctgtttccaggattcaggaagcaaatgaatgagaacagcccgtgcagccacctctccctcccaccaacccctctttcctttcttgtctcccagatgggcggccacttctccattccaggaactactcatttgtggtggtgtggctgccaaatgataacatcctcctcctgtcattattgtcattgttattgttgttatcattgtcaagggataatgtcccttcttgattcaacatcttgaatcccaagtaaggagtggggtggaggctgtgttatcatccccaccttagctgagctgggaggctcagaagggactgtgatcacccaaggccactaggctggcgtaaggccttgtgtctgccatcccagagccttggggctttgctccaagcagcacaaatctcctcttttgctaccttgtctctagctcattgccttctgtctaccgtggtggaaaggtgtggacttgcagccagctgggcctggcctgatctcaggctggactgtggtgtgggcccctttgagtgaccatcttcctgcctgcccaggcttctgggacgggggtggggggtgtttgcaaagctctgtctctttcacttgccttgtgaccttgcacaggttgtcttggcctctctaagtcttggttgactctcctaaacaagtttattttattttatttatttatttattttttttttttttgagacagagtctccctctgtcatccagtctggagtgcagtggagcaatcttggctcactgcaacctctgcctcccaggttcaggccattcttctgcctcagcctcccgagtagctgggattacaggcgtctaccaccaagcccaactaatttttgtatttttagtagagacggggtttcaccatgttggccaggctggtctcaaactacttacctcaagtgatcctcatgccttggcctcccagagtgctgggattacaggtgtgagccaccaagcctcgccccaggagttccaagaccagcctgggtaacatgacaagatgccattctacaaaaaataaaaaaattagccaggtagggtggtagtcccacacctgtagtcccagcaactcaggaggctggccctgggaggactgcttgagcccaggatgtccagactgcagtgagccgtgattgcaccattaccctccagcctgggtgacagaaccagatccggtttcaaaaaaagaaaagaaaaagtgcttacttacctaacgcactgcctggcacatagtaggtctacatggatggggctattgttgtttatctggctggttcctttgctatcagggacaaaagctaaccagaatgaaagtgctttcacgttacacacttaagccttatgagggaggcattgctataatccccattttacagagcaggaaactgaggctcagatagctgagcagaacactctcactggaggctgtaaagtgaggagttaggtgttctgggttgggaacctgggtctctctcccatccttacctctcctcagtccctctaccccttgcctttctctcctgtctaccatggtgtctggcagctgccggccagtatggagctggttcctgtggcgacctcctagaatcctgcaatgcaggagttgctcattatatatatatttttacaccgagtctcactctgttccccaggctggagtgcagtggtgttatctcagcttactgcaacctccacctcccatgttcaagcgattctcatacctcagcctcccgagtagctgggattacaggcgcgcgttaccacacccggctaatttttgtatttttagcagagatggggtttcaccatgttggccaggctggtcttgaactcctgacctcaggtgatccgcccacctcggccacccaaaatgctggcattaaaggtgtgaaccaccatggctggcctcgttaagagtattaattcagtacctgaaagccaaagttgtaaaaaggcctctctttgggtatgaggggctcaaacaaggcttacttttttttgggggggtgtaagagataaggtctctctttgttgccgaggttggagtggaggggtgcagtcctagctcattgcagcctcgaactccagggctcaagcaatcctcctgcctctgcctctaaaagcactaggattacaggtgtgagccattgcgccgagcctggattttctaaggatgtggtccgagtgggaacagcccagttagttcagccctatagctggaagtccagatcactggctctgggggccaaggcctgcctgctgggtcttttgttttacctgcgtagcttttgtttttaataagactttccagtgttagatttccagtcaatatccggatttcttgtggctctaagacactcagatctatagagttctgagttgtcatgcaaaggctgtgggcctaaggcctggttccaccatgtctggctgtgcgactcggccacgtggatttggcgttctgggcctcagattccttttctgtaagctgagggtggtaactggtaccctggggcctagatgggtgattgggtgatgcgtgccgagtgcatgtgtcttatacgcatggtggctgttgttgtaatcagtttcacctggcgttgctgagcctttgtcccttgtggcagtaatggcttcgatttcagaagcaccagtcactgtcccatcagactaagagtggccactccagctgccacagtccccactactccctagcactcacccaggcctagatcattttgcttggagcctcctggccctggaacctttgagtttgagacccctggcttgtctgcggtgcaccagcagatagaactttggccctaaggagaaaggagggcatcactccctcttgacccttgtcatttagcctcaggggctggccagaaggaaggccttaggcattcccgcaccctagcctcccgagtagctgggactgcaggcacccgccaccacgcctggctaatttttgtatttttagtagagacgaggtttcaccatgttagccaggatggtctcaatcttctgaccttgtgatccgtccacctcggcctcccaaagtgctgggattacaggcgtgagccaccgcgcctggcctgagatagggtcttatactgtcacccaggctagagtgcagtggcaccatctctgctcactgcagccttgacctcctgggctcaagcgattctcctacctctcagcctcctaagtagctgggactacaggcacgtgccaccacgcttggctaatttttcattttttgtagatacagggccttgctgtgttgcccaggctggtctcgacctcctcgcctcaaatgatcctcctgcatcagtctcccaacgtgctggcattacaggtgtgagccactgcgcccagcctcctcttcattaaaatacaagttataatagcacttctttccctttcttttttttttttgagacggagtctggctctgttgcccaggctggagtgcagtggtgcgatctcggctcactgcaatctcgcctcctgagttcaagtgattctcctgtctcagcctcccgagtagctgggactacagttgcgagccaccacacctggctaatttttttttttttttttttgagacggagtttcattcttgttgcccaggctggagtgcaatggcacgatcttggctcaccgcaacctcccctcctggtttcaagccattctcctgcctcagcctcctgagtagctgggattacaggcatgcaccaccacgcctggctaattttgtatttttagtagaggcggggttttcccgtgttggtcaggctggtctcgaactcccgacctcaggtgatctgccggccatggcctcccaaagtgctgggattacaggcgtgagccaccgtgcccggctaatttttctatttttaatagagatggggtttcgccatgttggccaggctggttccaaactcctgacctcaagtgatcttcctgccttggcctcccaaggtgctgggattgcaggtgtaagccaccgcgcccagccccgtcttctttaaaataggagttataatagcacttctttccctttcttgaatagggattaagtgagacagtttggagtgcttggcatagaagaagtgcttaaaacattaggtgttgttcgttcattaaaaaatgtttcctgagtacttttactgtgtgcctggggacatggccctgagcaagttaccagaacttctgctctggaggagctggcctttcagcaggaagcaaataaaggagaagcatgggccacttagtggctcaggcccacaatctcagctctttgggatccaggcgggaggatcacttgagcccagaagttggagaccagcctgggcaacatagaccccgtctctacaaaaaataaaaacattagctgggcatggtgacacctgtagtcccagctactcaggaggctgaggccggaggatggcttgagcctgggatttcaaggctgcagtgagctctgatcacgctactgccttccagcctgggcggaagaacgagacctcgtctcaaaaaaaaaaaaaaaggcgataagtatgatggaaaaaaggatcaaggagcaggatgagggagagatcacagttggagggggtacattttattttattatattattattctttgagacggagtctcactctgtcttccaggctggagtgcagtcacgcgatctcggctcactgcaacctccgcctcccaggttcacgccattctcttgcctcagcctcccgagtagctgggattacaggcgcctgccaccaggcccggctaattttttgtatttttagtagagatggagtttcaccatgttagccaggatggtctcgatctcctgacttcgtgatccgcccgcctcggcctcccaaagtgctgggataacaggcgtgagccactgcgcctggccagagggggtacattttaaatagggaaattggtgacatttgagcagagccttgaaggaggcgaggaaggaacccctggagacgggaagagaatccagtgcaaaggtcctgatgtgggaggatgcccggaggccagtttagcaggccagtggagggagatcagatctgggagatattagggtgggaccaggcctctaggaacattgtgggcagggaggctgtctgagcagagggaagtaaagctggtggcgctactgctgtccctctggacctggccaagctgagggctctctcctttgatttccagcttcaactcagttttctcagtaagcagactccacaggcatgtaggcgccccgtgccatttttcttttaataagaagcagctgtgccggggatgctggcgtttccagctgcgtttttatttggcctttggtgatgtgtccctccagggatatgtggatgagccgcgggggcactgcctgtgcctcagtgggtgctgcaccagtgcacatcggatgcccgttggctcctgtccctgacagatggaggggcacgtgatgtgttccttgggctggtttgtccctttaacagatcttattagtttagagccacttggaaatgacatcttctgtttccagtgactttccttttgggcaaagacaaattgcatcttgaaaaggccatacatggccgggcatggtgactcacacctgtaatcccagcattttgggaggccgaggcaggcagatcacaaggttgggagtttgagaccagcctggccaacatagtgaatcccgatctctactaaaaatacaaaaattagccaggtgtggtggcgcatgcctttagtcccagctatttgggaggctgaggcaggagaatcacttgaacccaggaggaggaacttgcagtaagcggagatcacgccattgcactccagcctgggggacagagtgagactccatctcaaaaaaaaaaaaaaaaggaaaaaaggaaaggccatgcaaggctcggttagggtggtctgcagtgctgggcctgctggaattggtacagtccagagggatctgtgggaatatggaaggcttggttctgccacacaccaaaaaagtgacctcacttctctgggcctcagtttcctcatctggaaaatgggaacatggtggtctctgcctactgggagtggactgagaatcacgtagcaaattgttgtgaaacaggcagcatttgtgatctcgttggttggcttttgtctccttttatctgggatcaggactctgatgacaggtgtacgtttcttttctcttgctctgtcccccagactggagtacagtggcgtaatcatggctcactgcagcctccaactcctgggttcaggtggtcctctcacctgagtctcctgagtagctgggactataggcatgagccaccacacctggctaattacaaaaaaatttttttggcagggagcgatggctcacacttgtattcccagcacttggggaggccgaggcgggcggatcacggggtcaagagattgagaccatcctggccaacatggtgaaaccctgtctctactaaaaatccaaaaattaggtgggtgtggtggctctcacctgtagtcccagctgctcgggaggctgaggcaggagaatcgcttgaacctgggaggcggaggttgcagtgagccgagatcgtgccactgcactccagcctgggcgacagagcgagactctgcctcaaaaaaaaaaaattttttttttttagagacagggtcttactttgttgctcagtttggtgtcaaactcctgggcccaagcgatcctcctgccttggcttcccaaagtggtggaattacaggtgtgagccgccgaacccggccttagtttctttttccttaaagagaaggaactcatcattactctgttgatataaatggagtgcctatcagtgcaggcaatgttcttgctctggggatacagccaggaccaggacatgcaggcacgccctgttccccagatcctgaaatatcgaccagaagttgttcctggttcctttctaagtgggaatcatggctgcaaacaagtaattggccgtgagagttatttacacacattttgtgtacggtgatgagaaatgggagaaaaaatgcccagcatcggatcaccagaggtcaggagttcgagaccagcctggccaacatggtgaaccctcatctctactaaaaatacaaaaattagccgggcgtggtggcaggcgcctgtaatcccagctattcgggaggctgaggcggagaatcgcttgaacctgggggacggaggttgcggtaagccgagattgcgccgctgcactccagcctgggcaacagagcgagactctgtctcaaaacaaacaaacaaacaaaaaccaatgataggggatttggccagataagcgtgtccagacaaccgactatcaactcgctactcagagggatctagaagaatctttaatgacccagaaagctgcacaagacctgttaggtaccagatgaaatgggctgtgggatcctgtcttgtttaaaacgattgtatttgctcagtgaaaagaccggaaagacatactctgccctaaccccacatgtgaatcgtctccccatgtgattcttggtttgtttttgctggtttggggattaggtttataatcaggaagacagatttctccaaagctgcgctctaggctgtccaagtgctttttcagagttacttattgacggataacagcccttgataggttcataacattgaaatcccctggtaataacctggattgtttctggatgagggcggaagatggccttggggacagttgtagatttagagaggaggttttcttttcttttctttttctttttttgtttttttttgagacgggatctcactctgttgcctaggctgaaatgcagtggcgtgatcacagctcacagcaacctcaacttcctgggctcaagggatcttcccacttcagcctcccaattagctgggaccacaggtgtgcgccaccacccccagctaattttaagaaattttttgtagaggtggggtctcattattttttgcccaggctagtctcaaacccctgggctcaagtgattctcctgcctcggcttcccaaagtgctgggattacaggcaagagccacggcacccggcctaggttagatttagagttttcagagttggcttaggcggtagaggctggcctttgaatggaaccctgtctcgctgtcgctctcagcgtttatatttggctcagagccacatctgccaaacttctgcccgatttgaatgaaagtgctgaaattataggcccctcggctgctgaaaaaaagtgagaacatcatgtaaaccgtaatttactgggattgccaactacaagctgtaattaagcccttattgtgttaaagctttggaaaaatccaagccaataatgagatatttatagggcattagctacaatctgaataaagggaaaatgtggccctgcgtctgaagcaggactgcaaagagaggaaagacgcctgcttccgggtgcgttttgggtttctgtgaatattggtaactaggtccctgctgggtggtgggaaattttcccctgtggcgtcacccgtagcttgaaccgggagctggatgactgtttcagtttcatctgctgctggacatttatgatgttaagagccagtgtttatggagaatcaccgtgtgccacatgtgcaagatctgaccagtgtcttctctgcccaggggtggcagctgctgctcttagcatccctgctttataggtagagaaactgaggccagagagggagactggcctgaagtcacacagggaggaggacagaggagttggagcttgaactggatgtgggccctctagagccacacatatggcggctttgggtgggaaggtgtgggcctgactcttgagagcagggctgaatggtgggcaccatggcgtttgtatctgaggactgggccaagattacagagggagtgagcaacgcgtggctttggatatgcatcgaggttgtcagctctgtgtccagcctgcgtgtggtaagcagcaaccactctacaccagttgctgggcacccagcagggactgggacagacaggacaggtgaacagttaaatgagcaagaacattctggggcaggcacaggggctcacacctgtaatcccagcactttgagaggccaaggcgggcagatcacttgaagccaggtgttcgagaccagcctggccagcatggcgagccccatctctaccaaaaatacaaaaattagctgagcatggtggtacttgtctgtcgtcccagctacttagcaggctaaggtgggaggatctcctgagcccaggaattcgaggttgcattgagctatgattgcaccactgcgctccagcctgggtgacagcaagacccggtctcaaaaaaaaaaaaaggctgtatgcggtggttcacgcctgtaatcccaacactttgggaggctgaggtgggagttcgagaccagcctggccaacatggcgaaaccccatctctactaaaaatataggcaggagaatggcgtgaacccgggaggcggagcttgcagtgagccgagatcgcgccactgcactccagcctgggcgacagagcgagactccgtctcaaaaaaaaaaaaaaaaaaaaaaaaaaatataaaaaattagccaagcatggtggcgggcacctgtaatcccagctactcgggaggctgaggcaggagaattacttgaaggttgcagtgatccgaggtggaggttgcagtaatccgagatcatgccacggccctccagcctgggcaacaagagcgaaactctatctcaaaaaaaacaaaaataaaaatattctgaagagtgagaagcggtttgccctgtactgcattgggtgggggaatggctgcagggggctgcttcacatgtggcttgttgggatgggtgtcctgcagtggaatagccccgccaggacttgggggaacagcatcgcaggccagggaaacagcaggtgcagaggcctcgcacacacccggcccgctgagtgccccctgcggaccggaaaggaccagtaggcacgtgagagttaggacgctgcccgtggaatgccgacttttctaaatttgaattacgcaagtagagcgtggagacagtgttcttggaaaaagggaaaccattacagatgaggaagagcacactgcccagcccgtcccttcctccagctctacctgggagcaccactgtcacttcagggtatgtctagccagacccctctggtgtttctgtacttaggtacatgctggtacctatagagaatacgtggcaccattatgggtggttattttttttttttttggaacaggtctcactctgtcacccaggctggagtgcagtggcacagtcatggctcgctgcagccttgacatcctgtgctcaagccatcctcctacctcagcctcctgagtacctgggacaacaaccacatgccaccacgcccaactaatgtttataatcttttgtacagatggggtttctctatgttgccaaggctggtctcaaactcctgggctcatgcgatcctttcacgttggccccccaaagtactgggattgtagacatgagccacctctcccagccacgtgcatatatttgttgaatgaaagtagctaaaggctggaagtggtgactcacgcctgtaatcccagcactatgggaggccgaggcaacatggcttgagctcaggagtttgagaccagcctgggcaacatggtgagacctcgtctctaccaaaaatacaaaaattagcaggcgtggtggtgcatgcctgtactcttagctacttggaatcccgaggtgcgaggatcccttgagctagggtagcggtggaacttgcagtgagcccacactgtgccattgcactgcagcgtgggtgacagagcgagaccctgtctcaaaaaaaaaaaagtagctaaaaaccagaatggagtgaatttcactgcacagtcatggaggggaccaggcagaggacagccctgggtcttggttttggagactcacagcctgcctggggatgcagggaccctgaagcaaggacatcttcctttggaggaagtggagatttgctccatctatataaagagtaataacagtaataggctgagaccctgaggctgggcagcgtgggtgtctatctgcgttggcttcgagggctgtaagatggggctagcagcgtcccctccagggtgggagtgaggccctgtatggcaacctgcggggtgccccctctgacttttgcttcctgcctggctgctcagtggccctggcaggggcaggcaccactgctctttctgttacaagagacctcctttggataaatctgaacacgctcccatggcagacctatggggcggtagacaagaggccagcagagctgtcccaggccctggtgacacctccatgcccaggtgaaggaggagcaggctacttggagcctgccctgtgacacactttcgcggtgatgagagcttctcagggctgcgatcctggcgggccagtcaagcgggcaggagcagccccagccagggtgaccctgcctgctgggtgatacgccctggcacgaccaggccagccctggggaaagcccccagggcggatcagggagggacacagctgtcctggccatgagacttctgtcttttgtatggatacacagggtccttctagagggtcacagcctccacccccgggaggcctaccagctggccgcgcagccaggatcctgcagccaccaggacactgcctttccaggttgttcttttcttttccttctttttttttttttttttgaggcagagtctcacagtgtcgcccgggctggagtgcaatgcatgatctcagctcactgcaacctccacctcctgggttcaagtgattctcctgcctcagcctcctgagtagctgggattacaggtgtgcaccaccacgcctggctaattttttgtatttttagtagagatggggttttgccatgttggccaggctggtctcgaactcctggcctcaggtgatccacccgcctcggcctcccaaggctctgggattacaggcgtgagccgccgtgcccggcccccaggttgttcttttctacatcaacatcaggggacagtgactgagagaggccacgagccactggctcagcttgacgaaggcttcctgtggtttgggttgatgtatctctctgtcttgcaacactgagttccccgttgtctgggcggaagccagtcagacggaagcccggcttctgtggtgcctgccctggtggcctggacaggttgctgggaagctcaggtcaggctgctttctgaggtggggaggccccacctggaatgtgctcccagcactgggtgaaaattgatgcacaggcttgattttttttttttttttttgagacggagtttcgctgttgttgcccaggctggagtgcaatggtgcaatctcggctcgctgcaacctccgcctcccaggttcaagcgattcttctgcctcagcctcccgagtagctgtgattacaggcgtgcaccatcacacccggctaattttttgtatttttagtagagactgggtttcaccatggccagactggtcttgaactcctgacctcaggttatccgcctgcttcagcctcccagagtgctgggattacaggcatgagccaccgcgcccttaaactcttttctgttaaaggagttattcaactgtttactcgttgtggagaaaaaaaaaaaaaaaaaaacaggccgggcggtggctcatgcctgtaatcccagcactttgggaggccgaggcgggcggatcacgaggtcaggagattgagaccatcctgactaacacggtgaaaccccacctctactaaaaatacaaagaattagctgggcgtggtggcgagcgcctgtagtcccagctactcgggaggctgaggcaagagaatggtgtgaacccaggaggcggagcttgcagtgagccgagatcgcgccactgcactcccgcctgggtgatagagcgagactccgtctcaaaaaaaaaggaaaaacaattcaccctgtccggaagtgcacagagtaaggctgggtgtcctttgcatgggaacgacctctagcagtctgtggctcttgccagattttttatatatatatatatatttctaggtgtgactacccccgactcatccaaccagtgagcctataagtctagtaacaaacgctcccgctccacagtccaaagtctcaacagaatgtgactgtcttgcaccaggtccctgctatatttagtgcctccaagaatgtttggcttttgttttctgttttttttttcttttgagacaaagtctcgctcttgttccccaggctggagtgcaatggcgcgatctcggctcactgcaagctccgcctcccaggttcaagcgattctcctgcctcagcctcccgagtagctgggattacagacacctgtcaccatgcccagctaatttttgtagttttagtagagatggggtttcaccatgttggccaggctagtcttgaactcccgacctcaggtgatccaccctcctcggcctcccaaagtgctgggattaccagtgtgagccaccgcgcctgggctggtgtggtttttttttttttttttggagacagggtcccactctttcacccaggttggagtgcagtggcatgatgtcggcttactgcaacctccccctctcgggctcaaaccattctcccaccacagcctcccaactagctgggaccacaggcgcgcaccacaatggccggcattttttttttattttcggtagagacagggtttctccatgttgcccaggctggtcttgaactcctgagctcaggtaatctgcctgcctcagcctcccaaagtgctgggattgtaagcatgagccacaacgccctgcctagaaataattttagatttagagaaaataaataagcttcaaatttacagaaagtacaaagataacacagagagctcctgtacatccttcaccagtgtcctctaattttatatttcttacaaccaagaaattaacctagctactcaggaggctgaggcgggaggattgcttgagtctaggagttaaagcccagctttggcaacataacctcttctctaaaaataaatgaatgaggccggacatggtggctcacgcctgtaatcccagcactttgggaggcagaggcaggtggatcacctgaggtcaggagttcaagaccagcctggccaacatagcgaaaccccatctctactaaaaatacaaaaaattagccaggtgtggggacatgtgcctgtagtcccagctatttgggaggctgaggcaggagaattgcttaaacctgggaagcggaggctgcagtgagccgagatcgcgccactgtacttcagcctggacaacaaaaggagactccatctcaaaaaataaaaaaaaaaaaatgaatgaatgaaattaaccttggtatactactattaagtgaggcctggcgggatgttgtggctcacactgtaatctcagcactttgggaggccaaggtgggtggatcacttgaggccaggagtttgagaccagcctagacaacatatcaaaaccctgtctctacaaaaaattgagtgtggtggtatacacctgtagtcccagccactcgggaggctgaggtaggagaattgcttgaacctgagaggccaaggttgccatgagctgagatcaagccactgcactccagcttgggcaacagagggggactctgtctcaaaaaaaaaaaaaaaaggaagggaggccaggtacagtggctcacacctgtaatcccagcactttgggaggctagattgcttgagcccaggagttttagaccagcctgggcaatatagtgagacctcgtgtgtagaaaaaaaaaaaaattagcttggcctggtggtgctcacctggagtcccagctcctctggaggctgagacaggaggatcacttgagccctggaggttgaggctgcagtgagtgatgattgcaccattgcacaccagcccgggcaacagagccagaccctgtctcaaaaaaaaaaaaaaaaaaaaaagccaaagccagaatgtacagatttcttcaatttttcccatatgagactaatttaaaaaaaaattttttttttttatcgagatgggggtcttgctgtctggaagtatacatactgagaaattttatttttcaaacaaaatcaccccttttcctgtcttaggactggacattgcatctagttgtcggatctccttaagcctttttctggtctgggaagcaactcagcccttccttgttttttataaccttggtaagtcatggaatgtccctcaattagggcttatctggaattcttcatggtgagcctggggtgtgagttttggggaagaaggccattggtgaggtgcccctctcttctgtgaatctttttttgtttgtttgttttttgtttttgtttttttgagatggagtcttgctctgtcgcccaggctggagtgcagcggcgcgatctcagctcactgcaagctctgcctcctgggttcacgccattctcctgcctcagcctcccgagtagctgggattacaggctgccaccatgcccggctaatttttgtatttttttttagacggggtttcaccgtgttagccaggatggtctcgatctcctgacctcatgatctgcccgcctctgcctcccagagtgctgggattacaggcgtaagccacctcgtccagccatcttctgtgaatcttatcaggagtataggataccaacaagactgataaattattgacagtgataactgatgatgctgaccttgatctcttggctgaggtaggcttgctaggtttccccactggaaagttactagttttcttcttttcatactctatcctttgggatcatggaaaattttatttttattttatttttggagagtctcgctctgtcatctaggctggagtgcaatggtgtgatattggctcactgcgacctccgcctcccggattcaagcgattctcctgcctcagccgcttgagcagctgagactacaggcgcccaccaccacgcccggctaatttttttttttcaagagatggggtctcgctgtgttgctcaggctagtctcaaactcctagactcatgtaataatcctcttgcctctggctcccaaagtgctgggattacaggcattaaccactgtgcccggccttttctggcactattgaaaagaccatcctttctccctaaagttgcttttgtctggaattagttggccatatttgtgtgggtccaacctgaactgtctgttctgtgacgttgatgtatggctctgtcctttctccaaaaccacatatctttcttctctttttagatagagatgggggctgggcacagtggctgacgcctgtaatcctaacactttggaggcaggtggatcacttgaggtcaggagtttgaaactggcctggccaacatggtgaaactccgtctctactaaaaatacaaaaaaattagctgggcgtggtggtgggtgcctgtaatcccagctaattgggagactgaggcaggagaatcacttgaacacgggaggtggaggttgcagtgagccaagatcgcgctattgcactccagcctgggcaacagagtgagactctgtctcaaaaaaaaaaaaaaagaaaaaaagaaaaaaatagagatggggtctcacaatgttgcctaggctggtttcaaactactgggctggtgatgctcctgcctcagccttccacagtgctggcattatgggcgtgagccaccacgcccactcatttctatattgctgtagctttatagtaagacttgaaatcaggccatgtgagtcctcttttttcttgtttctcaaaattgttttgtctagtctagttcctttgcctccacatatatattttagaatcagcttgttgatttcatagaaaagatcattgtgtattagtacgtggaaagccacggtattagttttttgtttgtttgtttgtttgtttagacaaagtctctctctggcacccaggctggtgtgccaatagtgttgggattacaggcgtgaaccactgtgcccagctggtactggtttttataactgtgtattattccatccactgtcactacttccccaggaccagtacagtttctgcctcctcagtcttgcacctttaaccttgtcctcacccccaggctgttctccctgcagtggacagagggagcctgttaagaatatccttcctagctgggcgccgtggcttacgctgtaatcccagcactttgggaggccgaggtggaaggatctcttgagcccaggagtacgagaccagcctgggcaacataacgagacccccatctctacaaaacatttaaaaattagccaggcatggcagcgcatacttacagtcccagctactcaggaggctgaggtgggaggattgcttgaacccaggaatttgaggctgaagtgagctgtgatcctgtcagtgcactccagccggggagacagagggagaccctatatccttcctctacttggaatcctccctggccctcagttccctcagggtaaaaatgaagtcgtccctgaggctccatgatgttctcatgcaggtgaggcgctgtcctacctcatggctttttcacatgctgcttccactgcctgcactgcccttcccccagataaccctgtggctcatttcatcagcattctaaggcctctgcttaaaagcctccttctcaaaaggctctccccctggccactctgctcaaacgccccaccctgttctctctgtccccttcccctgcttaatttttcttggaaccacttgtcattcctgtcattgttccacctatgcgtttggtttcttgttttctttttttggggtggagtcttgctctgactcccaggctggagtggagtggcgatcttggctcactgcaacctctgcttcccgggttcaagcgattctcctgcctcagcctcccaagtagctgggattacaggcgcacgtcaacatgcccgtatatttttgtatttttagtagagacgaggtttcactatgttggccaggctgatctcgaactgctgacttcaggtgatctgccagccttggcctcccaaagtgctgtgattacaggcatgagccaccgcacccggcctatttgtttgatttctctttctgtctccccccactagaaggggaatgccccatggtagggcggtgcccctggctgtagcgcagtcccttgcatggtgcctggcatgcgataggtaatcggggcacccatctccctctcgggatgcactcattgatgtacttgtcaatcactgagcaagacccactcagcaatgtctgctgagcctgctctgtgccaggctctgacctgaactgccacccttctggagtcaaacaggcctggttgccaccaagaggagttaggcctggcagaggagacaagcattagtctcacaacagaaggaagtaggccggacgtggtggctcatgcttgtaatcccagcactttggaaggccgaggtgggcagatcatctgaggctgggaggtggaggttgcagtgagccaagatcacgccgctgtactccagcttgggtgaaagagcgagactccatctcaaaaaataaataaataaataaataaataaaaaggaagtggagactttcattgagatcagtatcaaagggcacgaggtggcagggcatggtggctcacgcccatagacccagcactttgggaggctgaggtgggaggattgcttgagcccaggagtttgataccagcctgggcaatatagtgagacctcatgtcaacaaaaacagacaaaacaaaaaaaacaggggagggagggctacaggagggtgggatgaggactggccacagttggaggccaggcccttcctggggatcccagcggttgttactctttaagaaggacctggcctggtgtggtggctcacgcctgtgatcccagcactttgggaggctgaggcgggtggatcacttgaggtcaggagttgaagaccatcctggccaacatggcaaaaccccatctctatgaaaaatacaaaaaaaagttagttagctgggcgtggtggtgggtgcctgtaatcccagctacttgggaggctaaggcaggagaagtgcctgaacccaggaggcagaggttgctgtgagctgagatcgcaccgttgcactccagcctgggcaacaagagcaaaactccatcgcaaaaaaaaaaaaaaaaggctgggctcagtgactcacgcctgtaatcccagcactttgggaggccgaggtgggcggatcacgaggtcaggagattgagaccatcctggctaacacggtgaaaccccgtctctactaaaaatacaaaagattagcggggcgtggtagcgggcgcctgtactgtagtcccagctactcaggaggctgaggcaggagaatggcttgaatcctggaggaggagcttgcagtgagccgagatcacgccactgcactccagcctgggcgacagagcgagactccgtctcaaaaataaataaataaataaaagaaggacgtgttcccttgttcttctatggggacatggggaactcctgtactgttttattttcctgaaatatttttattgaaatataattcacataccataatacctaatccttttgaaatatactattcagtggattttagtatattcacagttgtgtaaccagcaccactatctgattttgtagcactttcatttcccctaaacccatacatatgaagcagttcctccctcccccagcacctggaagccactaatgtcctttctgtctgtgaatttgccaattttggatatttcctataaatggaatcttacagtatatggccttttgtgtgtggctttgtttatttagcatcatgttttcaagattcatccatgctggttgggtgcagtggcgcacgcctgtaatcccagcatttgggaggctgaggcgggcagatcacttgagggcaggaattgatgagaccagcctgcccaacatggtgaaaccccttctctactaaaaatacaaaaattagctgggtgtagtggcacatgcctgtaattccagctactctgggtggctgaggcacgagaatctcttgaacctggggggcaaggttgcagtgagccgagatcactccactgcactctagcctgggcaacagagcaagactctctctctctctcaaaaaaaaaaaaaaaaaaaaaaaaaagaattcaccaatgaagccacctgggcctggacttttctttgtgggacgttttttgaatactaattaaatttcttgtacatctattgagtttttctgtgtcttcttgagtcagtttcagtaatttgggtctttctaggaatttgtccatttcatctagggtgtatttaatttgttagaatagtattcccttatcatcttttttatttctgaaaggttggtagtgatgtctcctctttatttctgatttttgtaatttgagtcttatctctttttctcttggttaatctagctaaaggtttgtcagtttggttgatctattcaaagagcaaattgtggtggtgttaacttctctctccatttttttagtctctttatttcttctctaattatttccttcttttctctttggatttggtttaccctccttttctgaggttcttgaagtggaagattattgaaatctgaaagtatttgaaatctttctcttttttttgttttttttttttgagacggagtctcgctctgtcgcccaggctggagtgcagtggcacgatcttggctcactgcaagctccgcctcccaggttcacgccatcctcgtgcctcagcctcctgagtagctgggactacaggcacccaccaccatgcctggctaatttttgtatttttggtggagacggggtttcaccatgttggtgaggctggtctcaaactcctgacctcaggtgatccacccacctcggcctcttaaaagtgtggggattacaggcgtaagccaccgcgcccggccaaaatcttccttctttttaaatacagttgcttacatctatgaatttccctgtaaacctgctttagctgcatccataagttttgatatgttgtgttttcattttcatttatctcagcatatcttctcatttctcttatgatttcttctttgatacataggttatttagcagtatgttcatttctatatatttgagaatttctgaaaaacatctttcttgtgttcatttctaacttcatttcactgtggttggaggaactactttgtatgatttcaatctctttaaaattattgagtcatgttttatggcttggcctcgaatacggtgtgtcctggagaatgttccatatgcacatgataagaatgtgtattttactcttgggtggagtgttctgtacacatctgtcaggtcttattggtttcgtattttctatttccttgttatcttttatttggttgttccatccattattattatttttcttgcctgataccaatgctgatatccatccatgattgaaagtggggtattgaagtctccaactttctttctttcttttttcttttctttttggagacacggtcttgctctgtctcccaggctggaaacgtggtggcatgatcatagctcactgtagcttctgtctcctgggctcacatgatcctcccacctctgcctcccgagtagctgggaccacaggcgtgtgccacacccgactaatttttgtattttttctagaggtagggtcttgctatattgaccaggctggccttgaactcttgggctcaagtgatcctctcatcttggcctcccaaagtgctgagattacaggcatgagccactgtgctcagccccaaattggccaatatttctttcttttttttttttttttgagacagagtcttgctctgtcgcccaggctggagtgcagtggcgcgatcttggctcactgcaagctccgcctcccgggttcacgccattctcctgcctcagcctcccaagtagctgggagtacaggtgtccgccaccatgcccggctaattttttttgtatttttagtagagacggggtttcaccgtgttagccaggatggtctctatctcctgaccttgtgatccacccgcctctgcctcccaaagtgctgggattacaggcgtgagccaccacgcctggccaatatttcttttgttctgtgctttttccttcctccctcccttcctctttaccttcctctttaccttcctctttccctccctcccttctttccttccttccttcctttttgttcttgttcttttctttttcctctacccttctttcttttccttctttctttttttctttctttgtttttgcttgattgcagcatcatgagagagtcctgtgcttttttatagctgcaagtattcctgggtcgagcctactcccactaacactgatcactctcccccttgaatttttaggttatttctagtttttcccctcctgccagagacttgggggtccgcaggcttgtgtgtctgctatgctcagggtggataccctgcaagggagtgccatgttgcatcagaagtggatttagagtgatgttgccaggcccaccaggaaaggctgtgccaaggctctttgctggggtgccaagaagaagggtctgtgcctgttgtggtgccaggcattgacatccttcactcccacccccgtcaccctcatgaactagtgaactagtcctgtggaatagggccttatgcgtgctagaccctgggtttgtcctgctgacaaccccatagtgtaggtgctgttatcccaatttcatagagaaactgagggctggggaagtggcagccttcattcagttcctgccgtgaggctgtggctgagctgccaggctgcagagtcttcacccaatgatcttgctcagttgtccccatgaggaagctgagcctggccttcctgtctctggagtccaaggtttcctttccttgtgtgcccctggaagtgctgtgtggtgaccgggatggtgcctggcagatggagattagacgcaggttggattggtgcctcattggtcaggagggctgctcttagctgtgtgccaatagaccggatgacttaatctctctatccttggtttccccatctgcaaaacagggttggccagagccctgtgaaggtggaagaaggccctgtgtgcctggagctttgtgcagtgccctggagatgctagcttgtttttctttcttttttttttttttttttgagacagagtctccctctgtcatgcaggttgtggtgcagtggctcagtctccgctgactgcagcctcaacctcctgggctcaagtgatcctcccacctcagcctctcaagtagctgggaccacaggcgtgtgccaccacgcccggctaattttttgtagaggcgaggtttcatcatgttgcccaggctggtcttgaactcctgagctcaggtgttccgcctgccatggcctcccaaaatactaggattacaggtgtgagccaccacgcccggccgtgatgccagcttcttttgccgtgcagctagcatttgctgaacacctgctgtgtgccagatagtgtgctggaggcagggcagtgaacaagacagacgagatccctgtcctgtggagctgatgctctagctgggggcctgaggggtgggaaggaagcacaggtgctcgggtgagaaaaaacatcatgcggccaggcatggtggctcacacctgtaatcccagatctttgggaggctgaggcaggcggatcatctgaggtcatgagttcgagaccagccttgcaaaaccccgtctctactaaaaatacaaaaattagccaggtgtggctgggtgtggtggctcacacctgtaatcccagcactttgggaggcggaggcaggtggatcacaaggtcaggagatcgagaccatcctggctaatatggtaaaactccgtctctactaaaaatacaaaaaattagccgggtgtggtggcgggtgcttgtagtcccagctactcaggaggctgaggcaggaggatggcatgaacccgggaggcggagcttgcagtgagccgagattgcgccactgcactccagcctgggtgacaaagcgagactctgtctcaaaaaaaaaaaaaaaaaaaaaaaaaaaattagccgtgtgtggtggcgtgcgcctgtagtcccagctacttgggaggctgaggcagcagaattgcttgaactcgggaggcaaggttgcagtgagccaagatcacgccattgcactccagccagggcagcagagcgagactgtttccagaaaaaaaaaaaaaatacaaaaattagccagacgtggtagcatacgcccgtagtcccagctgcttaggaggctgaggcaggaaaatcacttgagcccaggaggcggaggttgcaatgagccaagatcctgccactacacttcggctggggtgacagagccagactccatctaaaaaaaaaaaaaattctttaaaaatcaggcacacagtgtgatctgacttgcagttttccaagcctgtggggcagggagcctgggggaggctttgccctgagatgggagacttggcctcaggacattagagcgaaacagaggaggaggggatgggtctggatatccaaggcaggatctgccgagagatacgctgtgggggtgggacaaagacctcaagaacgggtccgggctgttcctgtcacttgtgacattgtggactgagtctgcctggatatttccttatgggctggctccccatcaccccgggagagtctcggggtggagggaactagaacgtgtttgcctggaggtcactacctactcccctggaaggaaggggctccaggaggctggctgtggaatgcagactgtgggtggtgcccggctgcctgcctctagttcacttgggccctcagggtggtacagagctggaaatccatacatggctgaccaccctgtaagggctgcagacacagtgagcgttcactttgccctggcaactggaactgtctcctccagtcctcaccacaaccgttttacagagcaggacacctgttgcaagatgggagagactttgctaacaaggtcccacagctggcactcaccaggctggctggggtactcaggccaccccttgcagtggggagcagttaggatgacaccgaggacacccctaggagggcggagttgtgagctccaggaccccacatttgagcagtttccccgtcactcttgaaaatgctgctgggccggccagtttctttggggtttctcagtactgctgaaagttacaaggtcaacactggcctgcaatcacagttataaaaaagttataaaagcctgacattcaaatcacgttggagactataaaacagcaagtttttcatttgcacacctcacatgacctcaagcctgctgtccatacacaggaaatggggatgtgcggaaaaaaaacccgaagtggaggacatcatcccccacgcataatccagtccgtgcatcgcacttgaccttcggcactgcagcctgcattgctccccggactagctcccaagattgatttagccagttccctgccagtggacatttaggtcattatcggttttcattccacaaagtactgccctcagggagtcggctgtccttgccaaaccactgcattaatatgtttctgggtgctggggaaagggcgcttaagacccctgccctcaaggtgttgatattctagttgggactgttagataaatgagcaattaggctgggcacgcttgaaatcccagggctttgggaggctgaggtgggaggatcgcctaggcagcatatcactacagaaaaacacaaataaaaaaagttagctgggcgtggtggcaagtgcctgtagtccgagctactcaggaggctgagggaggaggatcgcttcagcccaggagtttgaggctgcagtcagctatgattgcatcactgcactccagcctggatgacagagtgagatcctgtctctgaaaaaagaggtgcaaataaaccagaaaagtaccaactagtgggcagtgctgtgtttagaaggaaaacagggcaacatgaaggggaggtgggcatcagtaggggacagacctctctgaggaggtgacatctgagttgagtccctggtaaccggagatagccaggattgtggaaatacttggaggagatgagatggtctttcgaagcaggaggccagcatgtgcaaaggccctgcgacagcaatgtctggcctccttgctgtttctttttatttcattttttgagacggagtctcactctgacctatgctggagtgcagtggcatgatcttggctcactgcaacctctgcctcccaggttcaagcgattctcgtgcctcagcctcctgagcagctaggagtacaggcacacgccaccacaccccactaatttttctgtatttttagtagagacaaggtttcaccatgttggccaggctgctctcgaactctggacctcaggtgatccacccacctcggccttccaaagtgctggcattacaggtgtgagctaccacgcccggcctttttgctgtttcttgaccaccaatgtggctggaggcagggagtgagggggtggtgggggaaggagggcacggaggtgacagggccatggggggcacttgggaactgtcaaaccgtcaaatgttatgagcagaggagggtcatgttcttacattgtatcgagttttcctttttgtttttttgagatggagtttcactcttattgcccaggcaggagtgtaatggtgtgatcttggctgactgtaacctctgcctcccaggttcaagcgattctcccacctcagcctcccgagtagctgagattacaggcatgcaccacacctggctaattttgtatttttagtagagacggggtttctccctgttggtcaggctggtctcgaactcccaacctcaggtgatctacctgcctcggtctcccaaagtgccgggattacaggtgtgagcaaccgtgccggctttttttttgttttttgttttttttttttttgagacagtctcactctgttgcccaggctggagtgcaatggcatgatctcacaatctcagctcactgtgacctctgcctcctgggttcaagcggttttcctgcctcagcctctcgagtagctgggattacaggtgcccaccaccacgcctggctaatttttgtatttttagtagagacggagtttctccatgttggccaagctggtctcaaactcctgacctcgggtgatctgcccgcctcggccccgcaaagtgctgagattacaggcatgagccaccgcactcaaccaattttttttttttttttagtagtagagacagggtctcatcatgttgcccaggctggtttcaaactcctgggctcaagagattgcgtgccaaggtgctgggattataggcacgaaccactgtgctcagcctgagttttactttgattcgatggggcgaatgttctcttttgggtatcatggtaagagtttcacaaacccttccacctcctctctgaggcaggtggcatcattcccacataacagattgggaaactgaggcacaaagaggttacctgacctgcccatcttgtccagaaaggaaatactggattccagccagggcctggagagtcccagagccacgatcacgaattgccacaggtcacctcctgcttttgctcccagcctgttgtgtcccttggatgagaccagggagcaggtgatgccacggcttgagtgccaagggcgggcctcgagccgggagctgcaggattcctgatcagggaggggctgctgggctgggaatgttggggaggagtgaggccaggagtggattgtggaagtgagaagtctcctcatctgtaaaatggcagatttggcccattgttctgcaagcattggtcatctgcctcctgcctgggtgtgtgttgggtactggggagagagcagagaaggggccgatacgggaccctgcgcccatgaggctgccactctaataggatgttgaggtgggggcagggacagactgcagctgggtgaacacatcaggaacccggaagatgccagttgtgagtggcactgagcattgagcgggttgatgtgtgaaagaaggggagcagcttcctatggcggggggagggagggtgcagtttgctgggagctgcccgcctgctctgttaatgctgcaggaagaaggttccaggctgagggaacagcctgggcaaaggccctggggcaggacagtgtctggtgtgtttcgggaacatggaggaggcatatgtggctggagtaaagccagcaagacagagagtagggggaggtgaggacaggaaggtgacaggacaggtcgtgcagggcttggggggctgcagggaaaagtctggcttttattccaagtgaagcgggagcccaaggagggcccataacaaaggggtttacagtgacatggtgtgcacaggcaccttgtggctgctttgtgggaggcagattgtggggaccaagggcacgactgcactggtgtaggcaggtgacagtgggacacgctgacagccttggacgtggagggaattgagcagaatcaggcctgatgtggaggtgaaaccagcaggactcgcggctggacaaggcgggtgggtgagggccaggggagccccaggtctgcagcctcgtgaggggtttctcccctccctgccctttggggtgaccacagggatgcagtggcacctacctgcggacactgtgtgggccgagcactgtaaggcttgggcgtccttgctgggtgaccaatggctattgttggaaggatgaggcagggaccgaggtgggcagaggagactgggcatgggtccccacttctgctccaacagagcgacagagaagcccctgaggtgggtgcgggtgactgcgggtctgcctcattggtgtcccacccacattcgtgtcctggctctgctcctccctcgctgagcgtcctgggcaagtcctgagactgaacctcagtccacctgtctgaaatgggacttttggccctggcatccttgtgactttcaacccctctggggttgtcagaggatttgccgctatgttgcccgagatggggttagagacagcctgttgggtggccagcgttccttgtgtggctcttatcagagtcctgagagaagaggccagggtggaaattggccctggagtgtgggctcctgccgaagcctcttcctgtggccagtgccatgctgaaggctggctgtggtgtcacgtgagccctcccagccacattcaggctcaaagagactgtgctgagcatatggtgacaaggaagggatcccagcccagggtcctggccaggccctgccagcaccaggctgcacaggtgaggggtggcttgccctggggtgctggctctgggccacactgctgactcaccctctgtgggcttatctgttgattctccctcccatgggaaggctctgggtttgagcctgcatcgttcctgcacgtagccgtccccaccctcataggggctggaagtcaaaaggcgcctggtggagccttgtggtctgttcaaaaaacggtaaataaacagcctgggcttctgatctgctggactcaacctggcacctctcccatcgctgctgggtgctgcctcccagctgcacccttccctgcctgtcccctaccgccttcctggagcgcttatccccttccagggagaggtggcccactttagagctctgaaacctgctctggtggggtgaagtgacttgagccaggccaagccggtggctgggccctctgtggcagactggaagtgtcctcccatttcatggatggccaagtcagtgcccagagaggggtagagacctgtccagggccacacagcccaggaggggcggagctcgactttgaacccaggctgcctggctccacagtctggattcttcttacccattcaacaaatacttaatgagcacacactgtctggcaggcactgttctaggtgctgaggatctagcagtgaccaggccaggtgcagaagtcttggcgtgtcacaggactagaccttcatcagaggccgttttgctgggagtgggaaggggtgtgtatttgggagggaggggcgcaagccatcacacctgcccatggccaggtaggcagggcctatgggagggtttcctggcagagggaacaccccctgcaaaggcctgaaggccagcagtgccagagagaactcagaggaggcaggtgcagggggtggggctggggaacccggtcagcactgggactaggactggacaggacgggctaggaccagtcacttggtttctgcaagagagaagcttggaggcaggatcttcattttagaaaggtcactggggaaggtgggaggttgggccaggaccctggggcctggcctgggcccatggataggaggccaggtactgaaatgatgcaatagtactaggctaggtgcagtggctcacacctgtaatcccggtgctttgggaggccgatgcgggaagattgcatgaggccagaagtttgagaccagcctgggcaacatagcgagaccctgtctctgcaaaaaataaaaaaattagccgggcatggtggtgtgtgcctgcagtcccagttacttgggaggctgaggtgggaagttcactagggtccgggagttcaaggctgcagtgaggtatgattgtgccactgcactccagactgggcaatataggaagatgccatctctaaaaaaaaaaaattagccaagcatggtgacatatacctgtagtcatagctactcaggaggccgagactgaggtttgcctgtaccctggagtttgaggctgcagtaagctgtgattgtgctgctgatgcagcctgggcacagagtgagatcctgcctctaaaataaataaggccgggcgcggtggctcatgcctgtaatcccagcactttgggctgctgaggcaggcggatcacctgaggccaggagttcgagaccagcctggccaaaatggcaaaaccccatctctactaaaaatacaaagaaattagccgggtgtggtgctgggcgcctgtaatcccagctacttggggggctgaggcaggagtaagctgagattgcgccactacactccagcctgggtgacaaagcaagactccatctcaaaaaaaaaaaaagttaataaactacttaattgtgcatctcctgtgtgccagccctactctatgctttggggatggaatgttggaggatcccaccttggggagctgtgtgtgagctccccacacagctcagatgggggtatggggtctgtatgtgagccagaacaaaatgcagctaagtgacatttagcatgtgttagttccacagagaaaaatgaggcatggggggtggaggtgggagaggtgtgaatgggggtgagagaagtctctgaggaaatgtcattcgagcggaatcactctgagcttggcaaggttaccctgtcttactgacgggaaacctagaccagagaggccaggaagcccgcccaggatcacacagcacagaggtggccaagcagggactggaatgcagggcagcctgggtgcacagagggcactgtagcagcagcaaagggagaggagaggagtaggtagatttcagtactctcagaatgcggatgggatcaacgaggaggaagtagatgacggaggctggaaagtcacttcctgctaagtggccagtgtcagtgttccaggcagagctgcttgggaggtggtttctggaaggctccaagtactcctgctgctgtgtcccagaaaacccttagggccaggcccctgctcaccaagctcctaggagacttctggggggctcatttcggaggcagtccaggccgagggtgaatgttggtgccctttgcatgcagcagtctgggaacttttagaagcaaaatcggataagtcccagggctcctggcgctctcagcctggcatgcgaggccctctgcgcctgccctgccctgtcctcaaactctcccctgagagctgcgtctccgtcgcccaggctgtgccctcctgtgcccgacttagaactgttcggaataacactcaaaattttaaggaaattaaacactcgaacaaaggatttttagcaaagcaattttacttctgtacagaggggtgcttgtccttggccagtcgccatgagagcacacctgaacaaagggacacgagagcctttattcctgatgcaagtcctgctcctgtaccctctccccattggccggggtcgggtcatacaatctaaaccaattttggttggctaaacatttgaatttttgtagataaggtgggcacgtaaaagagagaggaaaggggaagggatgtctgtagtgaactagaaagttagtcttctttgtaaataagggaaggaatgtgagctggtactggtaacgcctggtactgtggcgtgcctgggcatctaacaaagccagaaaggaaaaaggaaaaaagagtgtgtatgtgtgtgtggggtactatgaattaaaagattgatcagcctgtttgaagagaaacctcatcatattccacactacaaataccccaggcccagaaagtcaccttctcctgcctgtgcccacagctctgtgttctcttgggcgtcactcccgccctatgttctgaagctgtgattgtccgttgtctgagctgggcgctggtggcgtctggggcatcaccattgtcctcacagtgcctggcgcctcagacacaaagtggagtcacaggacagcacaggccacaggcaaacaccagaggtccaaagccgggccctggctgggagttactggagggtctgcctaagatgtgtttgctcagaaggccaggtgccctggtggttagacagctcaggccctgtgccttcagtccatgttcatgccacccccagatgctgtgtgaccctgggcaggcccccaccctctgggcctcatttgcatctgtaaaatggagccagcagacccattttaatggatcctgtcatggttaaatgggttaataggcaggtgcagtggggtcattgcagggagttcaagaccagcctggacaccatagtgagaccttgcctctacaagaaacttaaggtggcctggtgtggtggctcacgcctgtaatcccagcactttggactccattgcactccagcctgggtgacacagtgagactctgtctgttaaagaaacaaacaaacaaaaaaaccaaaaaacttaaggtggtggtgggtacctgtgatcccagctacttgggaggctgagacgggaggatcacttgagccctacagttggaggttgtagtgagctgtgaccttaccactgcactccagccagggcagcagagtgagaccctgtctctatttaaaaagaaatcaaaaaggttaataatcatgaaaagttctcaatgccttgcttggcatagagtcagtgttgaatagctattagctactctaatgttttgaactcagtaatgcgtgtgtatgatgcggaattcaaagatgtcggaaaacatgcagtggctccttccccaccaggccccagccgccccgggtcctgttttgtttccctttggttgtcttagtcacaaagtacagactttcttctgtaccttttccttccccttcccccctcccccttcccttcccccccccacttccctttccccttcccccttccctttcccttttccttctcttcttcctttccttttctttcttcagtaaaactgatcactacaaaccttttctttttttctcacttagtacaccaaaaagggagttacatgtctagaaaggacaggctctttttgtgtgtctgttgctgcatagcagcatggataggccataatttatatataaatacacgtattttattctattttaaaggtttttgttttgtttttttcccccgagacggagtttcgctctttgttgtgcaagctggtgcaatggcgcgatctcagctcattccaacctctgcctcctgggttcaagcgattctcctgtctcagcctcctgagtagctggcattaaaggcacccaccaccacgcctggctaatttttgtaattttagtagagatggggttgcaccatgttggccaagcaggtctcgaactcctgacctcaaacgatccacccacctcggcctctgaaagtgtttggattacaggcgtgagccattatgcccagcaatatatcttatatataaggtgattgaaaatatatgttttcaaaaagaaaacatattttcagtcagcttccttaggttgaacgtaatttatatttaactagtcccctgttgctgggctttaaaattctttgagatctgaatttttcgtcttattgagaaactaacagggttgtaacaattctgtgggcaaattttaatggaatgtccaccctgtacttttgtatctgaatcttcacgaacatgttctccttgacttgtgaccttttcctgagatttcagttagatatagttaatcgcttaagtctttttttttttttttgagacggagtctcactctgttgccaggctggagtgcagtggcgctatctcagctcactgcagcctccgcctcccaggttcaagcgattctgcctcagcctcctgagtagctgggactacaggcaccctccacctcgcctggctaattttttgtattttagtagagacggggttttaccgtgttggccaggatggtcttgatctgctgacctcataatctgcccgcctcagcctcccaaagtgctgggattataggcgtgacccactacaactggccaatcgcataaatcttaaacatataccttgattttcttgtcttcttcttcttcttttttggagacagtctccctctgttgcccaggctggagtgcaacggcgcaatcatggctcactgcagcctcagtctcctgggctcaagtaatcctcctgccacagcctcccgagtagctgacactacaggggaatgccaccatccgcagtgaattactttttactttttgtagagacaggggctcgttatgttgcccaggctggtctcgaactcctgacttcaagtgatccacccaccttggcctcccaaagtgctgggattacaggtgtgagccactgctgcaagttttgattttctaataaatgattgtaccttggtacctactggctagatcaagatgcaggacttcttcatggtctcagaaagtccctcctgccccttctagtccatttcccgaaagggaaccactgccctgatttctatctccagagactagctttgccggttcaagttcaagtccaccctgtgactcagcaagagaaacaaggacatgtgtctacaaaaagcgcatatgagaatgttcagaacagctttatttgtaataaattcaagctaggaagaccccaaatgtccatccaatggtgactagacgaacagactgtagtccatcagtgcaatggacagattcgaccacgaaaaggaatgaacgtcagacacacgaagcagacaggatgtctgtgattgcatcacatgctgctcctgtgttgttttatcgttgacatcttccacttgcacacttcaaaaatagtcattgaaaggatggagcaggggcactgttgtgaggggcacgtgctgtcaccgccgctgctggtgattcagtgtctagccagcgccgcatggtttctgagatgctgcatttgtctttttttttttttttgagacagagtcgttctgtcacccaggctggagtgcagtggcgcgatctcagctcactgcaacctctgccttccaagttcaagcggttctcctgcctcagcctcccaagtggttgcgattacaggtgtccaccaccacacccggccagggtttttttttgtctttttttttttgtattttgtattgtttttgtttttgttttgagatggagtctcactctgtcacccaggctggagtgcagtgatgcgatctcggctcactacaatctccgcctcccgggttcaagccattctcgtgtcttagcctcccgagtggctgggattacatgcttgcgcccccacacccggttaatttttgtatcttaagtaaaggcggggtttcaccatgttggccaggctggtctcaaactcctgacctcaggtgacccacccaccttggcttcccaaagtgctgggattataggcgtgagccactgtgcctgacctgagacactgcgtctctgatgtgcaagatgccaagtgtccctgcccctcaggtccctacctgtgagctaggtggcctggggctctggtagggccagggccaaggctacttgtggcgttcatgaggttaataccctgggacagcctggtgtccactgtgactactgtgacggaaagacaaggggccatgctaagaggtgactttggggtctgtcacctgcatgggggcgcccgctcgctgtttccctcgttcagttcactccgcctcccaattgatgtagcttgttccctcagtccccctgctcagagaaccctctccaattatcccagcccccaacccctctcacccctgcagtatgtcttcctcgcacccacccccgtcagaatgttggcgccagtgtcaccagcacctccccaagtgctcaggagccagtgagaaaggttcgctccttttcatgcaagccatgagctgtgatgttgtccaagtctcgtatcctgtttgtgcctcaggctcctcatcagccgaatgggaggctgacggaaagggattagagctcaggcatcagcttgaactggggcacatggcgtgacaggcctagtgcctggcaggcaggtccctcgggctctttgtcatcctcaggagtgtggctcgaagacaggtagcatcccaggcctggagagctgactgtgctgcctgtggctgcagagacaggatgcagaggccagggctcgtcccccagagccttgcaagtgtctgtagggcgctcccctctgtcttgcctcctcccactctctggctcttctctatccagcctgccctcaggttgtgaccatccacctcccaaactgccctggaatctgcctacggcctgtccactgccctccgtacccctgcctgccatctctctggtttcgcccctgatgtcactcacatgaaccacagcggtcacccccacctgcctcctgctcctgccctctcctctgccctgcatcagccagaggggggtttaaaagcttacatttgttaataatctggctaaagcttaacatttattgtaatccatccctaaatcccagctggtggcattgctctaacagtgatgaccagcctcctcatcataatccccagcactgccaccctcaaccccccagcgctgaccactggaggctgcttctaaaacttcagccctgctctgccagcagcgcccctggggtgtcttcgtagccctgttgcccatcacgatcccttttctcatgcagtccaggctgcaagcccccgccgagggcttgggctgacttgttgtgtagtcagtgctgtgtctctgcacccagccagaagtggtgggacagccccccggctgacgggctagaacccatcatccagggtgtgtggaaagagcacatctcccccccgacgccagccactgggtaatacattcccaggaatttccagtgcccagccccagctgagaaacaggtcttctggaaccctccagcaccctcatcaggggttcccagcatgggtagggccacctgccagctgggaatgattgtagtgctagtgacactcactcagggacccaggatgctgtctcgttctgtacagggcacagctgtacagtaccaattgccctgtgtcctgtacaaattttcaacgatccaaacatctaggtgcaaaacctgtttgaaattctctgtgttggccaggcacggtggctcacacctgtaaacccagcactttgggaggccaaggcgggcagatcacctgaggttgagttcgagaccactctggccaacatagtgaaaccctgtctctactaaaaatacaaaaaaattagccaggcatggtagcgcgtgcatgtaatcccagctactcaggaggctgaggcaggagaatcgcttgaacccgaggcagaggttgcagtgagttgagatcgagccactgcactccagcctgggcaacaagagcgaagctctgtctcaaaaaaaaaaaaaaaaaaaaaagaaaaagaaattccctgtgcctagaacctttcaccattttgtatgaaacaacagaatttcctttcgagcctttaatgtaccccgagcccactgtttctacttcagtcctcactggaaagctttcattttcctttctgagtgtacagggtgacttcctgtcttcctccttgctggaatcctggtgtattcactgtaagtcggagcaggctactccctctatcttctggggtggttgtgcctgagtcttttccattgtgaaagacatggaattgattcctttcttccttccctccttccttccctccttccttccctccctccttccttccctccctccttccctccctccttccttccctccctccttccttccctccttccttccctccctccttccttccctccctccttccctccctccttccttccctccttccttccttccctccttccctccctccttccttccctccctccttccctccctccttccttccctccttccttccctccttccttccctccctccttccttccctccctccttccttccctccctccttccttccctccgtccttccctccctnnnnnnnnnnnnnnnnnnnngaattcactagtgattggtgacttcctgtcttcctccttgctggaatcctggtgtattcactgtaagtcggagcaggctactccctctatcttctggggtggttgtgcctgagtcttttccattgtgaaagacatggaattgattcctttcttccttccttccttccctccctccttccttccctccctccttccttccctccctccttccttccttcctccctttcctccctttcctcccttccctcccctccctcccttccctcccttcccttctttccttgatggagtcttgctctgtcgcccaggctggagtgcagtggcacgatctcagctcactgcaacctccgcctcctgggttcaagcgattctcctgcctcagcctcctgagtagctgggattacaggcgtgtgccaccacacttggataatttttgtatttttagtagagacggggtttcgccatgttggccaggctggtctcaaactcctgacctcaagtgatccgcccacctcggcctccccaaagtgctgaggttacaggcctgtgccactgcacccggccaggatatgtacttttcttaaacagctctgtcgaatagtaatttacattccgcgaaatcgatccatttcagaattagtggtctttagtcattttacagtccttttttttttcccacacagagtctcgctctattgcctaagctggagtgcagtagtgcagtcatggctctgtacaacctcagcctcccgggctcatgccatcctcctctctcagcctctctagtagctgggatcacaggcgtgggccaccacgcccagctaattttagtttagtttagtttagtttagtttttgtagagatggggtcttactatcttgtccaggcttttacagttaattttagtaaacatcaccatagtccagatgtagaacattttcatcaccccagaaagctccttcccctccattggcagtcacccccgttcccacatccaggtatccactgatctgccttctgcttctgtagatgtgacttttctggacatgaaacacatcctattttgtcatcaataactttcctcgtattttacccatatacatgtggcattgtgttgatttaaaacacataggaaatgtgttgatctcctgggtatgggggaaatttaacaaatacatgccagggaatgggccccctgggagtacggggggtggggcacagcctgccagagggaaatggttctggtcactatgaccttccatgcataccttcctgagctcttcaggcctcaggaccctccaagaccagagcattccccagggcccagctggggttggtgcctttgctgaggtcgcccaaattgcaagacagagttgctccaccacatgtggtcacacttcctgcccctcgatccggacgcaagagtaatttctgtccctctccccccctcacagggacttccttccccgcggttcaggaatcgtcacccggcggcctctcattctgcagctcatcttctcaaaaacaggtaaaatggggcggcctgaggttcagcaggaagtggatgtggatgtgtggttgccaggagttgctgggggcggagggtggaacttgggtcctgggctgtcattggacattgaattcacgtgttccacatgtgtgaggaaattgaaaaacggctcagtgaacacttacacacccacactgcaagccctcagctgtgaccagaatgccaggtgccatgtgtgctttcttttttcttttttttgagacagagtctcactctgtcacccaggctggagtacagtgatgctatcttggctcactgcaacctccacctcccaggttccagcgattctcctgcctcagcctcccaagtagctgggattacaggtgtgaccctccatggccagctttttttttttttttgtatttttagtagagacagggtttcaccctgttggccaggctggtcttgaactcctgacctcaagtgaccctctcacttcggcctccctaagtgctgggattacgggcatgagccaccacaccggccccatgtgtgcttttcatgtgttatagataacccgattttgctgaacgctttcaaagtcagtagcagacgtggtgacacatccatccttcacgccccagtgcacctccccatgcaataaagacgcctgtctacaaagtcccagcaccatgccccagagaacgagtcattcccgcatgtcatccacgtcccagtttctactcagcatgtcgccagttgtcccccagatatctggctggttttatagctgctctgctcaatccaatgctatactcttttgtaatctcttcttctcttttcattaaagcagcctccccataatcactttttttattttttttaagagacagggtctcactctgttccccaggccgtgcagtggtgtagtcatagctcactgcggcctcgacctcctgggcccaagcaatcctctccaatcagcctctcgggtagctaggattacaggtgcacacaccaccacacccagctgatttttttttttttttttttttttttttttttttggtagagatgggggttatgttacccaggcaggtcttgaagtcctggcctcaagcaatcctcctgcgtcagcttcccacagtgctgggattataggcatgaaccatcacaccagccctctaccattgctttttattttttattttatttatttatttattttttgagacaaagtcttgctctgtcgccaggctggaatgcagtggcgtgatctcggctcactgcaacatccgcctcctgggttcaagcgattctccttcctcagcctcctcagttgctgggactacaggtgtgtgtcaccatgtctggctaatttttgtatttttagtagagatgggatttcaccatgttggccaggctggtcttgatctcttgacctcgtgatccgcccacttcggcctcccaaagtgttgggattacaggcgtgagccaccgcgcccggccaccattgctttttaatcagactttgactcttagggagacccagcctgttgaatatagtatggcctatgtgtggattttttcctgttctttccttccctgatctcagtgtatttctattcttcccacccgaggctgacatgaggtgggcgtatatcccagctggaaaccccctcgggcctccttgggaaggatcttgggtcagaagctagacccgggagaggtaagggtctccgtgccccttccctgctaatctgcaacatcagctctgggcgttcaacactcagtttgtgttaatgtcttcttgcggcccttttaaatactctcacactgggaaggcagctgacacacacacccccattctacagatggggaaactgaggcttagccatgctgcctgcctttccaatgggccccagatctgggacctgcatccaggtagatctgacctcaacgccagctctcagcttggcctcccaagactcctcactttcgtcctctggccccgcccaacctggcgagaaggcgtgtctccagtgagagacagcagccgatgggcccaccacctcttctttatgagctctgctatttcgtacgccaccgatgggccaatgggctgccacctctgggttcaggcgtccaatcagctgtgccaggaatgggcagccccaaagtcctgagagtcactatagaaatcagtgttggtagttttctgtttctcattgagcaggatggggacagatgtgcaaactgcatttttattttattttattttgagacggagtctcactctgccacccaagctggagtacagtggcgggtgatcttggctcactgccacctccgccttccaagttcaagcaattctcatgcctcagcctcctgagcatctacaggcatgagctaccacgcccggctaattttttgtgtttttagtagagacagagcttcaccatgttggccaggctggtctggaactcctgagctcaaatgatctgcccgcctctgcctcccaaagtgctgggattacaggcgtgagccactgggcccggccacaaactgcatttttaatgagtccctggtgatgctgccagtctctggccacaccactgggagagcctgccctgcttggtttaggcttggagcggagactgcccaggttcccaacccagctcctagggagggaccaccactgtgtttcctgtctggacagtgatgacaataacaccaccttgttagccttaaagcacacgttatttactacatgtcagggaggaggggagagaagcaggcagagagccttggccaggagggagcacagagcgcaggcctacccagtacctgacccggatgaacgatgatgggttcctgatgtctgtccccaccttacagaggagggagccgaggcttcctgaccacttgccttagggcacatgggaacattgtctttaaagtccacccttaagccacctcttgggggaatgtggccttaggccaaggtgtgacttgaccagatcctgtggctgttggtggaaaagggaccacaggggccagtgctgaggccagtgccctggaggaggcaggagtaggtgctggaaggggtgggggcaggtgggggatgggtgtggcagctgtggtggaggtggatgcatagttgcatcctgttgggctggttgaaaagggagttccagaagtgtcccacatgggtggggccttttcctgcctcccagcttgcacccctcagccccgcctgatcatggcattttcagtctctgtctccttttttgttttgttttgttttgttttgtttgagacaaggttctgctctgtggcccaggctagggtgcagtggcacgatctcggctcactgcaacctccacctcccaggttcaagcaattcttctgcctcagcctcccaaatagctgggactataggcgcacaccacctagcctggctaatttttgtatttttagtagagacggggttttaccatattggccaggctggtcttgaactcctggcctcaagtgatctgcccaccttggcctcccaaagggctgagattgcaggcatgagctaccgcgcctggcaaatttttaaattgagatgaagtcttgctatattgaccaggctggtcttgaactcctgggctcaagcaatcctcccatctcagcttcccaaaatgctgggatgacaggggtgagcccctgcacccgaccaggctccaatctcttattgctccaagtaggtgcccacttggtgctgggccttagctgatctccagggaggcagcgtgagcacctggcatggtcccagcccccgagcccagcctgtgagtgtctgttggattcaccttggggttgggggcccagagagaacattctaggtagggaaacagcattagcaaagcagtgtggggaggtggtgaggcttgggaggggccagaaggcaggagggactgggactggaaggcatgttgaggattcaggcagtgggagctggggtggcatgcatggtggcgggagaccactggctgccatgttcaggagggacagtcagggaccagaatgcaagtggggagtgggggatagggagtggcagagaggctggcatggcgccaggcaagaggcaatgggggcctggccctggtggtgctggcagatgccaggcagtctagactgtcttccaggcaaggcattaagcagcataggcacccttgctgggggaggtgggtgggaggtaggacgccttactaagaggagaggaaaatgaacacattgcgggcatcagtgattgctggggccggcggggccttgtggggtatacaccagaccacgtggctcctagggattggcagctggctctctgtgaccaaactcagaaccaggctgccaccctttactggcccgggacttgttaaagtgacttccctctctgtgccttggtagcttcatctgtaaaatgggggtgatggtggcgctgccatcgtggccatggcaccccattggctgtggtatgctgtctcttcctgtggggtctgatgtccaaagacagggcccccagggcgcagcccacgttcccctctggttcccgcagcttgccctcattccagccatccccagtgaaccataacttccagccatagaagtttaaacattacctaagaccataaccaccaggaagtttggtggcccatgagtgaaccctgccctcactgggaagcagccccgtaaactctgagtgcctgggactgttcctgtgtggaatgtgcacagtgaggccctgtgaaccaccccctccccaccgcccttggccttgaactggcctttggtgtgctcaccggaaccaaggaagagatgtcaggacctggctccagggcttcccattggcctcagaatcaaatcgagcctccttctcaaggccttgtggcccttgccagtctctgggacctcacctcctcctggtccccagccactgcccccatccatctccctcctgattctcaggcccagcttgctggttcccactgcttggcctctgtgctcactgtgctgcctgcctggaacgccctgttccctacctgccactgtctgctgctcacccgcacctggtcacttgccgccttcgttccccggtccccggcagcacgagttatcctgttcttgttttttctttttcttttttttttttttttgagatggagtctcgctgtcgcccaggctggagtgcagtggcgccatctcagctcactgcaagctccgcctcccgggttcacaccatgctcctgtctcagcctccggcgtagctgggactacaggcgcccgccacctcgcccggctaatttttttgtatgcttagtagagacggggtttcaccgtgttagccaggatggtctcgatctcctgacctcgtgatccgcccacctcggcctcccaaagtgctgggattacaggcgtgagccaccacgcccggcctgttttttcttaatggactctctctgcgccagcacacgagaacaggcatgcagatcggctctgcccagcacagggcctggcgccgagcaggtgctccgcatgcacggccgagtgaacgagctcaaagggctggtgctgtgccccttcttgcctactgggcgggaagtgatgggggttactttaccaagcatcttcccctggtgagcctggtccatcactctgccattccatctgcagccttgtatctagagagcagaccaagctggcgtgcgtcaggctgtgggctggctgggatgcctgcccaggctgacaccttcccagtggcaatttgtcctggactgggagatatttgcgtattgcctcggattagagagaactcaagggctaaatgggcatgggaagtgttgtgtgctgtgcccacttcttggtctgctgaaggctctcaaaagtcctgcatgagtggatcctgcctgctggcgtggtagctagggtctcctgatggtggcagatccccaagttgttccccctggtcctgcctgccaacagcaggtttgggaaaggcagatctcctctccttgccttcagggccagcctcgtcattgtgttctttgctgggggaacggtgagaagatccagggcagagccccagtgtgcaaagcactgggaccctagcccagcccctgagggttccctgagactaacagctgagccgtgtttgtgctcctgatgggatttgatcgcagtcatatgggagccccggcactgggttctgtgtcattgcattttggggaaactgaggtgctgagagaagggtaggaacccggagctgggtgtcgctaggctgtgaaaccacgaggcaccccgaaaactctcctccctctctccctctcctcacctccccaaacccggctgtcttttctgttgggctgaaggcaggtcttcccagcaggacctgggcatttcaaaattcttaagtagtgccagcgggcacgtgaccagtgtgctttgaagatagggagggccattctctgaccaagggccttcggtcactctggggctccacaagctcctttgaaacaggaggctccgaagacctccagggtctccaggccagaggtgactgtggcctctggcaaggggctgcttcttcatgtcccaggccccctgaccctgagaaggtggcagcttgcacctgtggctcccttctggggacacctcaaagggcctgaggtgcaggggattgactgtttagcacagtggggccccagttgggggttcctgggagtgatgtcctcctaggttagagcacagattcttttttcatggattttaattaagcagctgctgtatacgagatgctagggggaactgtgatcacaccaagtctctgctctctcagagctccagcttcagtaggggacacaggcttgggagggaggcagaacctctctctagaaaaacccgcaagtacaaccagtgggcccacagttaggaggccctgtggtgggcgaggacggctgactccctggccttggcagcgtgattgctggatgactgcccagattaatcctttactcctgctgtgtgccaggctgggtccctcagagtccccagggcctgatcacatgccagctgcgaacctctctgagggggcccgggctgaccctcctcccagggagccctcctggctcagggtgccgggtgacagtgggggtgtgtgtggagctatcaaaatgctttgcagtttgccgaggaattacaggaactggctttggtatctggaaatgcctgtctgcagagggtggctgtggggtgcagcttgatggcagggaccgggacaggcagagccaggggtggctcagtggcttgttggctgggcctcggctgctgctgctgtggacaagttgacagggaactcagtgttaaggcctctggctgattctttgggccagtggattgttaaaaaaaaaaaaaaaatcatctcatctccagcacttgagcgcatgcagcgttccagaggcccaggctaggccctccactctatttctctttttgtcattgttttgagacagggtctctggcctccccttgtcatccaggctggagtgcagtggcgtgatcacagctcactgcagcttcaacctcccaggctcaagcagtcctcccacctcagccacccgtgtagctggaactacaggcttgcgccaccacgcccagctaatttttaatttttttgtacatgtaggatcttgctatgttgcccaggctggcctccaatgattctcccacttcagcctcccaaagtgctggagttacaggcatgggccactgctctcggcctggtggaagcttttaaacctctattgggctgggcatgatggctcatgcctgtaatcccagcactttgggaggccgaggtgggcggatcacctgaggtctggagttcgagaccagcctggctaacatggtgaaacctcatctttactaaaaatatacaaattagccaggcgtggtggcatgcgcctataatcccagttacttgggaggccgaagtatgagaatagcttgaaccggggaggcagaggttgcagtgagccgagatttcactactgcactccagcctgggtgacagagcaagactcagtctcaaaacaaacaaacaaaaaacctctgttgacctggcattcagcatttactttcaccatgccagggagccctgtgaagaaaggcaggcagctgcggcagacctggtcggtgcctgggcctttttctctggtgtggttctgttgctcactgacccactagggaagaaacggttttctggcacctgctgtccatatccttcgcccacatggaggggttggccgacagcagaaggatcttggaggagagatcacaaagaacagcccttgctggccgggcgcggtggctcacacctgtaatcccagcactttgggaggccgaggcgggtagatcacgaggtcaggagatcgcgatcatcctggctaacacggtgaaaccatgtctccactaaaaatacaaaaaaattagctgggcgtggtggcgggcgcctgtcgtcccagctacttaggaggctaaggtaggagaatggcatgaacccaggaggcagagtttgcagtgagccgagattgcactactacactccagcctgggtgacagagcgagacttcgtctcaaaaaaaacaacaacaacaaaaaaaaacagcccctgtcttctctgatcccctgttggttcccagcctgcatgtgacaaccggggaaggtgccgtgctccaaagtctggcatgtgagtctggctgcctggttccagccccatctcgtgtctgcccctgactgggcggacttgggtggggcaggtggtccttcctgggcccgtttcctggtccttgcgttggggaatggcctgaggttccgggggaaccttttgcagctcagacacctagattcagcttgctggggaagcctgtggcagccgggcaggcagaacctccatttctcacctaacatgcgtgagtgtgcccttggggacacagcaatgaccaaggcagatgggcgtcccttccctggtggcatggacattcaaggtaaagctctctatattagatttcttctcaccctttgtcagatggtagtaagtgttatggggaaacgaaggcaggggaggagggggctgggtggagcagctgctgtggggagagagatctgcaggaggtggggatgctgtgtgacttgagagagtagcttgccctctctgggctcctgcctgtgtgtgctgggggaacgatggcgcccactgcccctggtgctgtctttgccacatcattccttggggacttctgcccaccagctgctcagaccgtagctgtgctggctatgctcttcctgtgcaggtattgactctgagtcctcatacagcctgttatgatgcgcattttacagatcagtagactgagacctgggcaggccctctgactacagactgagctcattactgcacacagcgtgctgccagtacatgctgggctctggggtgctggagccgcaggtcctggccccatcaatacaatccaaagtgagctggctctgatgaggaagaggccaagatgccccactcagggaagtcttcctgggagaggtggtagccaggcagacctgggagtaggaggaggtagggctgggctttgtagacaccacacttggtgggacagaggcctgctagggagagggcctgtgtccttgccaccagcccatcttccacgccatgtccccctgcactctttgaagggagatggtctcttttggggctaagctggggtcctggagccagaagagaactgagatttgctgtggggggttgggagctgttccatttttagtggctgctacaggaagagcggccgagtgtttccccttgtccctgcagaaggctggagtgtaactgtccttgggaactgggtcagctgatagcagggctgggggtgggggtggggatcctgaatcctccagcagatgtcctcattgccctgatctgggtggccagtgcctgtgctggacacggtcctcagtcatcggagcccactgagtctccccctgaccctgcagagaatttcaaagaggcgaagttccttccagtggcctcacaaaggctatctggcttaggagccattacctgaagccagaatttctgagttccaagtcccagctccatcacggaacttggcccaaggcccttaacccctctgggcctcagttttgtcatctttgaaatggggatcttagagatgcctacctgtcaagggacttgtgaggcgcaacgggaccacacgcagggcctggccagagtgccgtagtttcttcggttgccatgatgggacggtgaaactcctcacactcttctttctgccttgaagattctagacctggctgggtgttcatctccctttttgcctttgcttgaggcagtttatggcatggctgtgttattcacgtcgccaggtctcctcctggtggacgttgaggccattttcatttttttactcttaaaaacgacagggcagtgcacatcttcgcatctccggggtgggtcaggtctctgacctctttgccagtgtgacttattacccctttctttctttgtttttctttttgagacagtgtcttgctctgtcgccaggctggaatgcagtggtgtgatcatagatcatagctcactgcaacctccagctcctggctcaaatgatcctcccacttcagccgatattaatccattttcatgctgctgataaagacgtatttgagaccgggcaatttacaaaagaaagaggtttaatggagttacagttccacacagctgggctggggaagccccacaatcatggcagaaggcaaggaggagcaagtcacatcttatacggatggcagctggcaaagagagtgagagagcttctgcagggaaactcctgtttttaaaaccatcagatctcgtgagacttattctctatcacgagaatagcacgggaaagacccacccccatgattcattgatctcccactgggtccctgctacaacacaagggaattatgggagctacaagatgagatttgggtggggacacagagccagaccatatcagcctcccaagtagctggaactacaggtgtgcgccaacatgcctggctaattttttaaatttctgtagagacggggtctcactgtgtcacccaggccggtcttgaactcctgggctcaagtgatccaccctcctcggcgtcccacagtgctggataataggcgtgagccactgtgcccagccatttcccccttatttttagcatcactacagtagctgtgatctctgagctttggggatatcccctccccaacattttactctgaaaattcgaacatctggaaacgtcaaggctttgtacagtggacacctgtgtactcggcagccaccttccgtgatgaacatgccttatatttgctttgtcctcaatctgtgattcgggactggatttctcttgtttcctggtgggacccacactgcttgtcaattacttattttgttccccttcatcccagtcttgctgtgactttcagatacccccgggtcttatatacactcagggttatacccagaaaacatttctcctgggggatttgtctctaggtagggggccctcttgaatagtcagggggagaaagaaagactcaagaccagctctgaggaggcggcaggggtgccccttccctctacctgtgggctccttggggaagaaggacaagtgagtgccatgagaaatacccctggggattttgtggagctggaatgtgctggtggaccatgaatccacaaggacttgggcatcgaactcccttgactgggacccacagcaagggaggctctgcagcatcaccttaatcaaatggactcaccctctctgggtgatgtatcctggtgcttcctcttctgttcatcagtcaatcaacaaataaatggctgggcgtggaggcatatgcctgtaatcccagaaactttggtcattggttatgtctacctgtttatttttgggggagggggattcataatatgtcatgacgtatattaacagtttgcaaagtgccacatgggaacgtaatcttcaggatctggaaagaggctcagtctattcagtctataggaacccccgcctcccccaagacccttgtcatgagaacgaatctttcactcccaaattcctagagtgacgatgattgggtcattattttcttttttattttattttattttattttatttatttttttatttttttgagatggagtcttctctgtctcccaggctagagtgcagtggcgcaatctcggctcactacaacctccgcctcccgggttcaagcaattatcctgcctcagcctcctgagtagctgagactacaggcatgtgccaccatgccaggctaattttttgtatttttagtagagacagggtttcaccatgttagtgaggatggtctgaatctcctgaccttgtgatctgcccacctctgcctcccaaagtgctgggattacaggcgtgagctactgtgcccagcctgggtcattactttcattcaacaaagcatttctccccgcagtccatgcgcaccctgcccacagctctttctcattttcagcatctctcttccctttctagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacggtaggcagcacgggtggggacccatcactgaccgtttctggtcgttcatggacagtgctatgggtgagcctgtgtacttccactcatgggtatcatgtgcccattcacaaacagttgatattcacacacacatagccccttgatctgtatcttcccacttgtgctaggtatgtagtacccagacctctgtctcagcttgaagaaagagcatgccaagaagttgtttggagtggtgggggattgcagccatttcccccttttaccaagggcagccaccacttggctcaaggcagccagatctgctggtgcctcaagagaggccagaaccagtcttctgtaaaatatcctgggtttttttttttttttttttgagacagagtcttgctctgttgcccagtctggggttcagtggtgtgatctctgctcgctgcaacctccgcctcccaggttcaagcaattattgtgcctcagccgcccaagtagctgggattacaggcatgcaccactacacccagctaattttttttttttttttttgagatggagtctcgctctgtcgcccagactggagtacagtggtgtgatctcagctcactgcagtctccgcctcccaggttcaagctattctcctgcctcagcctcccaagtagctaggactagaggcaactgccaccacgcctggcaaattttttgtatttttagtagagatgggatttcaccatattggccaggcttgtctcaaactcccgaccttgtgatctgcccactttggcctcccaaaatgctgggattacagacgtgagccgccgcgcccggccaaattttttttttttttttgagacagagtctcgctctgttgcccaggctggagtgtagtggcgcaatctccactcaatgcaaccttcacctcccgggttcaagcaattctctggcctcagcctcccgagtagctgggattacaggtgtgtaccaccctgcctggctaattttttttttattttttattttttttatttttagtagagacggggtttcaccatgttgcacaggctggtctcgaactcctgagctcaggcaatccacccacctcagactcccaaagtgctaggattacaggcgtgagccaccacgcccagcccattcagctacttttttgtatttttagtagagatggggtttcaccatgttggccaggctggtctcgaactcctaacctcaggtgatcgcctgcatccccctcccaaagtgctgggattacaggttttagccaccttgcccagccaaatatcctgattttaaaactctgcattcaaacagcagcccggggccatagacatcctctggcccagaggcacagattgctaccatgatgggttccttgcgataagttttaaatttgtttttcaataaatgacacctgcatgtggctcagaattcaaaaattacagaaaggtatatcgcaaaaacctaccttgtcaaccagttttgcacacatattttaggttcttcagatgacaatgcaaacatgagctgggtgtggtttcacacacctgtcattcaagctgcctgaaaggctgagtcaggagggtcacttgggcccaggaagtcgaggttgcagtgagctatgatcacatctgtgaatagctactgcacttcacctgggtaacatagcaagaccctctatcttaaaaaaaatgtgtaagcaaaaaacatgtaagcaattgtgattgtatctatgtatatgttgtgtatgtgtttatcactccttttccttaaattgttagcataacataaaaatcacttatgctttttttgagatggagtttcactcttattgcccaggctggagtgcaatggtgcaatcttggcttaccgcaacctccacctcccgggttcaagtgattctcctgcctcagccccctgagtagctgggattacaggcatgcgccacctcacccggctaattttgtatttttagtagagacggggtttgtccgtgttggtcaggctggtctcgaactcccgacctcaggtgatcgcctgccttggcctcccaaagtgctggcattacaggtgtgagccactgcgttggcctatgctttttttttttttttgtatgcctctcagaatgtttctttattatatatttatttttttttttttttgagacagggtttaacactgttggccaagctggagtacagtggtgagatcttggctcacttcttctcctgggctcaggcgatcctcccgccttagtctcctgagtagttaggacaacagatgcacaccatcatgccaggctaattttttatatttttggtagaggtagggtttcgccatcttgcccaggctggtttcgaactcctgagctcaagtgatctacccatcatggcctcccaaagtgctgggatgacaggcatgagtcaccgcgcctggcctcatccatttgtcttttgtttttgtttttttgagacagtcttgctctgtcgcccaggctggagtgcagtggtatgatctcagctcactgcaacctccaccttctgggttcaagtgtttctcatgcctcagcctccagagtagctgggagtacaagtgtgtgctaccacgcccagctaatttttgtatacttagtacagatggggttttgccatgttggctaggctggtctagaactcctggcctcaagtgatccacccacctcggcctcccaaagtgctgggattgcagatgtgagccaccgcacccagcctcatctgtttgtctgtaatggttctttggtattggctgaatggatgggctgaaatttattcagtcatttaggtctattccagtctgaactgtcctgatttagaactgtgccattgaaatggagtaggtagaaggtatctgtaggatgggatcctagaaggggagttactggatcaaaggtgtggttcaggcagagtgtcaggcgacatcctcaagtctgagccccgcgcaggaactttggtagtcagctgggtggctgcgggcctgtttgtgcctcccctctcctggctctgaatgcctttccttctggtttccctcccagtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggtaaccctgagcctagggcagtcccctcttccaggtgcctctgagcatgggatgtgcccagcatccttggttccaagtcactggcgttctctttaatccatggccgctgtaggaaaaggcctcctggaacatggcacttcctccgagaaccagcagtgctggtgggcatcccctgggaagtcactgtgtggcagttggacggtcctccttggacatggcagtgcccatgttgccagagtgggaagctagcctagggctgaaggaagggcccagcgctccatcgcccagatgcgatcttaggtcccatctagctgttactctgctccctgagacatggtcccctcttagtcagaacgggaacttcagtcctaacccagatagctgatgtgaggactgttgaacttttgggttgtttctgatctttgcatggtgagatcgtctatttcccttcgagttgacacccctgggcccctctagtcagatccttctactgaaccctcactgcagaatgtgagcaggaaggggccccagggagggcacagctgtggcccccttgatgcccaaattggcacccaccagagatcttcactctggcttccatctgtccccagtgtctcatgcacatgccacacatataacacacacggttagcacagagccaggccctcagcccccgtgggagcagttgatctgcagaggtgagactttgctagaaagacatccttgactctggaatgacttgtggagaggtggaattggatgggatggtttccagagtggaattttagccattcaggcaagaggtagtcctggaaacagtcgtgtcaaactcaaatgttcccttgggactttgccggcacttggaaagtccagcatcaaaatctggcccaggaatcatgtttacgtgaggtttcccaaagcctgcagcagcagaggttgtccttaataacacaaatgacaataacggccagcatttgttgagtatttgccgtgtgccaggctcacccttatgaccaccctgtgagatcagggctgtgaccatcttcattcgacatgtcggaaactggggtccaggcctgtgacgttctggctttcccaggtgatgtgacctggaagtttcagggccaactggaccccaggtggcttgcagctgccagctgatgctctttcctggtggcagcctctgacctctgacctctgggctctttcaggcctacggaccatcggtgtcatcaccaagcttgacctgatggacgagggcaccgacgccagggacgtcttggagaacaagttgctcccgttgagaagaggtgtggctttgggggtgctggggaagcaggaggatgggtggggtccttatcattactgaaaccccagcacctgttccctgcctgcctggaagtcattgcttctccatttcaccgtaactccttctttcttttccctttgagctatgtatctttttcttctgatttgtatgcattcgtttttcaagtgcacaattaacacctgctggtttctgaaacattagaaaacaagtgtatagaaagaggaaactaaactcacccgcagccacacttcccccagacagccactggtgaatctgcagctcccagctccccagggtttataactttaattaatttttttattactttctattatgagccttcccttcccttttccttttcctttttgttttttgagacggagtttttgctcttgtcacccaagctatagtacagtggcacaatctcagctcactgcaacctccgcctcccaggttcaactgattctcctgccccagcttcctgagtagctgggattacaagtgggcaccaccacgcccagctagtttttgtatttttactagagacggggtttcactgtgttggccaagctggtctcaaactcctgacttcaggtgatccacttgccttggcctcccaaagtgctgggattacagccatgagccaccgcacccggcctattatgagcattttcaaacattcccaaaagtgtggaaaaaagttcaaagaatcctcgtggatggcttccccagcttcggtggttattattattattttcttcctggaatattttattttttcattttatttatttatttatttatttatttatttatttatttatgagacggagtctctgttgcccaggctggagtgcaatggtgcagtctgggctcactgcaacctccacctcccaggttcatgccattctcctgcctcagcctcccgagtagctgggattacaggtgccagccaccacgcgtggctaatttttgtatttttaattgagacagggtttcaccatgttggccaggctggtctcgaactgctgacctcgtgatccacccgcctcggcctcccaaagtgctgggattacaggtgtgagccaccgcacccggccatcttcctggaagattttaacacaaatcctaggcactggctgggcgaggtggctcacacctgtaatctcagtgctttgggaggctgaggcaggaggatgccttgaggctgggagttcaagactagcctgggcaacatatcaagtccctgtctctactaaagattaaaaagttagctgggcatggtggcatacacctatagtcccacctacttaagaggctgaggtgggaagattgcttgagcccaggagttcgaagctgcagtgagctatgatcacactactacactctagcctgcacaacagagcaagatcttgcctctaaaaaaaaaaaaattctataaatcctaggcattgtagcattttacacataaatacccacatttcttttcaaatacttccccttgccatcccatttgtttttttctataccattcatttgtggaagaaaccagaccacatcacacatttgggatttggccaattattgttctctgttagctggtaattagatcaggttcaggttcaagttcaggtacagatcttctgataggagtaacctaagtattttttattttattttaaaaatattttaaatattttgggtcgggcatggtgactcacacctgtaatcccagcactttgggaggccaaggcaggcggatcacaaggtcaggagatcaagaccatccttgctaacacagtgaaatgttgtctgtactaaaaatacaaaaaattagccaggcgtggtggcacacacttgtagtcccagctactcgggaggctgaggcaggagaatcgcttgaacccaggaggtggaggttgcagcgagccgagatggcgccacttcactccagcctgggccacagagcaagggtctgtctcaaaaaaaaaaaaaaagaaaaatttttcaagcattttattttatcggagcagcagttttaggttcatagccaaactgagagggagatacagagatttcctatcagccctatagcccacacatctgtaacctctcccactttcaacgtgcccagcagagcggtgcatttgctagaactgatgagcctgcgttgacccattgtcaccaccccaccccacatccatggttgacatcagggttcactcttgctgttataagtttttttctttctttctttctttctttctttccttttttttttttttttttttttttttttgacgatgtcttattctgtcacctaggctggagtgcactgggacaatcatagctcactgtagccttaaactcccaggctcaagtgatcctccgagctcagcctcccaagtatttgggattacaggcatgtgcgattgctcctggctaggttttattttgttttgttttatttttttcagacagagtttcattcttgttgcccaggctggagtgcaggggcacaatctcagctgactgcaacctctgcctcctgagtagctgggattacaggcactcgccaccacacacagctgatttttgtgtttttagtagagatggggtttcaccatgttggctaggctggtcttgaactcctgacctcatgtgatccacccgcctcagcctcccaaaatgctgggattaaaggcatgagccaccgtgcccagccttcttttgtgtttttttaaagccattcctcccctctggcatctactctaagctgcgggcacctcctgcctttcccttcatgcttagccgcagtcatttagagcatttcttttactcctgggttttccacctcgatgtctgagatagatgtggggaaaagttcagaccttggttgccagcatcccccagcactgctgagatattgagtggtgaggcgaccccggatcccaggggaatgctgtcagggctaaattcaaaaccctgtttagctgtgaagatccggggctgagaagcaaatctgtggctggctgaggtttggggaggatttgctggtgctagagaggaaagcagaccctacccaaccccacgccctactacagccaccccgacccggctgcccttggacactgttaggcctccatcttggatcctaagggcctttggggtctgtgggcactagccaggctgaggatttggtgatatgggcctcttccccttcctcctgactcactgatgtccacagctgcccttctctgccttccttcctgtttctaagaacgaaggcgcttccactctcagctcacttgtaggcctgctcccgttttgtgacctcaggcttcagaagccctcccactggaccctttttcctggcgtactaatgactcacaactcctcctcctttacgggaacccaggctaggcgtggtgtctcatgcctataaccccaggattttggaaagcacagttgggaggatggcttgaggcccagagtttgagaccagcctgagcaacacagcaagaccccatctctctcttaaaaaattatccaggctgggcacagtggctcacgcctgtaatcccagcactttgggagaccaaggcgggtggatcaaaccccagctctactaaaaatagaattagctgggtgtgttggtgcatgcctgtaatcccagctactcgagaggctgagacatgagaatcgcttgaacccaggaggcagaggttgtagtgagctgagattgcaccactgtactccagcctgggtgacagagtgagactctgtctttaaaaaaaaaaaaaaaaaaaaaatccgtgtgtgatggtgcacgtgcctgtactcccagctactcaggaggctgagtccggaggatggcttgagcccaggagttcaaagctgtagtaagctatgattgtgccactgcaatgcagaatgggcaacagagcgagactccatctcttaattaagtaaatcaagccaaatccaagccagatgctttttactggcccctcctgtttccttctttgtgctgtcacacaggtgatggtgactctggcttcacagggatctaggttcagatcttgggtctcctactgtgacctcaccttggcatgtcttcgtttccctcctccctcttggatccaagagagatctggcgaggatgaagagcagtcacatcccacaagaccctacaggatagatgaccggcacctctcccttgcttctcaagagaaacatgcacaacccactacaaagaaaagggagcacaggccaggcactgtggctcacgcctgtaattccagcactttgggaggccatggcgggcagatcatgaggtcaggagttcgagaccagcatggccaacatggtgaaaccccgtctctactaaaaaaacaaaaattagccaggcgtggtgacgcacgcctgtaatcccagatgctcaggaggtggaggttgcagtgagctgaggttgcaccactgcacttcagcctgggcagcaagagtgaaactctgtctcaaaacaaaaaaccccacaaaacaaaaacctagccaggagtgcaatggtaggcattccacttggattctttgcaacagtgtgtattgaattatccagcttttctcccccatatactgaagcgttaactttcagttctacctccttctcggtgtagttttggactttcttttcagttccattgatctctctggacatgaataccctgatgtacccaactgtttaaaatatactcgtttgatagtggattttagctcttccctattgctcttgtttttaagatgttatttcttttttttcttgtgagacaaggcctcgctctgttgcccgggctggagtgcagtggggtgattacagcttgctgcaacctcgaactcccaggctcaggtgatcctcccatctcagcctcccaggtagctgggactatacacgtgtgctaccacgcctcgctaatttttgtatatttttgtagagatggggttttgccatgttacccaggctggtctggaactcttgggctcaagcgttccacccgcctcggcctcccaaagtgttggaattacaggcgtgagccaccgcacctggccttgagattttttttctttttctttttctttttctttttctttttctctttttttttattcagagtcttgatctgtcacccaggctgaagtgtagttgcatgatcttggctcactgcaacctccgcctgccgggttcaagcggttctcctgcctcagcctcccgagtacctgggactatagtcacgcgccaccatgcacggctaattttttgtatttttagtagaggcggggtttcaccatgctggccagggtggcctcgagctccttaccttgtgatctacccacctcagcctcccaaagtgatgggattacaggcgtgagccaccgctcccggccgagatttttttctcacctatctttgaatctcagcttgtagatttcatctgccccaaagcttttttctgtccctgcgcacacaggctggatgtgagctctccttcctccaaatacttaatgttgctcttcgcagctgccatgtgcattcgcaccctctgtgttgtttctgagtaacatgttatgacagctgtgagtgcctcgtgggacaggatccatctctatacttgaatcttgcccatccccgtgccaggtccacttggctcacctagctttgcccctgacctgactgcctctccccacaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcaggtactgcaagggtttgcacgtagtgtgcagtggcataggctgtgcactgcacaacagctgcaatcctcactggcacttgtttcaggctagagcagcacttgttttagcaaaatgggttcagtccacatttagcctaggagtttgagaccagtctgggcaacatatggagaccccatctctaggaaaaatagaaaaaattagctaagcatggtggcacatgcctgtagtcccaggtactcaggaggctgaggcaggaggatcacttgagcctggaaaatcaaggcttcagtgagccatgttcatgccactgcactccagcctgggcaatagagtgagaccctgtttcaaaaacttaaataactaaataaaagaaatgtacttgattcagggtctggtgaagagcagatgttcagtgacttggtgctgctactattacaaccatcgctgttattattaccaaaattttaattatcattgtaattattcagtcatttacccagaagactgtatgcattgcctggggttggtgacagggggttaataactcttttttatttattattattattattattattattatttttttttatttttggagacacagtctcactctgtcacctaggctagagtgcagtggcatgatcttggctcactgcaacctccacgtcccaggttcgagtgattctcctgcctcagcttcctgagtagctgggattacaggagtgtgccaccacacctggctaatttttgtatttttagtagagatggagtttcaccatgttggccaggctggtctcaaattctgagctcgagtgatccgcctgtgtcagcctcctgaagtgctgagattacaagcatgagccaccatgcctggcctatcgttctcttcttgtaagtaattgattcacatggtgcataaacagaaatgatattaaaagctatacagtgggccagtgtgtggtagcaggggcaagacgctcctcctcgctgttttctagcaccttccagggtggcagcagggcctcagcagcactccagcagtcatcttttcatgcacatatcagggggacacagtgtccacacgagagtaggttcctgtccttgtagaaggcataattctaatgggggagactgacacccaacaaaccgccagataaatgcacgatcaagaatccagtaggggcgcgggggccgggaaaagagccacccagagaaggcagctcaggagagcaaagagggaagtcagtgtctagagggaggggccctccaggagaggaagctggggtgcttacaaacgggagtagggagaggaagggaagtaaaactccgcagctggctggggcctcctgagagccagcagtgaaaagtccagctggcctccagggagcctggagggggctcagcctccttccacgtggggtgcttcccagagcagcagcgccccttcctctccatttgctcatgacttaagtgccctagtatcctgtcacagaccaagggaaggccagcgtagctccctgcctttctaggcagcccacatagacgggggtcgatggccagggctgcagggcagggacccctggtcacggaggtctttgggttaccccacttgctccatgccatagatgtgaggttccttcatgcctcttttctagctcgccagacactttgtatttattttttatttttttgatgattttttttttttttttttttttttgagacagagcctcactctgttgcccgggctggagtgcagtggcatgatctcagctcactccagcctccacctcccaggttcaagtgattctcatgcctcagcctcccaagtagctgggattacaggcgtgcgccaccacactcaactaacttctgtatttttagcagagacagggtttcaccatgttggccaggcttgtctcctaatctcaggtgatctgcccgccttagcctcccaaagtgctgggattacaggcgtgagccactgtacccatcccggccttcccctcaaccccagatggagtctcgctctgttgcccaggctggagtacagtggcacaatctcggctcactgtaagctccgtctcccgggttcacaccattctcctgcctcagcctcccgagtagctgggactataggcacccatcaccacacccggctaattttttttttttttttgtatttttagtagagacggggtttcaccgtgttagctgggatggtcttgatctcttgacctcatgatctgcctgccttggcctcccaaagtgctggaattacagtgtgagccactgcccccggcccatgcccagcctttttgatttttcagacaaggtcttactctgttgtccagaatggattgcagtgacacaaacacggctcattgcatcctcagcctcctgtactcaagcgatccttttgccttagcctcctgagtagctgggactacaggtgtgtgctgccacacctagctaatttttaaaactttttttatcttttgtagagagaaggtctcaccatattgcctgggctggtctcaaacgcctatcctctagtgatctgtctcaacctccccaagtgctaggattacaggcgtgagccactggacccagctttctctgttgtaggacagatggccaaactctgctttacactttgcaagtataggctgattttatggctttgtttttctttttctttttttttgagacagagtcttgctctgtcacccaggctggagtgccattgtgtgatctcggcccactgcaacctccacctcccgagttctttctcagcctcccaagtagctgagactacaggcacccaccaccacaccgagataatttttgtattttttggtagaaacagggtttcattgtgttggccaggctggtctcgatctcttgatcttaagtgatccttctgcctcagtctcccaaagtgctgggattgcaggtgtgtaccaccgtgcctggcccacatttgtctattttgaatcttccttgcttttctctgtagatgcagatgcagccggggagctcatcttgagtgcattctccaccttttcaggggcgatctttccatcttagtttgtagggcctgtccccatgtgtgttcattggcccccgtttccgtggtctggatggactgtccttgcaagctgttgcttgtcctccaaggcgtggataggcccagtgcctgatgtcggccccgtgggctgtttgtagcctcttacactcatgggcagctccgtgccgtctccgttcccagacatgagtgtgtctgtggcttgatttatctgttgctgtctctcaaggctgtgtggtgtggtggccgcatagtggcaccctggtgttggcccttggttggggggagtgtgtctgccactccctggtatcctgcccatgccaccctttctgatctctgacctctctcctgcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagtatgtaccccggcacccaccaccaccaccaccctggcccctgccttccatcagccacagggccccctaggctgggcaccactcatcactcgtccactcattgattcagcagacacttgctgcaagccttctgcgtgccaggctccatcctaagcatggcattcgccccagtggaggggacaggtgtccgtccctgcccctggagtgctcagaatggggggaagtgggacaaatgggacaaaaaacaagaaagaaaatgtatagtgtgttaaatgtcaaaatatgaaagtggtgctagtgtgggagttgtcgggaacagcctcctttagaaggtgagcattggccggccaggagcggtggttcacgtctgtaatcccagcactttgggaggccaaggtgggtggatcacctgaggtcgggagttcgagaccagcctgatcaacatggtgaaaccccgtctctactgaaattgcaaaattaggctgggcatggtggctcacacctgtaatccccgtacttttgggaggccgaggcgagcggatcatgtcaggagatcgagaccatcctggctaacgtggtgaaaccccatcactaccaaaaaaaaaatacaaaaaactagccaggcgtggtggtgggcgcctgtggtcccagctacttgggaggctgaggcaggagaatggcgtgaacccaggaggtggagctttcagtgagtcgagattgcgcaacttcactccagcctgggcatcagagtgagactctgtttaaaaaaaagaaaaaaggccaggcacggtggctcacgcctgtaatcctagcactttgggaggctgaggtgggtggatcaccaggtcaggagattgagaccacggtgaaaccctgtctctactcaacgtacaaaaaaattagccgggcgcggtggtgggcacctgtagtcccagctacacaggaggctgaggcaggagaatgacatgaacccaggaggcggagcttgcagtgagctgagatcacgccactgcactccagcctgggtgattgagcaagactgtctcaaaaaaaaaaaaaaaaaaaattgcaaaattatccaggcatggtggcacatgcctgtaatcccagctacttgggagactgaggcaagagaattgcttgaacccaggaggtggaggttgcggtgagccgagatcgtgccattgcactccagcctgggtgatagggcaagactccgtctccaaaaaaaaaagatgagtgttggccaggggtggtggcttacgcctgtaatcccaacattttgggaggccgaggcgggaggatcacttgaggtccggagttcaagaccagcctggccaacatggtgaaacccctgtctctactgaaaatacaaaaattagccaggtgtggtggcaggcgcctgtaatcccagctactcgggagactgaggcaagagaatcgcttgaagccaagaggcagaggttgcagtgagctgagaacgtgtcactgcatatcagcctgggcaacagagtaagactccgtctcaaaaaaaaaaaaaaaaaaagaagttgagtgtcaggcgaagacctgaagcaggtgagggcagggcaggagccgtgtgggattaagcccggccagtgcaaaggccctggggcaggactgggccgggcatgtcagaggaagaccctgtggctggatggagtgagtgaggggagtgggaggaggtgatagagcaggttgtgcagggccttgtggggcctcagggaggacattggcttttgctgtgagtgaggtgggagccatggacagttctgagcgcaggagagtcaggactgactcaggtgctcacaggctccctagccgtggtgggagaagagacatgggagagcgggtgggagccagaccttggctaggttaggtccctctccagcttggcctcttaagatccaccccatgacttggttggtgcagctgcttagctgtgagattgggaagcaggtgtgcccccacaatcccaaattctcactcggggactcttctgcctctgaccttttggcttttggcctgtaagggaccttgaggcactggaacagctggaccagagcaggtgacagggacacctgggtagctcatactgcagacagtgccatgcatgaggcacttcccacagggacaccaggaggacaccgcctcctctggccatcacagccctggcatccccccaccccctctgccaggcagtagtgcatggtcgtgggctaaggggccagagtgcttttatgctcagacagccttgactacgttacaaaacactttctacagagcagatagtggccctttgcaggcttcaggaggaaattcatagccggggatggtggtgcacccctgtaattctagctacttgggaggctgaggcaggagaatcgcttgaacccaggaggtggatgttgcagtgagccaagattgtgccactgcactccagcctgggtgacagagcaagactctgtctcaaacaaacaaagaaacaaacaaacaaacaaacaaaacacaagattcagcctactagactgaaggaagtgttgttgtggaggattcagcctaagggtggacctgggcctgctgggtgaccacaggcaggtgattggacctctctgagcctcattttctgcacctctaaagtgagggtcatagcagctgtcatctcacatggccatggggacaaactggcagattacaaggtgcctgtaatcccagcacatggggatgccaagtcaggaggattgcttaaagccaggagtttgagaccagcgtgagcaacaaagtgggatcctgtctctgaaattaagaaaaaaaaaaaaaattaggctggggacgatggttcacgcctgtattcccagcactttgagaggcttcagtggatggatcacttgaggtcaggagttcaagaccaccttcaccaacatggtgaaaccctgtctctatgaaaaaatacaaaaattagccaggtgtggtggtgggcacctgtagtcccagctacttggaaggctaaagcaggacaatcacttgaacctgggagtcagaggttgcagtgagccaggatcacaccactgcactccagcctgggcagacagagcgagactgtatctcaaaaataaataagtaaataaataaataaataaatttaaatactacttgttaagcctatggcaggactgggccaggggatgcccatcacaaacagtccctgtcccccggggcttagcacgttacgtcatttgtaaccagttgccttgcagggccctccctgcccaggcactctcaccatggagaagcgccactgttatctgtgtctcctgtcaagagctgggccttcttgctttagcattttatctgagggtccaaggtcctcatgcagacatgggcggtctttctcggttcacgccttacaagagaacgggaattacggtaatagacttcccccagcctgaattctgcacttggcttttctcttcttgttaaagcaaagcctggagccttctgtctccgcctggtgcagcccacagactgttcatgtatcccagtgcccatggggacacccagggtttttttgtttgtttgtttgtttgtttgtttttggccttaaccgatgcttgtaagttcatctgtgactgtacaggcaaggattcctgcagggcaaagaccccagcagagggatcttgggttaaggaacatacgtgtttaaaattgatttttaatttttcattttattttatttatgtatttggtggttttttttgtttttgttttgagatagagtctcgctctgtcacccaggctgaagcgcagtggcatgatctcagctcactgcaacctcccaggttcaagcgattctcctgtctcagcctcctgagtagctgagattacaggcatgcgccaccacacccagcaaatttttgtatttttagtaaagacaggggtttcaccatgttggccaggctggtgtcgaactcctgaccttaggtgatctgcccacctcggcctcccaaagtgctgggattacaggcatgagccaccatgcccggacctcatgtatttgttttttaaacggggtctcgccttgttgcccaggctagagtgcagtggtgcaatcccggctcaccgcagcctcaccacttgggctcaggtgatcctcccaccacagcctcccgagtagctgggaataatacaggtatgcgccaccatgcctagctaatttttgtatttttgtagagacaaggtctcactatgttacctaggctgatcttaaactcctgacctcaagcaaaccgcctgcctgaactttccaactatgagatcgcagacgtgaaccaccacgcctggccttgtttttttaatttttatttattttattttattcttttgagacaaggtctcttgttctgttgcccaggctggagtgcactggtgcaatcatggctcactgaagcctggacctcctgggctcaagcaattcttctgcctcagccacctgagtagcctgatcctcaggcgtgcaccacagcacctggctaatttttaaagtatttctagagactggatctcactatgttgcccaggctgtctcaaactccttagctcaagcgatcctcctacctcagcttcccgaagtgatgggattacaggagtgcaccaccatgcccagcccaactccccctttttataaggacaccagttatattggctatgagcacaccctgtgatattctcttgactgattacatctgcagtgaccctgtttccaaataagagtacattccgaggtacaggggggcaggattcaacccgaattccgcgggacaccgaccagccggtcacaattgtccagaatgctctgattgtgcagcgtgggttgggcctgtaaatcacctccagggcccccaggaggctggtgcccaggtgtgctttgtcccctgtggctgagagcaggtccccagagtctccatccttgcctaaccctccccctccccccgtcgcccagtctgttgtctgtcattagtttagtgctatgcctttgctgaccttggtcctggtttggtccacaattcaaattctccattccaggctgggtgcagtggctcatgcctgtaatcccagcactttgggaggccaaggcgggcggatcacttgaggtcaggagattgagagaccagcctggccaacatgccgaaaccccatttctcctaaaagcacaaaaattagctgggcatggtggcgggcacctgtattcccagctactggagaggctgaggcaggagaatcacttgaacccggcaggcggaggttgcagtaagctgagattgtcccattgcgctccagcttgggcgacagagtgagactccagctcaaaaaacaaaaaacaaaaaaaacaaattccccattccaggtgaagcattaacctaggcctttgtgtgtctcctggaaggaaattaaatgtgcacaccctttacttcatgtgaggaaagagattttggggatctgggcagcttgtgcttgcctctcccagttggggtatgaaggagacccccctttctttggcagcccagccttggtggccctgacagtggtcaccatttgagcagttcccctttaggagcaagtccccaggtacttcagtagatcatgatttttgggagggaaactgatgaagggagacagcccagtaccctaaggagagcaattaggaatgcttaggaaaactaaaacgtgaacaagatcatcctacttttttactattcacgatgccaataggcaatgctgagagactctttttaagggccaggcccgttctaaggggcgacacatgttattaccactttttgtccattagatgagcaattgtttaccaacaaaaattttctttcttttttttcttctttttttgagacagggtcttactctgtctcgcccaggctggagtgcagtggtgcgatctcggctcactgcagcctccgccacccagattcaagcggttctcctgcctcagcctcccgattaactgggactagaaacgtgcaccaccacacccagctcgtttttgtatttttagtagagacggggtttcgccatgttgtccaggctaatctcaaactcctgggctcaggtgatctgcctacctcagcctcccaaagtgctgggattataggtgtgagccaccgtgtccagtatatatatatattttttaataaaatgtggtctcactgtgttgcccagggtggtctcgaactcccagactaaagccatcctctcacctcagcatcctaaagtgctaatattgcaggcatgagccaccgcacccggccaataaaacattttaacttgtgtgaaaccaggtgtctttgcagaattaccattagtggcagcattttttctttttttgtgggcacacaaaataacagtgcattttaggatcagtgacttcttggaggtaatgagatctaaaaacatcttcagtctccacgaaggaggtagatgttgttaccctcaacccattttgtagatgaggaatcggaggctcagaggggcaaagtcctgtccaaggcctcacatcccatcgatgggtcaggaccaaccccagcaggctgggaggtggcgggaacctatggaagccacctgaattgtggggaagtggctacctttccttcccagcatcctgtaaatcaagttgagcttcagggcagaggtgctgagctttgacccctgaacttcactcctgtcttctgcaaagtgggaggaataagtgggccttctcagatcgaatgggtgaataatcggaacaggcttagcttgagcctgactcgtagccagcatttgccattgggagctcttgaatttggtttatttgtcttaatatagacagaagacattttgctgctgaaaaatggtaaaagaacagtaaaccctggcttgacttggaacatcattccagagtagtgtggaaacctccgttttgatgcttgctttttccttttcctcataggatggtccagcagtttggggtggattttgagaagaggatcgagggctcaggagatcaggtggacactctggagctctccgggggcgcccgaatcaatcgcatcttccacgagcggttcccatttgagctggtgaaggtagtgccccccggggctgggccctcccgtctctggtcaggcaccctcctgctggcctcaagccaggcctcctcccaggcaataaggtctcaagctcctacctctaggcctgaacttgtggtgggcagggtgtggcctggatgaggtgtccccatgggcttccttttctgacactcagctttgaggttttgggcagaacaatatgaaaacccctgtgtttttcctctgacaaaagccaatatacattctttgcaaaatacatagaaaatacagataaatttacatgagaagatgtccctagcatgtcattgaagaaggaaaaaataggcattggagccagcatgtgcaacatagcactgagctgatatatacaacatccttatgtatgaaactgaacatggatgtctgtctacaagtgtttctttgtatttgcaaggatgtttgcaaaaatgtcagccctgggtgctaggatttgggacttctttttccgtgtgtgtgtgtgtgtgtgtgtgtgtgtgtgtgtgatttgcttgaagttttatactgtttacaatgagcacatagcattttttattaaaaaaacaaacagttttttaaaatcagaggagcaagaccaaatgcagtggctcacgcctataatccgtgggaggccaagggggcctgatcacttgagcccaggagttcaagaccagcctgggcaacatggtgaaaccccatctctactaaaaatacaaaaattatccaggtgtggtggcatgtgcctgtagtcctagctacttgggaagctgaggtaggagaatcacttgagcccaggaggcagaggatgcagcaatgagccaagatggcaccaccgcactccagcctcagtgacagagccagaccctatctcaaaaaaaaacaaaaaaaacaaaaagaaagaaaaaagaaaaagctgggtgtggtggtgcatactgatagtctgaaaaatctaagtttacatgaatttatattcccaccaatatgatgagagagttggtgtcatgtcatgctttctgaaactgggttttaattaattaatttgtttgtttatttttattttttttgagacagggtcttgctctttcacccaggctggagtgcagtggtgcaatcacagctcactgcagcttcgaccttcctgggctcggatgatcctcccacctcagcctcccgagtagctgggactataggcgtgcaccagcccacctggccaatttttgtatttttagtagagatggggtctcactatgttgcccaggctggtctcaaactcctgggctcaagccatctgcctgccttggcctcccaaagtgctgagattacaggtgtgagccactgtatctggccagttttcaattttttaaataaaattttgacgagttaaatattctgccttgtgaatatagccacacgtgggagagaacgttccccagatgcacgcctgccacgggggcgccccgggtgcctccatgcatgtgcttggtttgtctcttctcagatggagtttgacgagaaggacttacgacgggagatcagctatgccattaagaacatccatggagtcaggcaagttccacgaggagagtcaccactgttccttcctctccgtggtgcgaccccccagctaattgggtcacccacacctctgagtccctaatcgttaggccttaagagggctcttggatggttttctgtagctgcgagcccctccctgagggtctccaagggcacatgagggtggatgtgtcttagtcctgcgtccattgcaggcttcagggctgtctgcagctcctgatcaaatagggcttagttcctgcccagtcggttggtgtgaacctcatgctaaactaagaatgctcactgcagatttgcctggggaggggcggggcggcactgaatcagggttttgggaagccagcatgagtccccatcatggcttcctcgtgagcctcttgggtcccctccttattctaacaaaggtagttgctccaggtgtctgcccttccatcgccgtggggtcctcgggtcaccctgagggtttccgggcagtggactcaggcatccgaccccacacatgacacaaccttcattccttgttggggacccggccagggccaatgaaattgctgaccatgctttgtttctctctgacttatctcccctgcccccgggtctggacggtttcaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaaggtattgctccctcggcagggtgactcctgaccttgtggaaacgggggtacgggggtttggtatcaggctcccagcgcctcattggcccccactggtgccttttctccccatatcgctttgtgtccgtgaacttggcctctccccagaggctggggcaggagcatgtaggcctgggcccaggcacacaggggagtgccaggcctcctggactggccagacagatgcacagttgtccctgggaccctgataccaagcctagcatgtgtctgatgaaattggggtttcactgggctgttgctttgctgcctcctgggaagcagagagggaccccccgcgtcaactgctggaggctgagctccttgaagctccctggctgtcaccccttcttgaccaatgcccggcattctcagacttccctggagccaccgacttctctgtccctcagctccgggaatggcctgaatgccagcgacatcatgagagccagctggggtcctaagtgcccctgcccaccccctgcaccccacgctgtcccccaggggcagcccatttttggatccacttagtcacagtgcctctatgcgctctcgacgagccactgcctccactcagcaggacgcgccgggctcccccaacccgcgccaacgccgcgggcctggttcccagggcagcacgctttggccaagcagctgaaatgcctcccagtgggcagtctgtgcttgcgcgaccacagtgtccccagcgctccgggttgccagggaatttctgcttgagcccctctgttcttagtctggaaaagcccacatttgctgcttaagcttcttcgattagaaaagggagggggaaaacagtccaaacaggttggaaaacgctcgtcctagagccaggtgtcatggacatgaatgttagaggactccgcacaccttggctgtctgtctgtgcaatgacaaccccccgtggcccttctgtaactacaccccagaccgagcccacacccccaaaccccagacctctttgatccgaagcagcttccggggcaaatgcgggcgcaggctcccccatgcatggactaatcagatgactctcgtttcttctcttctctctgtctcctgtcctgcgtgtgtggcctgcactgtccctgggtgtctttctgcctcatcctgccctccgcatgacccaggacggggctcttcacccccgacatggcctttgaagccattgtgaaaaaacagattgtaaaactcaaagagccgagtttgaagtgtgttgatctcgtggtctcagagctggccacggtcataaaaaagtgtgccgagaaggtaacaggttttgttctcatctccgcatttgtccccgtcctccccctccatgtgttagtctcaacccgagcatctggaaaattcagcctcggcaggaacccccttccgcctaccagttgtcacttagagatgtcgccaccttgcattggcagatggaatggggggagtggcatcacacgtgggttgtggctgcccgtgggggcggtcagcctttgttgttgccaaacgcattgcatttactaagcagtgccctttcctggaacccctagagaaaggggtttcccagccagcaccaaaacagcaaaacacaggaaacacatcatctgtatagccctgcatgttctcacagtctaggccacctgagagtaaccattccattttccccgactcgtggacttgacccacactgcagaagatgggactcccctgtgcatgaggtctggttaagttggtgctgcagatgaagcctggggaggtgggggcatttggcgagtgtgtgccacagatacagtgatcaggagtggttctctgcaaggagttcctatcgaggctgatggcccagatacccgccttaccattctagaacagacgctactcactcacgctggcgaggcccttcagggttcctgctctcacccagtgctgggcaagaggggggtgccctgaagccctgcatggcaaacatgcccctgcttttctgctttcatgttgcctcctgcctcctgccccccggtcactggctggaaaagcagctctgctctcctgctgtctccggtccacggtgcccccactcttctgctcttagctcccagctggactcactgggggccaggagcaaggtgtgggctcggtgggccccctcatatctcattccccacccccctccgcattttctacctgtgtggttcatgttgcttcccgtgccacgaggaccccgccaatgcgaccactctgcttgttcccccagctcagttcctacccccggttgcgagaggagacagagcgaatcgtcaccacttacatccgggaacgggaggggagaacgaaggaccaggtactggccttttgtcttctttattgggtataatttacatgcagtaaatgtcaagtgtactgttctgtgcatgctgacagctgcatatggcaaagtaacccttacctcaatcaagatacagagcggttccgtcacctcctaaaatccctgtccctatcatgctgacagctgcatatggcaaagtaacccttacctcaatcaagatacagagcggttccgtcacctcctaaaacccctgtccctatcatgctgacagctgcatatggcaaagtaacccttacctcaatcaagatacagagcggttccgtcacctcctaaaatccctgtccctatgcccctttgtagtcaacctctcaaaaacccacaggccaggctgggtgtagtaactcacgcctgtaatcccagcacttagggaggctcaggcaggaggattgcttgagcccaggagttcgagaccaacgtgggcaacatagcaagaccttgtctctacgaaaacataaaaaaattagccaggcgtggtggcgcatgcctgtggtcccagttacttgggagggtgaggtgggaggatcccttgagcccacaagatcaaggcttcagtaagttatggtcgtgccatcgccctccagcctgggagacagagcgagaccccgtctcttaaaaaagaagcagcaaaggaaatccccaggccctggccaccaccagcccgctccctatcctacagtccttcaagtggactcccacaacgtaaggcccattgactcttgactcccttcctgccacccttcttccctccctccctcccctcggcgtctgcatttgggagccaagcgtgttgtttgttgtatctgtagtttgctgccttgattactaagcaatcttccagggaatggatggagcacagcaaggacctccacttgcctgctggagggtgtttggggtgctttttgtgttgtggttttttgtttttttttttttttttgagacagagttttgctctgtcgcccaggctggggtgcagtggcacgatcttgactcactgccacctccacttcccaggttcaagtgattctcatgcctcagcctccgaagtagccaggactacaggcacatgccactttacccacctaatttttgtatttttagtagagagagattttcactatgttggccaggctggtcttgaactcctgacctcaggtgatctgcccgccttggcctcccaaagtgctgggattataggggtgagctaccacgcccagcctgctttttctttttttaacatttaacgctttcttgcaaaggcatgcaagcacacaccccaagttgctgcctacccctcagctgagactgtcacccacgaagcactgggccgtccttatactctcctgcagccgcagcctcagcctcccaagtagctgggactataggcgtgagctaccacgcctggctaatttttgtatttttagtagagatgaggtttcgccatgttggccaggctggtcttgaactccttagctcaaatgatccacccacctcagcctcccaaagtgctgggatgacaggtgtgagccactgctcccagatctgttttgagtcactttctctcagttgtcctctgtgttctttttacaactgtttgttgaaaccagagcttaattaagcccttgcttgctatgtcactttgtttaaaatggtccctctccccttgccattgatggggatgaaatgggctcatttgtcctgcagggaggcgcccagttttgatttggccaattgctccctcagggcaccagtccacctatgcctcatagctgctgtagcttggaaattgtatcaaaagtctggaagagtctgattctttttgttgttactgttggtaagaatgctgccggcccttccacagcccctggtgcccacctgccatgctgccaggccggatctgagagcgctgggttgaggagactcaggccttactaaaccagccacgctcgctcccacagatggag

SEQ ID NO: 14737 - DNA, 16629 bp, Human
aaggcgggggtcagaagtgggatgtgtgtggagctggggcaggatacgggcaaccagccaggacagatggacctcccttccctccctctactgccctctctactccaaatccccagggccacacgactcttctgtgatgtgtataatcctcagagcaaaacatactgtaagcggctccaggtgctgtgccccgagcactcacgggaccccaaagtaaggttttccctcagctcctcccattttgcccctcctccctgcctcgctgtcccacattcatcccttccttcctcacctcacttttccttcactttttcctctcagcttccctgctgcttcaccctccattcctccttttccatgcctcctcaccgttccctgaaccctccattcttttccttctccctccttgagcccccattcctattctcccttatcaccgctattcatccccccaacctggcctccttgcaggtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtggtaggtttctgtgcggttttggtgctgcatgtggtaggtttccatgtcggacgtggccggggcaggcggggctgcaggtgttcctgcttaggactcctgccgctcccttggcagtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaaggaagctgtctccacattgctgcggttgcaactgttccagacttctggataagatggggggcgcctgcaccccgcgagagcccagggacccacattcccagcctcccacgggcagagggtctacgcagcgcgccttcagtgtggtgacaccgcccatgcatgctcctgtctcccacccagagctgtcgtccgctgtggacgccaggccccgccttttccccacaagccccacgttgaggatccgcctcctgcaggggcgcgccctcccgcgtgcctcagtttacctgcggtgtggcaccgcccctttccccgccccgcgcgctcccacagctgttcggcggggaggagggagcgggacacgacccccccggggttgatgttcggagggacccacgaacacaggatagaccccagcgagaggtgggagaggagagcgccggcagggccagggagtgcgcaggcgcgaagcagcttccttgccgcgttcggtatcggctgtggagaccgcgggagggaagggagggcgcaggcgcaagccctccccgaccgcttcccttcaggttgaggctggaaagcgcatgcgccagctagatgggcagcgaggagagccgcaactgccagtccctcgaaggggttagctgtcgttgaacgtcagcacgcagatgcaactggctctcggcaggggggcgcgcgcaccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggtgagacagccttggggctggacgtggagagcgctcaggcggaggatgggaaggaattgtggctcagaacgctgacggggaggaatgaagggccctcaggccgataagggggaggaatggcggcgtcggaatactgacgaggagaaatggggggatttaggctgaggacgggaaggaatgcagctctgaactctgacaggtaggagtgtcgggatcctgggacgaggacggagaggaatggtggagatcagaacgctaaagggagacatcggggcatctgaagttgagagagaaatgggggttcagaactctgagagggagaaatgaggggccctcaggctgatgacaggagaaatagaggctttggaatgctgaaagggaggaataggaggccccatatagaggacgaggagcagtaggggatcagaatggtgacagttagggatggcatgatcccgggacaagaacagagagaatggaggagggttcggaatgctgaggggagaaattagggtctctctggatgataagggaggaatggaggatgagaacagtaaggaggagaagtggggaactttttggctgtagaggaaggtttgggagctcagactagggagaaattgtgggtgagaacattgaaggagaagaaaaataaggggggaggtcttgggctgaggaaggggaggcatgggaggcttccagtgtgaggaatggaaaagatgaggggctgttcaggctatgggttggagcagttgtgtctcgcagaggaagtcgaagttgtaacactgaggtagcaggataagaggacatcaggcagagaaggaatggagtggttaaaacactgaaggagggaaattaggaactcctgggtcaaggaaggggggaatgagagactactgaagtcaagtagtgagggcaagagaaatggggccctttggggctgaggatggggactatgggggtcttggggtgataaaatagagggatagaggcccttaggtcagtgacagggaggaatgagggggaaggatgaaaagtttctggattggcagtgaggagaaatgatgggttgtcagtctgaggatagagaggagtaggggattaggacactgagaataagaaacagggatccttgggttgaggaatgatgatatcctaggcccagaataggaaagaatggggtgagaatatgaggggtttcttttccatatatgggctggttgcctgtggcaggtcctagggcttgggcaagcactaatggataccagtgatttgtgtggcctggggcacagtgttgtcccttcctagagcctcagtttccctcatcccttccaccccctttcaggctactgctgcttcctgtggcctccatggctgaggactggctggactgcccggccctgggccctggctggaagcgccgcgaagtctttcgcaagtcaggggccacctgtggacgctcagacacctattaccagaggtactgggtgggtagtgggcagagtcaggagtggggtagagcctgattctggtaaaatcaaatggtgtggttaaatttatggatgaagtttaaattatgcacatacagttaatccttattagcggattttatgtttgaatttcacctacttaataaaatttatttgtaacttaaaagtcactactcacagtgcatttgtgattattcaagaatacgtacagagcagtgaaaaactgtcactcaatgcatgtatttctagctgaggctgaaggagcccttttcagctttaatactgtaaacaggtgtccttttcgtggtctgtttagtgtcacatttttctaatttttgtactttttggtgattttgctttttaaaatggtccccaagcatagtgctgaggtgctgtttagtgttctgtgagaagactatgtcgtgctttatggagaaaatacaaggcagataaactttgctggttatctgagttacaatgctgttggctgtaagttcaatgttatgcatcagaattatggtacaaccagaaaaagaaggaaatttgccaatatgtgcacaaagctgcttcagaaagtacagaaagcatttatagtcttgaagctatgtaagagatgagaaagcagctacattggtgggttcatgaaatgacgatcaataaagcatagttgacagcattgttgaggaaagccaaagtcatgttaccctgggttaggaaaatattaaggttatatcagctagtgctggctgacttgcacatttcaaaaggcgacatggcatgaaacatgttaaacctgcatgcaatgcaggttctgctgatcaggagtcttccgaagaattttaaaaatacctgttaagtgttgtacaggaaaggggttgtgtggaagagtggttttcaatgtcaatgagattggcttgttaaacaagaatattggcaaaaaaccttacagaacacatacggcctccaagtcccctggtttgagtcattcaaagaccatgcaaataatcatttgtaaaaaaaaatatgtattaagtaatgtgtgtttaaacagaaacacacacaaaacaaaagttcagatgctctcaggaacctaaccctgtatttcttctaggagcaatggttttgtattcaatgttcatgatagctttgtagaacgtaactaccataactaatgagagtcaacatagatgtttataagcatttacatgtgtttaagaaacattattaagtttctatattctttctgattttttaaatctaagttgctatctttccaggtaaatatcaaattacaaattactttttgtttatatttagttataatttattcacatatttatgtacttgtataaaactttcaaaacttaaaagtgcagttgtcaagaactataaagaacctgagatttcattcttaggacaagataatagtgaatttgtcagaattttgtagatgctggtaggaggggtaagactcctgggttacagatcaaagacagtttattacaacagttgcaggatccagaatacagtagtctcccccttatctgcaatttcattttccacagctttagttacctacagtcaaccaccatccaaaaatattaaatggaaaattttagaaataaacaattcattagttttgaattgtgtgccgttttgagtagcgtgatgaaatctcacaccatcccgctcagtcctgctcaagaggtgaatcatctctttgtccatatccgtatccatatccatgttctagacacaacctgcctgttagtcacacagtaaccatctcagttatcagatagaaaaaacacagtacatattacattagggtttggtactatccacggtttcaggcatccactggggaacttgggatgtatcccctgcacgagagggggaattactgtattactatttttgtgccagtttctgaatcccaattcctacagcatgacgtgaagagggttgtattattataggaaaagaaccgtgagcttagagaatcaggtttttttttaataatattaagacagtaagtatgctttccctttggaaaaagtatactttcccttcctcctatggaaggagaccctatctcttatcttccaaggttgtttgctttacaaacatccttggaaagatagtttatcaaaaaggacaatcgttgtctctcttgcagggcatacaaaaatgcaagaaacccatgggggtcccaaaatcaattacttatactttaatttgtatgtagttgcatttgtttatatgtttttaaaacatatttgtgttttctttacttgatatatacttggtacataatgctaacatttatatgttatatttgtgttatatatatataacacaaatataatatatttgtgttcctatttgtgtttatttttacttacatgaaatagttccagtattactagtattatatgttgtaaatatgttcatctgtttacatttatattgtttctaatgtttctatatgtgttggtatttatattaatttttttatgttttcaaggttagttgaggtggggctgggcagggctcacaagccaattccaggctgcctcctatatcctgccagccctgtcaaaaggttgtatgagtgaaatggcattggctccacctgggtgctaacccatcatggcccatccctagccccacaggagacaggatccgaagcaaagttgagctgactcgatacctgggccctgcgtgtgatctcaccctcttcgacttcaaacaaggcatcttgtgctatccagcccccaaggtacttcacaacatgagatacctaggtaggggtggatgtgccacccaacacccaaccactgacccatattcctccttcccttactttccaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgagtgttggtctaaggtgagccagatgggtgagggttgtgattgggggtgctcttggagccccacacctgcctttcccatcccaggtgctgtgagaactgtggaatcagcttctcaggggatggcacccaaaggcagcggctcaaaacgttgtgcaaagactgtcgaggtgagtggcctccagaggatggggcatcgggagataggagctggagcaggtccagtgtcatgctaggctggggtttgaatgtggatgtcaggacagaggctactggcatggttggaggttggatattggagatagcaggcataggtagaggttgaatagtggaagtcagggcacaggcagtgagtgaagtcagatgtctgttgcttcctttccacttttcttcttccctcttcctccccacagcacagagaattgccttcaaccgggaacagagaatgtttaaggtaagcacaacctgcttcctcttcacaactctgcagtgggagcaggatgtgatggagctggtagagtctgaagggatgatgatgggtccacaggatgaagagtcattttatagggtgctctccataggtcagcagacacaataatgggaattaatggggtaattaatccccattaccattagtgcatcagtagacacagtgatgaagtgaacaggggaccagtagacatactaatggcctcagtgatggtgactaaccagaccttctcagatacggtgatgaggctaatgggggactaaaattcatggtgatgccagctgatgtagggtcagtagacatgggaggaccagtgcttctggagcaggcccgtgatctcgtccctaccattcctggcagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaagggtgagttgggcaagtggaaagagcccaaggctcacctcggcccctggcccccatgggcttggccccatgcttcatgcctctgctcccacctgccccccgccaacagagccgagggtgtggagtatgccggggctgtcagacccaagaggattgtggccattgccccatctgccttcgccctccccgccctggtctcaggcgccagtggaaatgtgtccagcgacgttgcctacgggtgagttgggctggagggagcagagctcattctgctgttaaaatcgtcgctgcctctgcttcctttcaacctggccttgcctacctcatgtctttcttttctgcctaaccctatgctcgcctttctggccccgcctacctgcctctgtctgccagcaccttgctcaccgcctgcgtcgccgtcatcagagatgtcagcgacgcactcccctggctgtggctcccccaactgtgagtgcctcacgccaccctctgtctgcctgtcccatgcatgctttctgcacttagggtgtggggagtttctgtgtctgcctggtgccaccaagctgaaaccaccctttctgatctttcccagggtaaacatgcccgccgcaagggaggctgtgactccaagatggctgccaggcggcgccccggagcccagccactgcctccaccacccccatcacagtccccagagcccacagagccggtgaggccccagtgggtggagggaaggcacaaccctgaccttacccagtacctgccctgaccccaccccatttgcctctacagcaccccagagccctggccccctcgccacctgccgagttcatctattactgtgtagacgaggacgagctagtgagtggccccaccctacctggataagcctagaatctcaggacgcttggttaacttcaaagaagcagatgctggaatgagcctattggggaacagcaaggcacaataatgggtcctaggatgggatgagtagataatggaggactaatacggggtcagcaggtgcatgagagtgcttcatgtcacatataccaacactctggtagctgatgtggggattgacagaggagcagctagcatagtgactggggttcacctaggatgagcgacagagtaggcacagtgatgggagctaatagagagttatcaaaatgttgctggaaatgggggtcagagacattttcttggtagctagtggtggcctaggaaatacagcagtggatactgtagtggagcagccacagtcctaatggtatcgagggccagctggcacagtgatagtggccaatgttgaactagcgaatgctgaggagtgactagtggggagtcaggaggctgagactagtatgcaagtagctccgtcttatggggctagaggagcaccaggaccagcactggaataggcgttgaggatggcctctcctagtcctagttgacagcaccacccattccccccaccccagcagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatggtgggtggggcaggaagggtcaggtggacgggataggttgggccaggcgccccagtgcctggaagtggtgggcaggcttggtaggtgggtgggtggggcagtagctttggttgaggattaacagacattgttcttggcttaatgagtctaggtggcattggtgttgctaataggagactagcaggctcagtgatgaagggctcatatgtaagcagattccgtgctgggactgatgggagattagcaggcatgtggagccgggcagggtggatgtgattggtcaggacaccaggtagccatagcaccctatctttccccatagaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggtgagggccccaccctgtcctgccttcccagcctcacccagctgcatgccagggagctgagaccaagtctgctgcaatcctccctcacgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggtgggggcagtgatggatgttctgttggtgccgtagcggagtggtctgtaagcagagtgatgatgagccatgatggttctcttgagcagagcaatagatgtgctgattgcgacgtttctgcagaattaccccgcctgtctaacagacaccctacctcccacaggcaactagctttgcccgctttgctatccagctaacagaaaaacggaggtcagtgaggaatgggaatgggaaagctttgtaggcagagagatggactttctgtgttgaaatgtgatggaagtaggatttgtcagcacagtgaggggttggctgatagagactttcctcaggtgaactctgcccttctaatggttgcctgtttcctacttctcccaggcagtagacccaggcctgccttctgtgaagcaagagccacctgacccagaggaggacaaggaggagaacaaggatgattctgcctccaaattggccccagaggaagaggcaggaggggctggcacacccgtggtcagtgctggggatgccccaccctgccctgaccctgctgtagccccaacaaccacattgacctatggtgttaattcttctctagatcacggagattttcagcctgggtggaacccgcttccgagatacagcagtctggttgccaaggtgtgccccacacagtgaggggtggggaaggagtgggtgttggccagatgtgggccctgagttttgaaagtatagccggcagtttggcatggtgtggtgggaggtaaaggcccatacccactatgctggtcacaattaatgaggggcgtgtgtgtaggaccctagagatttctcctgagatccagcccaatagcattccaggttaggactctcctttgggggtaggggaaagacttggtactctatcatgagatttgaaagaaaaagatagggagtctggtccctattttcctaaggaatttctataggggtcagctttaatatataaattcttattcagagaataatcatttgggtcttgaaggcctttagagtctccaggagacctctgggtgggctgttgcctgacattgagcaatgtgtaccagagaaatggtgctgggcttgcctgggcagtggtatgggcaggagatctgggttccgagctggctttgtgagctgggttcacacgtagttgtgtgatctctggttgccctgcacttcctggagcggcctctgtggaagggcttgggctggatctcttgagcctttcctgagcctattgaggttattaacttcagatgccttgcagaactgtccctgtagtcctggcatagaacaaagggtagatgcctgtaaggactagggtggttgggaggacagaggagtgctggctcctgcagaatattgacagaccctgcatagagccccagacactggcgatgtaaactattggcctaagcacttggattcctttgctcctacaaaccagcccaccaggctagaaaccctttcatctatacttggccaattacagaagtattgattgagttcctgttgggtgcacagcattgaggacaatgagccctgcaaagcttacccttcaggagacacaggatacctaccttcagggagcttataatctgactatgtacaagctgtctataatggtagtttttagaagatataaaaaaagataaaggataattaaggggaagtggatggaggacacagaatagtaggaaatggttttgtaatgctccattgcgcacatagcaaacctcattcaacatacagacctgctcccttttccctaggtccaaagaccttaaaaaacctggagctagaaagcagtagactggaggcttctacagactgtaggattcaaggtgatatttgcagactggctttatgagagacaacactgatctactaggggctggaccctagattggttgccagggcttgtgtgtgaatcaaccctaggaggaaaaacctactaccaaaccagaagagcaggcctaagagtactttgagcttctagaagaagtaagcgggaaaggaagagaaagagtagaaagttggtgcatcttctcctccccaagagcctgagtataagaagttggattttaagggtgggggagctgggttggagaaaggtaatataattaaagccaccacaaaacaacctaaacaagccatgttcatgagtaattgtaagtggcttctggatgagacctggcagtgtctctacatacttcctcagggagatagcaattgaaaatgtaattgaataaataaggaaaggaactgctatttggtgtgttcctctgtggacccagtttatttaatccttaaaataatatttttgggaagacattgattttgtccatttatgtggatgggaaaactgagactcattaatttgtccaatgtcgaacagctggtgttagtagagcctagactcaaacccagcttttaaagcccttgttctttactccactaaactgtaacctgtaatcctgtatgcactaacaggagttttcggtgaccttgaaaacacagattactataattactataataaatcccttacattcctgtctctagcatggtttagggagtgccaaggctcaatgtagatggggtcaccttgtcagagcatctgttcatacagaaactgggtttcctgcagaccccaggtgctgcataggattcctcaaaccctacaggatatatctccccactggctgctgtccattttgcttgttaccctgactccccctcttcagccagagcagtctttgtaactaaagctgccagcctggctcatctttcctgacaacgtgcatctcctgccctgtgatcacctttgtgcttggctcctgccctcagcctgaatgtgttctaggaggctgaattcctgcttcgagtcctgcccaagagccagtcttggctcagccctacctcactctctcccaattcttcattcataaagtgccaaaaagattagacctgtaatttgttagccagctttacagggccaggactgagtgagtgcctccttaaactttgtatcctgtgtgcctcccttgccttaccctagtcccagccctgcagctttaagtaattcagacatggattagccatttcccagttctgtctcatacagtccagcctctgccaccttccccaccccttcctttattccatcctaactagttcagccctagtcaagactggatagactgatactgctttgtttcccccaggaaccaaccacccaaccccagtattctggtaattttgacaatgatctatatgaaatttatttgattgacatttagactcatgagttaagcttctgctgaccatttatgttagggtacaatcagaggagcagaaccactaagataaagattatgtatatatgtattttaagggatttattatagggatctgaccgcatgccattgtgggagctggttaaacagtctctgtaaggctgttgtctttgcatctaatgctggagcttgaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccacttacttacatgcttagtgtttcttttgggagtggtttggtgggaacagtgttgactgcctctgagaaactgggatagtgggtgggaagatcaaatcaaggtcacttctttccaaggaccctgagcgattcacttacctaggccgcgggggcggggggttggctgaaggctgaggctcttggtgctcagcactggccggacaccttcaacctgctggtgggtccgccagggggcgccggggcgagaaagcccgtagttcccagccacagtcacccaccggggccctggaggcaccgctcgtcacccatcacccctggcctggccgccctggggcgtggtctccgtccggcgcaaaccccagtacttgggctagggccagagggaagctgagtccccctcttcaaatagtggtaaaacaggcaaaaccgaaccggggttaaatttcggagctcgcccagggtgagggcggggctcgacgacctaggacgttcgagtgcggccgggtgtcgccaagggtcggtttaccccatcgcctcagaaattccgacgaggccctttgggctgcacaaccttgggaatccccaacgggcggccccgaatctgcgccgattttcccaagccgtacttcgggcccaaggcgttttcattgccgccttcccggaggatgtgtggtgggggtggttccgcccggaccgacgggcgggcccggagcccgttggactcgaagatcaaagaaccgcccctctggacactccaggaaaccgagacgaccacctaatttgtttgttttctgtttcaggccacgtaaactcttagtaaatgcaaatgcgtattttactgaactgcaattgaaagaaccgttatagaaaagaacacaaaatgacagaattattaaaagagaagaaaaacattatttcgtggctgaaaagctgaaccagcaattcaggaaatggaattcgtatttagaaacataccacatacaaaatccgaagtgggtggtttacaaatgattaaggaatgctaatttacagtaaattgcgtccttaagagggcatacacattagttgtacttattatatgtcagtttgacgtaggtactgatttgttgcatgtgctcacaagtgttctatgctcacccccactttagaatgggagtatcacagtgtcattcttaattggcttttaggtattaccaccttgctcttgactggaaatgcaactgtggttaccacctgtgctgcaggtccgtcctggttccctgatttgtgtttcctgttctgcctggatcctgattctcagaaaccagttactggacttctgatccacatcctgaccctggtccactgtgaccctcagactcttaattatgctccaccaggtcgtgccactgccccactagtccatttgatctgcccccatcctaggatatcctgagtctaagccctggtttctgccaatggcaaataggaagattttattaacaggttttaaaaaattattattattactggttatttggtttgacaaggcacttaggctccctgagctttgccttagctggaaaataaggatagtattacttgctattctatcaaccctgtaagatatttgcggccacgcgcggtagcgcaccctgtaattccaacactttgggaggccggcgggaggggcagtggggaggatcgcttgaacccaggagcaggagttccagcctgagcaacatagcgggaccccctgtctcttcaaaatttgtttttaaattagcagggcgtggtggcgcaggctttgtagtcccagatactctggaggctgaggcccaggaggacgaggctgcagggagccatgatcacgccactgcactccaccctgggcgacagagcgagaccttgtctcagaaaaaatctgtgaggttaaaaggctgtgtgtgtgaaaatatcttggaaattgtaaagaactacacaaatataaggttttcctgtgattattaccgtcatcaagattaa

SEQ ID NO: 14738 - DNA, 16629 bp, Human; identical to SEQ ID NO: 14737

SEQ ID NO: 14739 - DNA, 16629 bp, Human; identical to SEQ ID NO: 14737

SEQ ID NO: 14740 - DNA, 16629 bp, Human; identical to SEQ ID NO: 14737

SEQ ID NO: 14741 - DNA, 16629 bp, Human; identical to SEQ ID NO: 14737

SEQ ID NO: 14742 - DNA, 16629 bp, Human; identical to SEQ ID NO: 14737

SEQ ID NO: 14743 - DNA, 16629 bp, Human; identical to SEQ ID NO: 14737

SEQ ID NO: 14744 - DNA, 16629 bp, Human; identical to SEQ ID NO: 14737

SEQ ID NO: 14745 - DNA, 16629 bp, Human; identical to SEQ ID NO: 14737

SEQ ID NO: 14746 - DNA, 16629 bp, Human; identical to SEQ ID NO: 14737

SEQ ID NO: 14747 - DNA, 16803 bp, Human
gggggacagatttgttgtctgggtggtgtcttgggagggcatgcagcgcacatccacagttccctccatttgtgctcatccctccagtatgagagccagacgtcctttgggtccatgtaccccacacgcattgaagggtaagtgagggtgccacgcagtgagaggtggggggttaaggcgggggtcagaagtgggatgtgtgtggagctggggcaggatacgggcaaccagccaggacagatggacctcccttccctccctctactgccctctctactccaaatccccagggccacacgactcttctgtgatgtgtataatcctcagagcaaaacatactgtaagcggctccaggtgctgtgccccgagcactcacgggaccccaaagtaaggttttccctcagctcctcccattttgcccctcctccctgcctcgctgtcccacattcatcccttccttcctcacctcacttttccttcactttttcctctcagcttccctgctgcttcaccctccattcctccttttccatgcctcctcaccgttccctgaaccctccattcttttccttctccctccttgagcccccattcctattctcccttatcaccgctattcatccccccaacctggcctccttgcaggtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtggtaggtttctgtgcggttttggtgctgcatgtggtaggtttccatgtcggacgtggccggggcaggcggggctgcaggtgttcctgcttaggactcctgccgctcccttggcagtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaaggaagctgtctccacattgctgcggttgcaactgttccagacttctggataagatggggggcgcctgcaccccgcgagagcccagggacccacattcccagcctcccacgggcagagggtctacgcagcgcgccttcagtgtggtgacaccgcccatgcatgctcctgtctcccacccagagctgtcgtccgctgtggacgccaggccccgccttttccccacaagccccacgttgaggatccgcctcctgcaggggcgcgccctcccgcgtgcctcagtttacctgcggtgtggcaccgcccctttccccgccccgcgcgctcccacagctgttcggcggggaggagggagcgggacacgacccccccggggttgatgttcggagggacccacgaacacaggatagaccccagcgagaggtgggagaggagagcgccggcagggccagggagtgcgcaggcgcgaagcagcttccttgccgcgttcggtatcggctgtggagaccgcgggagggaagggagggcgcaggcgcaagccctccccgaccgcttcccttcaggttgaggctggaaagcgcatgcgccagctagatgggcagcgaggagagccgcaactgccagtccctcgaaggggttagctgtcgttgaacgtcagcacgcagatgcaactggctctcggcaggggggcgcgcgcaccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggtgagacagccttggggctggacgtggagagcgctcaggcggaggatgggaaggaattgtggctcagaacgctgacggggaggaatgaagggccctcaggccgataagggggaggaatggcggcgtcggaatactgacgaggagaaatggggggatttaggctgaggacgggaaggaatgcagctctgaactctgacaggtaggagtgtcgggatcctgggacgaggacggagaggaatggtggagatcagaacgctaaagggagacatcggggcatctgaagttgagagagaaatgggggttcagaactctgagagggagaaatgaggggccctcaggctgatgacaggagaaatagaggctttggaatgctgaaagggaggaataggaggccccatatagaggacgaggagcagtaggggatcagaatggtgacagttagggatggcatgatcccgggacaagaacagagagaatggaggagggttcggaatgctgaggggagaaattagggtctctctggatgataagggaggaatggaggatgagaacagtaaggaggagaagtggggaactttttggctgtagaggaaggtttgggagctcagactagggagaaattgtgggtgagaacattgaaggagaagaaaaataaggggggaggtcttgggctgaggaaggggaggcatgggaggcttccagtgtgaggaatggaaaagatgaggggctgttcaggctatgggttggagcagttgtgtctcgcagaggaagtcgaagttgtaacactgaggtagcaggataagaggacatcaggcagagaaggaatggagtggttaaaacactgaaggagggaaattaggaactcctgggtcaaggaaggggggaatgagagactactgaagtcaagtagtgagggcaagagaaatggggccctttggggctgaggatggggactatgggggtcttggggtgataaaatagagggatagaggcccttaggtcagtgacagggaggaatgagggggaaggatgaaaagtttctggattggcagtgaggagaaatgatgggttgtcagtctgaggatagagaggagtaggggattaggacactgagaataagaaacagggatccttgggttgaggaatgatgatatcctaggcccagaataggaaagaatggggtgagaatatgaggggtttcttttccatatatgggctggttgcctgtggcaggtcctagggcttgggcaagcactaatggataccagtgatttgtgtggcctggggcacagtgttgtcccttcctagagcctcagtttccctcatcccttccaccccctttcaggctactgctgcttcctgtggcctccatggctgaggactggctggactgcccggccctgggccctggctggaagcgccgcgaagtctttcgcaagtcaggggccacctgtggacgctcagacacctattaccagaggtactgggtgggtagtgggcagagtcaggagtggggtagagcctgattctggtaaaatcaaatggtgtggttaaatttatggatgaagtttaaattatgcacatacagttaatccttattagcggattttatgtttgaatttcacctacttaataaaatttatttgtaacttaaaagtcactactcacagtgcatttgtgattattcaagaatacgtacagagcagtgaaaaactgtcactcaatgcatgtatttctagctgaggctgaaggagcccttttcagctttaatactgtaaacaggtgtccttttcgtggtctgtttagtgtcacatttttctaatttttgtactttttggtgattttgctttttaaaatggtccccaagcatagtgctgaggtgctgtttagtgttctgtgagaagactatgtcgtgctttatggagaaaatacaaggcagataaactttgctggttatctgagttacaatgctgttggctgtaagttcaatgttatgcatcagaattatggtacaaccagaaaaagaaggaaatttgccaatatgtgcacaaagctgcttcagaaagtacagaaagcatttatagtcttgaagctatgtaagagatgagaaagcagctacattggtgggttcatgaaatgacgatcaataaagcatagttgacagcattgttgaggaaagccaaagtcatgttaccctgggttaggaaaatattaaggttatatcagctagtgctggctgacttgcacatttcaaaaggcgacatggcatgaaacatgttaaacctgcatgcaatgcaggttctgctgatcaggagtcttccgaagaattttaaaaatacctgttaagtgttgtacaggaaaggggttgtgtggaagagtggttttcaatgtcaatgagattggcttgttaaacaagaatattggcaaaaaaccttacagaacacatacggcctccaagtcccctggtttgagtcattcaaagaccatgcaaataatcatttgtaaaaaaaaatatgtattaagtaatgtgtgtttaaacagaaacacacacaaaacaaaagttcagatgctctcaggaacctaaccctgtatttcttctaggagcaatggttttgtattcaatgttcatgatagctttgtagaacgtaactaccataactaatgagagtcaacatagatgtttataagcatttacatgtgtttaagaaacattattaagtttctatattctttctgattttttaaatctaagttgctatctttccaggtaaatatcaaattacaaattactttttgtttatatttagttataatttattcacatatttatgtacttgtataaaactttcaaaacttaaaagtgcagttgtcaagaactataaagaacctgagatttcattcttaggacaagataatagtgaatttgtcagaattttgtagatgctggtaggaggggtaagactcctgggttacagatcaaagacagtttattacaacagttgcaggatccagaatacagtagtctcccccttatctgcaatttcattttccacagctttagttacctacagtcaaccaccatccaaaaatattaaatggaaaattttagaaataaacaattcattagttttgaattgtgtgccgttttgagtagcgtgatgaaatctcacaccatcccgctcagtcctgctcaagaggtgaatcatctctttgtccatatccgtatccatatccatgttctagacacaacctgcctgttagtcacacagtaaccatctcagttatcagatagaaaaaacacagtacatattacattagggtttggtactatccacggtttcaggcatccactggggaacttgggatgtatcccctgcacgagagggggaattactgtattactatttttgtgccagtttctgaatcccaattcctacagcatgacgtgaagagggttgtattattataggaaaagaaccgtgagcttagagaatcaggtttttttttaataatattaagacagtaagtatgctttccctttggaaaaagtatactttcccttcctcctatggaaggagaccctatctcttatcttccaaggttgtttgctttacaaacatccttggaaagatagtttatcaaaaaggacaatcgttgtctctcttgcagggcatacaaaaatgcaagaaacccatgggggtcccaaaatcaattacttatactttaatttgtatgtagttgcatttgtttatatgtttttaaaacatatttgtgttttctttacttgatatatacttggtacataatgctaacatttatatgttatatttgtgttatatatatataacacaaatataatatatttgtgttcctatttgtgtttatttttacttacatgaaatagttccagtattactagtattatatgttgtaaatatgttcatctgtttacatttatattgtttctaatgtttctatatgtgttggtatttatattaatttttttatgttttcaaggttagttgaggtggggctgggcagggctcacaagccaattccaggctgcctcctatatcctgccagccctgtcaaaaggttgtatgagtgaaatggcattggctccacctgggtgctaacccatcatggcccatccctagccccacaggagacaggatccgaagcaaagttgagctgactcgatacctgggccctgcgtgtgatctcaccctcttcgacttcaaacaaggcatcttgtgctatccagcccccaaggtacttcacaacatgagatacctaggtaggggtggatgtgccacccaacacccaaccactgacccatattcctccttcccttactttccaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgagtgttggtctaaggtgagccagatgggtgagggttgtgattgggggtgctcttggagccccacacctgcctttcccatcccaggtgctgtgagaactgtggaatcagcttctcaggggatggcacccaaaggcagcggctcaaaacgttgtgcaaagactgtcgaggtgagtggcctccagaggatggggcatcgggagataggagctggagcaggtccagtgtcatgctaggctggggtttgaatgtggatgtcaggacagaggctactggcatggttggaggttggatattggagatagcaggcataggtagaggttgaatagtggaagtcagggcacaggcagtgagtgaagtcagatgtctgttgcttcctttccacttttcttcttccctcttcctccccacagcacagagaattgccttcaaccgggaacagagaatgtttaaggtaagcacaacctgcttcctcttcacaactctgcagtgggagcaggatgtgatggagctggtagagtctgaagggatgatgatgggtccacaggatgaagagtcattttatagggtgctctccataggtcagcagacacaataatgggaattaatggggtaattaatccccattaccattagtgcatcagtagacacagtgatgaagtgaacaggggaccagtagacatactaatggcctcagtgatggtgactaaccagaccttctcagatacggtgatgaggctaatgggggactaaaattcatggtgatgccagctgatgtagggtcagtagacatgggaggaccagtgcttctggagcaggcccgtgatctcgtccctaccattcctggcagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaagggtgagttgggcaagtggaaagagcccaaggctcacctcggcccctggcccccatgggcttggccccatgcttcatgcctctgctcccacctgccccccgccaacagagccgagggtgtggagtatgccggggctgtcagacccaagaggattgtggccattgccccatctgccttcgccctccccgccctggtctcaggcgccagtggaaatgtgtccagcgacgttgcctacgggtgagttgggctggagggagcagagctcattctgctgttaaaatcgtcgctgcctctgcttcctttcaacctggccttgcctacctcatgtctttcttttctgcctaaccctatgctcgcctttctggccccgcctacctgcctctgtctgccagcaccttgctcaccgcctgcgtcgccgtcatcagagatgtcagcgacgcactcccctggctgtggctcccccaactgtgagtgcctcacgccaccctctgtctgcctgtcccatgcatgctttctgcacttagggtgtggggagtttctgtgtctgcctggtgccaccaagctgaaaccaccctttctgatctttcccagggtaaacatgcccgccgcaagggaggctgtgactccaagatggctgccaggcggcgccccggagcccagccactgcctccaccacccccatcacagtccccagagcccacagagccggtgaggccccagtgggtggagggaaggcacaaccctgaccttacccagtacctgccctgaccccaccccatttgcctctacagcaccccagagccctggccccctcgccacctgccgagttcatctattactgtgtagacgaggacgagctagtgagtggccccaccctacctggataagcctagaatctcaggacgcttggttaacttcaaagaagcagatgctggaatgagcctattggggaacagcaaggcacaataatgggtcctaggatgggatgagtagataatggaggactaatacggggtcagcaggtgcatgagagtgcttcatgtcacatataccaacactctggtagctgatgtggggattgacagaggagcagctagcatagtgactggggttcacctaggatgagcgacagagtaggcacagtgatgggagctaatagagagttatcaaaatgttgctggaaatgggggtcagagacattttcttggtagctagtggtggcctaggaaatacagcagtggatactgtagtggagcagccacagtcctaatggtatcgagggccagctggcacagtgatagtggccaatgttgaactagcgaatgctgaggagtgactagtggggagtcaggaggctgagactagtatgcaagtagctccgtcttatggggctagaggagcaccaggaccagcactggaataggcgttgaggatggcctctcctagtcctagttgacagcaccacccattccccccaccccagcagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatggtgggtggggcaggaagggtcaggtggacgggataggttgggccaggcgccccagtgcctggaagtggtgggcaggcttggtaggtgggtgggtggggcagtagctttggttgaggattaacagacattgttcttggcttaatgagtctaggtggcattggtgttgctaataggagactagcaggctcagtgatgaagggctcatatgtaagcagattccgtgctgggactgatgggagattagcaggcatgtggagccgggcagggtggatgtgattggtcaggacaccaggtagccatagcaccctatctttccccatagaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggtgagggccccaccctgtcctgccttcccagcctcacccagctgcatgccagggagctgagaccaagtctgctgcaatcctccctcacgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggtgggggcagtgatggatgttctgttggtgccgtagcggagtggtctgtaagcagagtgatgatgagccatgatggttctcttgagcagagcaatagatgtgctgattgcgacgtttctgcagaattaccccgcctgtctaacagacaccctacctcccacaggcaactagctttgcccgctttgctatccagctaacagaaaaacggaggtcagtgaggaatgggaatgggaaagctttgtaggcagagagatggactttctgtgttgaaatgtgatggaagtaggatttgtcagcacagtgaggggttggctgatagagactttcctcaggtgaactctgcccttctaatggttgcctgtttcctacttctcccaggcagtagacccaggcctgccttctgtgaagcaagagccacctgacccagaggaggacaaggaggagaacaaggatgattctgcctccaaattggccccagaggaagaggcaggaggggctggcacacccgtggtcagtgctggggatgccccaccctgccctgaccctgctgtagccccaacaaccacattgacctatggtgttaattcttctctagatcacggagattttcagcctgggtggaacccgcttccgagatacagcagtctggttgccaaggtgtgccccacacagtgaggggtggggaaggagtgggtgttggccagatgtgggccctgagttttgaaagtatagccggcagtttggcatggtgtggtgggaggtaaaggcccatacccactatgctggtcacaattaatgaggggcgtgtgtgtaggaccctagagatttctcctgagatccagcccaatagcattccaggttaggactctcctttgggggtaggggaaagacttggtactctatcatgagatttgaaagaaaaagatagggagtctggtccctattttcctaaggaatttctataggggtcagctttaatatataaattcttattcagagaataatcatttgggtcttgaaggcctttagagtctccaggagacctctgggtgggctgttgcctgacattgagcaatgtgtaccagagaaatggtgctgggcttgcctgggcagtggtatgggcaggagatctgggttccgagctggctttgtgagctgggttcacacgtagttgtgtgatctctggttgccctgcacttcctggagcggcctctgtggaagggcttgggctggatctcttgagcctttcctgagcctattgaggttattaacttcagatgccttgcagaactgtccctgtagtcctggcatagaacaaagggtagatgcctgtaaggactagggtggttgggaggacagaggagtgctggctcctgcagaatattgacagaccctgcatagagccccagacactggcgatgtaaactattggcctaagcacttggattcctttgctcctacaaaccagcccaccaggctagaaaccctttcatctatacttggccaattacagaagtattgattgagttcctgttgggtgcacagcattgaggacaatgagccctgcaaagcttacccttcaggagacacaggatacctaccttcagggagcttataatctgactatgtacaagctgtctataatggtagtttttagaagatataaaaaaagataaaggataattaaggggaagtggatggaggacacagaatagtaggaaatggttttgtaatgctccattgcgcacatagcaaacctcattcaacatacagacctgctcccttttccctaggtccaaagaccttaaaaaacctggagctagaaagcagtagactggaggcttctacagactgtaggattcaaggtgatatttgcagactggctttatgagagacaacactgatctactaggggctggaccctagattggttgccagggcttgtgtgtgaatcaaccctaggaggaaaaacctactaccaaaccagaagagcaggcctaagagtactttgagcttctagaagaagtaagcgggaaaggaagagaaagagtagaaagttggtgcatcttctcctccccaagagcctgagtataagaagttggattttaagggtgggggagctgggttggagaaaggtaatataattaaagccaccacaaaacaacctaaacaagccatgttcatgagtaattgtaagtggcttctggatgagacctggcagtgtctctacatacttcctcagggagatagcaattgaaaatgtaattgaataaataaggaaaggaactgctatttggtgtgttcctctgtggacccagtttatttaatccttaaaataatatttttgggaagacattgattttgtccatttatgtggatgggaaaactgagactcattaatttgtccaatgtcgaacagctggtgttagtagagcctagactcaaacccagcttttaaagcccttgttctttactccactaaactgtaacctgtaatcctgtatgcactaacaggagttttcggtgaccttgaaaacacagattactataattactataataaatcccttacattcctgtctctagcatggtttagggagtgccaaggctcaatgtagatggggtcaccttgtcagagcatctgttcatacagaaactgggtttcctgcagaccccaggtgctgcataggattcctcaaaccctacaggatatatctccccactggctgctgtccattttgcttgttaccctgactccccctcttcagccagagcagtctttgtaactaaagctgccagcctggctcatctttcctgacaacgtgcatctcctgccctgtgatcacctttgtgcttggctcctgccctcagcctgaatgtgttctaggaggctgaattcctgcttcgagtcctgcccaagagccagtcttggctcagccctacctcactctctcccaattcttcattcataaagtgccaaaaagattagacctgtaatttgttagccagctttacagggccaggactgagtgagtgcctccttaaactttgtatcctgtgtgcctcccttgccttaccctagtcccagccctgcagctttaagtaattcagacatggattagccatttcccagttctgtctcatacagtccagcctctgccaccttccccaccccttcctttattccatcctaactagttcagccctagtcaagactggatagactgatactgctttgtttcccccaggaaccaaccacccaaccccagtattctggtaattttgacaatgatctatatgaaatttatttgattgacatttagactcatgagttaagcttctgctgaccatttatgttagggtacaatcagaggagcagaaccactaagataaagattatgtatatatgtattttaagggatttattatagggatctgaccgcatgccattgtgggagctggttaaacagtctctgtaaggctgttgtctttgcatctaatgctggagcttgaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccacttacttacatgcttagtgtttcttttgggagtggtttggtgggaacagtgttgactgcctctgagaaactgggatagtgggtgggaagatcaaatcaaggtcacttctttccaaggaccctgagcgattcacttacctaggccgcgggggcggggggttggctgaaggctgaggctcttggtgctcagcactggccggacaccttcaacctgctggtgggtccgccagggggcgccggggcgagaaagcccgtagttcccagccacagtcacccaccggggccctggaggcaccgctcgtcacccatcacccctggcctggccgccctggggcgtggtctccgtccggcgcaaaccccagtacttgggctagggccagagggaagctgagtccccctcttcaaatagtggtaaaacaggcaaaaccgaaccggggttaaatttcggagctcgcccagggtgagggcggggctcgacgacctaggacgttcgagtgcggccgggtgtcgccaagggtcggtttaccccatcgcctcagaaattccgacgaggccctttgggctgcacaaccttgggaatccccaacgggcggccccgaatctgcgccgattttcccaagccgtacttcgggcccaaggcgttttcattgccgccttcccggaggatgtgtggtgggggtggttccgcccggaccgacgggcgggcccggagcccgttggactcgaagatcaaagaaccgcccctctggacactccaggaaaccgagacgaccacctaatttgtttgttttctgtttcaggccacgtaaactcttagtaaatgcaaatgcgtattttactgaactgcaattgaaagaaccgttatagaaaagaacacaaaatgacagaattattaaaagagaagaaaaacattatttcgtggctgaaaagctgaaccagcaattcaggaaatggaattcgtatttagaaacataccacatacaaaatccgaagtgggtggtttacaaatgattaaggaatgctaatttacagtaaattgcgtccttaagagggcatacacattagttgtacttattatatgtcagtttgacgtaggtactgatttgttgcatgtgctcacaagtgttctatgctcacccccactttagaatgggagtatcacagtgtcattcttaattggcttttaggtattaccaccttgctcttgactggaaatgcaactgtggttaccacctgtgctgcaggtccgtcctggttccctgatttgtgtttcctgttctgcctggatcctgattctcagaaaccagttactggacttctgatccacatcctgaccctggtccactgtgaccctcagactcttaattatgctccaccaggtcgtgccactgccccactagtccatttgatctgcccccatcctaggatatcctgagtctaagccctggtttctgccaatggcaaataggaagattttattaacaggttttaaaaaattattattattactggttatttggtttgacaaggcacttaggctccctgagctttgccttagctggaaaataaggatagtattacttgctattctatcaaccctgtaagatatttgcggccacgcgcggtagcgcaccctgtaattccaacactttgggaggccggcgggaggggcagtggggaggatcgcttgaacccaggagcaggagttccagcctgagcaacatagcgggaccccctgtctcttcaaaatttgtttttaaattagcagggcgtggtggcgcaggctttgtagtcccagatactctggaggctgaggcccaggaggacgaggctgcagggagccatgatcacgccactgcactccaccctgggcgacagagcgagaccttgtctcagaaaaaatctgtgaggttaaaaggctgtgtgtgtgaaaatatcttggaaattgtaaagaactacacaaatataaggttttcctgtgattattaccgtcatcaagattaa

SEQ ID NO: 14748 - DNA, 16803 bp, Human; identical to SEQ ID NO: 14747

SEQ ID NO: 14749 - DNA, 16803 bp, Human; identical to SEQ ID NO: 14747

SEQ ID NO: 14750 - DNA, 16803 bp, Human; identical to SEQ ID NO: 14747

SEQ ID NO: 14751 - DNA, 16803 bp, Human; identical to SEQ ID NO: 14747

SEQ ID NO: 14752 - DNA, 16629 bp, Human; identical to SEQ ID NO: 14737

SEQ ID NO: 14753 - DNA, 16629 bp, Human; identical to SEQ ID NO: 14737

SEQ ID NO: 14754 - DNA, 16629 bp, Human; identical to SEQ ID NO: 14737

SEQ ID NO: 14755 - DNA, 16629 bp, Human; identical to SEQ ID NO: 14737

SEQ ID NO: 14756 - DNA, 16629 bp, Human; identical to SEQ ID NO: 14737

SEQ ID NO: 14757 - DNA, 154600 bp, Human
aagagttgctgtcatccttgacaatttgagtggtggttacggtgactctgttacattttcaatgaagtaagatgctttttacttttaaagccatccataaagatattgaaaggggctgcccttcagaattcttaatgcagtggagcctctaagtctgactttagacagtgagagatgcagagattagcaccatgtagaacactcactaggtacttagttctcactgcatggccagagcccagttctaagttctttcagggacacataagcaacgtaaggcacagccagtccttgatcacaacaaacttacagtttgtagtgatgaaacccaaaactcaggggtgcacaatattctagggcatgtgtaagagcttgattgtgaggaattccaaagaagagggaagtgagatcaacagtggtcaggaaaggacagacttgagccaaacctggacaatggtatctaggtgagtttagggagggaaggtaggctttcctgtggcaggagttcacctgggtgagtgggtgagcttggcactgcaggtggatgtgttttgtgatgctgatgtcacagccccagttgcagggaagtactttcaggtggtcctgcaggctgtgactctgctcctgtgaccttggctttcaccctcatcctccctagcacttccagtgtctgccaaccagcaggctcagctgctcccacaggtcccaagggagccagcccacatgggatgagggcacgccgtggccggatcctgaacatgtatggttgaatcattctttgcaccgtccagttaaggtcctggttcgagggctgaatcaaccttcacagagccagcctactggtcccatccctctgctgcaacccagggcttccttcttcctcttcacaaagcgctctgccctatcttgtggttctgcaggtccccaaaggaactgaccagaactgggctcagaagctctatgaccggcactccagcagccagcacttccagaagccccgcatgtccaacacggccttcatcatcgtccactttgcagacaaggtggctctcctctctgttggcttgggtattcccttggcccctctctaagtagactcaatgggctctagacctagagagaaatctgtcccttctgaattcaaatggcctgaagcctcagctaggttccccttccatcctcttttacccacccctctacttctaggggataccaagcttaccacaaggcataacttcacagggggtactatagttgcccagtcattcatatatatatatgaatacacacacacacacacacacacacacacacacacacacacatataaatacatacacacatatatgtctgtgtatatatatagtctatacacacacacatacacacacacacatgtctgtatatatatagtctacacacacacacacacacacacacacacacacatatatgtatatataaattctaaagcagttaacagtctaccctcatggagcttgagagagaagggagggctgtaaacaaagtaccaaatggtttggcttcttacctggagcctgtgtagctgctcttcagggggctgctttctcagtagctggtgggtgcatagaatttttctaagtggatttctgtttgctatgcactagctcggtgtttcttaaattgcagtgtgtgtatgaatcacctagggtcttgttaaaatacagattgattcattgggtgtgaggtgtggctgagaagctgcatttatagatccctgaagaaaccttttattatgggaactccctttaaaacaatttcttccacaaaatgaatactcagttccctgtatgtaaatcctgaccatttattgggtttgcattttaagtggaaacatctgtgggtttcctatctactcacagctcttttcagaaaatgctacctggatgagatgaaagtggttgagaaactgctgaagcactaacgactgtgtctctctctggttgctgtggccccaggtggagtacctctctgatggttttctggagaaaaacagagacacggtgtatgaagagcagatcaatatcctgaaggccagcaaggtaaagagtgtcagaagtggggagtggagcaggaatgcccacggccagtgctggacagggagtggtgatgcaacctccttggggtggaaagacagagatgctgggcagggaggaggccaacgggtttgttggtcatttcggtatgaaaacagttgaatggccataccactgtgaatgtgtccaatcttgtctgaaaacactttagtatggcctgatggagggaagaaagcaaggagtgtaggggtagggggagaaaactgggaaagatgcctgctaatggaggggataggggagcatgggaggtgacaggaagagaggacggtgagcgcagtgatggaaatgtggctggtgtccatcatgtcatctgtcctccgtctcctgcctgcagatgtaagattatttaaaccccatcacatctagtatctgcatttaatttgttcagcagtctatagaacctctctataagcagaaacttaatggaatagaaggtgggatttaaggaacacttaaatctactactttggactctttctctgttattatcagaatttcatttatttccaagcataggaaaaaggtagcaaatattgtgtccattctacaggtagaggaaagaaggcaccaattcacccaaacatatatttactaagcacctgctttggaaggcactgccctaaacacaccattttcacacaaagatgagcaagacagagtctgcactctggttgctccccttctaatgggctgtgagtgggcagatgaagacacacacaggtaactgtgaaaggagagaaggagcacggggagagggtggtagagtcaggggaagcgtgtgcactggcattctaaaagccgactctgatgcagatgccgttactggctttagccctgcagaggaaacccagggccgggggtgggggaaattcccaggatttaggaggctttctcccagaccacatgatactgaactcactgcaggggcctgataacattggagaaatggcagattaatttctctttgtgataagctttagatgaatgcaataggatgagatgatagaatggagaaaatatatccagcaaaatggacccaggacataaagccaagtaaaccctgttctatcacgtggtgaggggtttagggaggatttgagtcagtagcagcatgcagactgccaagaacagacccctgcccagtgtgatctctggatatctggaacatcagagaattagtcatcactgggacaaattggccgtgggtaaaagtgaatatcactttggagttcaatgcaagattgaccttgcagctccctaagtttttagatctccagtctgtggtggttaatgtgactttttccattttttcatgaggatggtggcatagggaggagccccaaggcacagggaaagagagtagatggaagtgttctgagcactaggatccccttcctcacgatggtctcttacgatgcctggaggcctgtgacaacttatagggccagaaaactctgttgtctcagtagaagtttgtcctttcagattagaagcagaaacgagggatggagagaagagaggtgggtacttttcatttaatacagagtctggttctgccattgtgttgatttctgagcatcttaatttgagtgactctcagggattccagaatctaaaaaggagtggtgcccggaaaactctgttatattcactctccagcaggttatcttttattaatagctgagctgcttttcccttatttttatttatcagctttattgaatatttgtgtagtatatagtggtaaccgacacatgtagttaatctcatggaacttagtgaaaaagatgcacagtttaattacaaactgtggtaacgctaagaaggtcaagaagaaggtgctatggaagagaatgataagggtaggttggtggcccccaagaccacccccaggttcaaccatttgctaggaagattcacagaacttagcatatagttatggctataatttgttacagcaaaaagtaaacagcaaactcagcaaagggagaggtggatggggtgacatctcccggagaccaggcacaagcttccaagagtcccttccacctggagtcatacaggatgcacgtaattccccctagaagcaagtcatgacacttcttttgacatgcctaccagggaaggtcacctgagcccaggcggccagggtttttatttggggttgattatgtaggcacccttagcctagcacaaaccaaaattccaaactcccagaaggaaagcagatgctcaacataaattattgtttgcgtgaacaatttaggcacagtgaactgttcttatcagggaatggtaaaaatccaagttcccctgacaccagccaggggtcaagcagcctttctaaggatagcagatgcaggcctgctgtgttagctcttttctatacaagaatattgttttagattgcaggtactgggtttttattagaaattaaatgtaagctcataaaaaattaaagtattgtagaaatatataaaataagtcttctttcccactccttgacccatcttttgatgggtcagaatataccctattctgcatgttggtacatctttttaagattaaaataagtacattatagacacgtagtcctctgtaatttaatttttcagttaccattgtatcttggttgtctttccacacgagtacacatctatttctcttttttaaacaactgctgataatttgctatttcaaataatgtagcaatgaatatcctttatgtatatctttgcatacttctgtacaattatgtctgttgggtaaaattttagaagcagattgatgatggttcaaagagtatgcacatcaaaagtgtatagatgttgctaagttggaggacaaaataggtgtgatctactcttgaaatgcaacttcctcctcctctttcctgcccactaaccacaatgctagctttccccctcaccagctaaaacgtctaaagagccagtgacctttttgccacccctgtccccatcccagcaacaaccctgagatgtggtgatgttggctggcagcactgagattaaccaagaagggctctggctaaccagaccctagctggaggagggcttgagaactctctaccctgagcccctcctagcctgtttcagacgtctcaaaagacagaaaacaaagattgttgctgtatcaccataaacctgcagatgggctatacacagactgcagctgcaaatcaaagagtgattctaagtatgctctacaccatttgggcagatgggcatgtctggcagcatctgtcattttagtatctttaaagctcatcatttactgagtgatgagtctattttctttaaaatttttagttttcatagtagccctatgaggcatatgtttctaactccatattaaagaaaaatgaaaacctagaaagatacaaggttctatgtcattacattaaaattgtaacgcttaattttttattggttttcatttagcacagctaaatctcaaatcctgtttgtaaattcataattttacctaaagtacttttattttatgagagactttttttttctgttgggtgacatccttgataagaaattaacaagtcatcatgaataattaagcagtaggggatagaagacacccatatactctaccaaccaaagggatgttcgaagaactcccactacgagcagtgaaataacagggtgttaatgagaatgtaattagtgaagccagttccattgtctgagcggttgtaatgtagctaattgctttctcagctatcggagctgtaaatagagacttaagtaaagagatgcctctttaaaacatgacttcaagttattaacagagtcattttctttaaatactaaaggatggaggttttcctttttttttttttccagttttccagtttttatttattgtgaaaaggaataatttatcaaccaggagaaaaagaaaactttaaaaggagaatgtttttcctctgaagattgcctattcctggccaccactacatgtaggtcagagggacaagctgtgggtcacgtgtttgtgccagcatgtgctgggcagtgagggtgtactgggcagtatttctgggctatgggacaggcatcccagtgccatctttccactctatcccagcataagggatcttgagatgaatgtggtccagagaccaccttggcccaaagctacttaccctgagttcatgaaccctacacctccttcccagaattaattttccaacaaactcatccacctctgaatctcagagatcctaccacttccaagtgcagtctcaatgacagggacctacaattaaaacctagattttaaaataaaatacaaattcaccagactgaaccttggtcatgttggtacccaaattacagcacaggagtcgcaggaacagctcacacaaggcccaggtgttcactccccttctccctcctgctgcttatggcttgacttcagcttgtcaaggaatgacaagtacacacgtccattgctttccacactgatgtgtttttaaaaggttatatacacacaccttgttttgaccaaataagtttgctttttaaaaatcttatgtttacttttaattttttaacttattttctgaataggagcttgagataataaacatactataaaatgttctcaaatgtactttgcttcctgtttaagatgtgctggtatttgaaaagcttctaccaatacttaaaccaagcagggtactatgtaggataactttttagttgacaaaacaatatcgtctcccttatgatacaggagagtccatgttgtcttccaaaaaaaatgaagtactgagacttttcctccaaagcctatttaaaacccttttaaaatattcatctaaatgtcagagatttttccctccaaagggtaccattagtcatgtaaaaagaattgattgaaaggaaaatgtgtttattatgtttacagccatagatttctttttaaagaaaagattctggggaagagacaccagtcaaactgttcttatactatgtcttattttaactttatgtgtctgtttcagaggaaatatcttttatattcttataaacacaaacgagtaggtgtgatttccaaggtaacagctatgtgtcagctgtaattgactttttattttattttattattattatactttaagttttagggtacatgtgcacaacgtgcaggtttgttatgtatgtagatagcattaggaggtatacctaatgctaaatgacgagttaatgggtgcagcacaccaacatggcacatgtatacatatgtatacatatgtaacaaacctgcatattgactttttttaaactgccaaatggcctttacaaagttttttcatgcttcttagtccctttttgatttgccccaggcttttaaaagctatatataggaatgaatagcagagaataccaaagccagtccctatgtacaggttttaaacaagtgacaggaaaatattggtttgtctggaggtgctagcttgagtgtttgagttcgaaggggacaaattgtgagaaatgcccgggtggctgccctaaggtaaattgtggcagctctcttactgctcagtcagcttataaacagactgcttaataactctaaacacataattggagtttgtcaattgccctgatctgattactatacactatatatgtcaaaactaggtaccccatgtatgtacagttattatgcgtcaattaaaaaataaaaatttaaaaacttattttcactcagaaatgtgatcctttgtatgggtcctttgtcaagtaagagcttggtgactacggctgggtgcggtggctcacgcctgtaatcccagcactttgggaggccaaggcaggcggatcacaaggtcaggagatcgagaccatcctggctaacatggcgaaaccccatctctactaaaaatacaaaaaattagccaggcgtggtggcgggcggctgtagtcccagctactcgggaggctgaggcaggagaatggcgtgaacctgggaggtggagtttgcagtgagctgagatcgtgccattgcactccagcctgggtgacagagtgagactccgtctcaaaaaaaaaaaaaaaaaaaaagagcttggtgactacttttcattgtgactctgggcttgtgtatagttgggacacttctcaggtgaggtatccttacgtagcccaatcttcttaagggatgggtgtggatggaaccagtaatttgtatttcttgcctgggtcttttgcggatgtctacagcccagcgttgaacatggtatctcttagtctttcagtcctgtcatcaaactagatctcttatgttcatttgagtttataaaacaaattttgaatagaatacgaagcatactgtacctccttttgagaactaatattccaacacagtcatctccctctaaatcccagatcctgccacttccaaatgcagtctcaacagcaggaacttaaacgaaaacctagcttttcaaataacatacaaattcttcagactaaaccttgattatgtttgtatccagattatagcacagtgccagcttaggtacaaatctgccttggacagtttttactttctgttcttaagttacaaagtccctgtttaatgtataaaattaaaagcatagatagcctttgtaatggaagcaggagaaaggggctgaaatcttaaaattctcccattggtgattctgatttccaagttcctagtgtgatttttcatacagatcaagcatcacaaatctagaatgctctaaaatttgaaactttttgagcaccaatatgacactcaaaggaaatgcatctacggccataccaccctgaacgtgcctgagcttatctgatctcagaaactaagcagggtcgggtctggttagtgcatggatgggaggaaatgctcactggagtatttttgcattttggattttcagattagggatgctcaaccagtaagtataatgtaaattctccaaaatctgaaacacttctggtctcaaaattctcaaattttgaataacggatactcaatctgtacctgttaatgaccttagggcttaatatttttttttttacagtaaaagctactatgaatgatttctgtaaatttaaccccctccccactacccaatagtatagttatgcagattggtaacttctacccatgcctcaaacatcttgaaaattcacttcagaaagtatatgaattagaattatttaataagccagtgttttgctttgccatgacagacaggcatgaatcacaatgacatcttcaaaatgtgaacctgcctccagcctcccattatttccccatggagctttctcagcaccagtctgacgggccactttgtcctttcttacctgtgtcttggctctctggccctggtccatggagcccccaggcccagctctcctctcctcctctcctcctcccctcctcccctcctccagcccattctgctcctgccactctcagtgtttagttcacctgaacactgttcatctatggctttctgccatagacagtgaggacaaacaaatgggcctttaacatgtggctactggataaggtttgcatccagagaaaactctggctgttggttggaatgtgtttgggtgaaggtgtgcccggaggtatgccctcacgctttcggtgactgtagtgatccaggagagagctgggtagtcctgagctggagcagcagctccagctccagattaatgaaaaaaaaaaggactgcatgatactcccctgtgggcagaacttggtacttgattgagatataggaagtagggtgaggacaggattctagcctaacctaggaagtcagtgggtgaaggtggtttgggctgtattgaattcggagttcccagtggaacacctagaggaaagaagagcgagctggaattgtgaatcatagtaacaggaaaagatccagactggagtggcaggatctgggagggatggttggagccatggcctaggggagactgtccccagggactgaggtaagtggtgaggatgaggctctggaaaatggcaatgcaaaggacggaagtgcaggaaaaagctccgtgggaggttctgggaagggtgccgggcagggagaagattggaggaagcagaactgctaagtgtcaggaagggacctttacaaggaggcgtgggccagtggcacagaggcctttgaagaggtcgggtaggatcaaaaatgaaagcacaccacttctagccattggacttgacaagcactggagttgctttcaaggtacatttcagcagcatggggaggaggccatctggtggagggaggtctgaggaggagcggcgtggaaggcggtgtctgtctgtggatgccttgctcgaggtgatcgatggtaaagtgagaagagagacaggctgaacagggaggggtttgaagcaacagagaagcttgaacgtagctgtatgcttggtggatagaagccaggggatggagtgattcaagtataagaaaatgcaggaatccaggtcagggagtgacttaaaggaatcatctggtcagctcttccatttatatagatgagcaagttaaaatctagtaagcctgagaggtttgccatgggccacacggctatcaagttgcagggtcatatctaaagttcaggtctcctgacccagccccatgcccttcctgctatacctcattacttctgagctcactgctaggttgtaagctcttctggtctccctggtctcccttgactcctctaggcacccaggacagggcttcatgtgcagtgggctcttccttatgctgtagccagggatctgtttagaaagaactgccattgctggttctagtcattgccgttctctgtggtgcattgttgcttggactctggagacaggctgtctgggttcaaatcctgactatgctacgtacagctctgtgatcttgggccctaagtctcagtttcctcatctgtaaaatagagtgcaatggtgcttacaccactgggaggcttggaggagttcatgtgtgccaggcatagtcaacgtgctcaataaatattagcccctgttattttaaccctttaatggcttcccattgctcttaggataaaaataaaaattcttaactgaggcctacatgagctagtccctcttgcttccttctcactgtgtacattgtacgttgaccagctttatcttagccccccgaatgcacagagctccttcataggtgccattacttccaccccataacatgctgtcctccccatccaatgtcctacagttcagacttccctccctaagagaatcctgtcttcatttcccacatcccagacccccgatttagtcgcatctttgttgttgatttcctttaggatattcatcttcttgtcattatgtttttaattatgggttattttcattagcattcaccttccatgctagaccataaactccatgatatagaagaggctaggcttcttctataacacttttgttttaccagtccctagcacaacatttgttgcatatttgagcgtcagtaagtgttgatggataatgtgtggatgaatgaatgaatgcacaaactagtcaatctagtttcttgacagtcagtgacctagtatttactttctctgctttgactgcacatggaattgagtacctaatacaaatatcggttttttatgatgttggcatatggattttagccacagatcttaaattgtgtttttatttctgacagctcactagttaccttgccatctaaaaagacaatatttatgactttgaaatgccatgcatgaagagagggaggaaaattttttttttaattatactttaagttttagggtacaacgtgcaggtttgttacatatgtatacatgtgtcatgttggtgtgctgcacccagtaactcgtcatttaacattaggtatatctcctaatgctatccctcccccctccccccaccccacaacagtccccagtgtgtgatgttccccttcctgtgtccatgtgttctcattgttcaattcccacctatgagtgaaaacatgtggtgtttggttttttgtccttgtgatagtttgctgagaatgatggtttccagctttatccatgtccctacaaaggacatgaactcatcatttttttatgactgcatagtattccatggtgtatatgtgccacattttcttaatccagtctatcattgttgaacatttgggttggttccaagtctttgctattgtgaatagtgccacaataaatatacatgtgcatgtgtctttatagcagcatgatttataatcctttgggtatatacccagtaatgtgatggccgtgtcaaatggtatttctagttctagatccctgaggaatcgccacaccaacttccacaatggttgaactagtttacagtcccaccaacagtgtaaaagtgttcctatttctccacatcctttccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctgcgcccactttttgatggggttgtttgtttttttcttgtaaatttgtttgagttctttgtagattctggatattagccctttgtcagatgagtagattgcaaaaattttctcccattctgtaggttgcctgttcactctgacagtagtttttttttgtttttttttttttttttgctgtgcagaagctctttagtttaattagatcccatttgtcaattagatcccatttttgcttttgttgccattgcttttggtgttttagacatgaagtccttgcccatgcctatgtcctgaatggtattgcctaggttttcttctagggtttttatggttttaggtctaacatttaagtctttaatccaacttgaattaatttttgtataaggtgtaaggaagggatccagtttcaactttctgcatatggctagccagttttcccagcactatttgttaaatagggaatcctttccccattgcttgtttttgtcaggtttgtcaaagatcagatggttgtagatatgcagcattatttctgagggctctgttctgttccattgatctatgtctctgttttggtaccagtaccatgctgttttggttactgtagccttatagtatagtttgaagtcaggtagcatgatgcctccagctttgttcttttggcttaggattgacttggcaatgcgggctcttttttggttccatatgaactttaaagtagtttttttccaattctgtgaagaaagtcattggtagcttgatggggatggcattgaatctctaaattaccttgggcagtatggccattttcacgatattgattcttcctacccatgagcatggaatgttcttccatttgtttgtatcgagagggaggaaaatttatttcaaagatgctgagaagctgagaataggaacagaattgtcacctgttggcagctaacacttgggggcatccttagtgatctcactggggaaccctccagggtacctgcctgacaacaatatcatcagtatccttagcagggatttgtctctttatctccttccatggagctatttagactctgcatgttgtgaataggattatcccttccatgccctcaagcagggatttgaggtgtgctttgctcagaaatatggtagcattctctagtgctaatcatggtgtcagcagcctattgtagccacagaatagccagcagtgagaatgggcttgggctgctcaccagagatggccttaagatcattggttggtgcttttagactgaacttagaacccaggccagggaactaaggaactgcaacttttatttgcatgcaagtcactctggtggaaaatggaaattggatgcttctaatggttggtgtgtctgtgagaaatgaggagtgtgagggaaaagtgaaactgacacgtgttgattccagcatgattgtccatgtaggtgcacatgaaacacagttgtttcatggctttataacccattagactagctcctgtgctgtgtaaaacaaaacactgacttgtgttaatttctcttgactctaaaactgaagctactaagatgtatgaactttgtaataactaagaatgaggtaagaggaactaatttttttgtatgtttttagtttaaaatgcttgatgtagaagattagcccataattttcaccagcattaggtgctgttttaagcattaggcattgtaaccttgtatgtatgtgcaggtgggcacactcattctaatccactgtgatagtgaagtgttcctgcataaggtgaggcttaagtcttgctgaaaacaaacccttggatccgtggaattcatacaagttgctttatgcttgatcttatccaaaaggcctagaagtgatatgggttactttaatatgtgaaaaataccagagtcgtcagactgaggggggttcactgagcaaagtgtctgcatctctccagtttctccttggacgtgacctgggtagttgctgatggtcttatgcctgccttaagtgaggtcaggttgcaagaagccccatggaaatgggatggtcatcatgtgttttataacccccatcatatcaccctggaactccagcacaaaggtacctaataaggttgcagaaactgcctttgagtgtgcgaagtcacctgaatctgacaggttctgagaacagttctagtatgctaccagcaccatcttgctactctatctggacactgtaatgtgctgatgtgataccatgactctgtactgtcaggtatctctgactgcagaagggagatgagccagggcccactgtagactgtaatgtgaaaaagctcatactcattgccttgttttgatatgcttctaggactttttgaattcacctagaatagtgaattattttgtgaattttgaacctattcttacatgattctttctttccaagctcttggcatgatgctgttgatatgaaagcctttgtaggtactcagtaaatactccactaggctggaacttaatttattgaaggtctcggcagtgcagagcatcaccagagcatgagctgtcactgctatatgggacctgtagccatacatgaagatgatgctgcatcttcagtaggtagcttgccttagcctgaatctcctacaagtctcaggagatgatgtcagctagagaaatgtttcatggaagtgttatcttatgtatttaattgttgttgcaagtacctcaaaagtcaaggctatatctgaagcccttttatatttctacttccttgatattgtgggtttaaatgacaaggctatatttatgtattgaaacaaattctgacctgggcatccggaggccgaggttctagcccaggctcagccactgactagcagccctttgagagctggtgctgaccattgtgcttggtggtggagggaacagaggttggagcaggattccggtaggttccttctccccagtcgcctacatcctcacctgccacatggaggtgaaagttgacctttacatttgttccagatctaaaattctatgttgtttcttcagatcaaaaatacaactttcttaagcatctgtacttacgtggttcagaaagatcattcatgtaggccgggcatggtggctcacacctttaatcccagcactttggaaggccgaggcgggcggatcacgaggtcaagagatcgagaccatcctggccaacatggtgaaaccctgtctgtactaaaaatacaaaaattagctgggcatggtagtgcacgcctgcagtcccagctactcgggacactgaggcaggagaatcgcttgaacctgggaggcagagcttgcagtgagttgagattgcgccactgcactccagcctggtaacagagcgagactgtttcaaaaaaaaaaaaaaaagaaagaaaaaaaagaaggtgttaatgtatataacccctagtaaaagtaataaaactagataatgtctgagccctatatgctgggcacttttctacatgcttacatggattctctcattcagtcctctcctcagcccttgttctcaggaggaagggaagtctcagcaagtgtagagctcaggattcaacacagaccttgagggggtgagggtgtcccaggacaccacagagcctgtggggagacacagacaggagtgatgggtgctttgggagagggtcacgggaggggcagggctcaaccttgagagaggggcctctcaggataagtatagaagagaaaggggtgggggtatttcaagtaaaaatagcacagtaagcaaaggtatagaggcaggagtagtgagcattgtgcctatgagacagcaacgtgaccagttggatggttttgcaaggtattgtctgagaggggtgagtgggatctgatcagggagtcctcagacactagactagggagttcagacacaatggcaggagaggggagccatgcacttaagtgggggttaaaggaagagggcacagggtaggtgagaaggagcagagcctagcatctgaggctgtagcatttagcctctcttctgttgagattggaattgctcaaggttagtgaatggggcctgtatgttccttttccctccctccttttcccccaacccctgcaggagtgtggtaaaagccttgtaatactttattctagccccagcattgacttccccaagggatgatgacaggactgtgttcctgtcagactgaacttcttgatggctgggactctgtcaccagcgcctcatccaaggcctgcatcttcaccttgttacagatgaagatattaacctcttatttagtattcataacaaccccatataacaggcataggcttatccctattctgatgagaaaacaggtatcagggaagttaacttgacaagatgcaataatgtagaaaaatagaacttaaacttaggtgtattaaagcatagccacctcctaccacaccacaaggaaatgaagttctgcgcatctttgcaggtgaagattgagtaagattgtatgggaaagcaacttttttcctaccatttaaaaaattgaattgtcattcatacattacaaaattcacccttttgaagcacacaattcactgggtttcaggatgttcaccaatttatgcagtcatcaccactaaaagtctgggaatatttttattactccaaaaagaaatcctgtcccccttagcaggcactccctttctccccttcttccccttcctcttcccctttctcccccaacccctagcaaccaataacctactttctattccctggatatttcatgtaaatggaatcacacactatacgaacgtttgtgtctggctgctttcacttggtataatttttttgaggtgtgtccatgttgtggcatggatcaggaggtcatttctttatattgaatttattaataatgttgaataatccattgtatggaggtaccacatttgtttgtccattcatcagttggtatttgggttgttcctaccttgtggcgcttttgggagtaacgctgctgtgcaggttggtgtgtgggttttggcgtggacgtgtgttttccgttctcaggtatatgttgaaaagcagctttgagaggaaacatgtaaggtgcaggagatgtcactttcatcattcttcctgtgattgtttctagttcccactagtggctgacttgtttcatgatgacaaggaccctgttcctgccaccacccctgggaaggggtcatcttcgaagatcagcgtccgttctgccagaccccccatgaaagtctccaacaaggagcacaagaaaaccgttggccaccaggtcagccccggaccaaaagctatgggccgaggtgcatgtgcagggctggcctctctgtagatgaaggatggcggcagggtgagagggaagccatcacagcagccttgacatcagtagcctcagccatccagctctatcttgtgtccttagaagaaggaaactccaataccttcaccacaaggaactaacagagggaggagggaaggggccgaccgtagcctccataagtatgttaacacctgtggtggggctgtgccacagggccaaagacacctagtgtgggaggcaagagggcctggaatttataggttagagaggaggcttaaggaagctgtggatcaggagactaaaagcaacttctcctgctgtggggtctctgtggctgttctgcccattgtgtctctggagagaagagaagagaatgcttgtcaagtccctggcagccaccacctaacatttgttcctatgagtttgccattctggacatttagtataacaaattatttccaggatacccgggcatcggatgtcagggtcccaggccctcaggtttaggaagagcaggcttccggtgcacagtgaccaaatctctcctacagtatttgcccacctttcatcttatttgatccacagcactgggagttaggcacattagggggtagtctgtcccccatgtaattcaaggaacccttaaataggaaggacttgattttggtcacagcaagatagcagtgtcagagctggaatcttaccccaggtctctgaaatttcttccatccttctggattaataatataatagtaacaataactaccgccacccatatatgagtttttctttatcacacatccacgacttgttaaaactaaccaagcactggcttttgtctctctagttccgtacctccctgcatctgctcatggagaccctgaatgccacgacacctcactatgtccgctgcatcaagcccaacgatgagaagctcccctttcagtaagtgcctgctgggcattagcctgtccagcccagccttagaggttcaggtggaacagggtggcccaggccttgcctgggggtctgtggccttcagcatgatgaccacctggacttacactccccagacatcttacttgctgcagacagactgacagacacttgctgagtgccaccagtctgctgtccaggaggtcttaagagaaaaaatgccgttccccgtatagtggtggtcaggaatgtgcatgcttgaataaaatagagaacgttaaatgtagccatgagtacatctcacagcaagtgttaaattcaggcttggaaaggttgctggagtggtcaggaaaggcttttcttgtgttgaagaatcaagacctcacatgatgtgttggacgataggacatgaacatggtcctgtttctcacattcccgtctgctgctaagcttccagaattatccacatttgctccccttttcctcactcctcaacctactctgatccaacttttgtttctaccctgaccttgaaactttgttccggttctgtccatgctcatgtggctgacctcaccctaatctgtagaactcttaatgatctttgtacatcttggtttctactaaattccagacaagtgtttgtgcaagcctactacagcttcattatccaccttgccttcagcacatctgagaccacactcttcatctcctgccaccccccaagaatgattcctctttcattggtctttgttgtagtaagaggcataacatttcctgttatctcatccacccatgagacctgatctcccagactagaagtctctctaacctgctgtgcagggggaatccctgtgatgatgggtatgtgctgtcatctgccttatccagtgtgggagctgcttgtcacgcatggctatcgagtgcttgaaacctgtctggtgtgagtgaggaactgaattctgaattttatttcattttaatttattttggataccccgaggtgctagtggccaccatacagcatggtttaacccttgattcttccgtctccttcacttcccagtgtctaactgacgtcaaagtcccatgaagtctccatgcacgttcctcaccctggtctcccttttctcttccttattcaccttgttccagatcctcttttcttgcctgaaatactaccttaaacctttaaaaaacatcctctcactcagctctgcagtctcttctgctctgggccttcacgcatgctgttccctctggccagaggaggtgtatttttaaattttttaagcaccttattcccatctttccttccccatgatttctgtttcgggcctagtataatttctttctgtgaaataacttactttgacaattttgactctcagactgaatatctgaactgccttctacactcgggtcatgtaataaagcttggcttccattcagatgggctctgtgtggaaaaggttaaggagacagaatgttaccagttttctatgcagtgtgctgcttgcttgctcttcccttcctccaaatctctgagacatgcttaggaattgcccctgggtggcttctgtttaccggctgactccagaagagaagaggctgttagaagcgtagtgtgtgtgaaagactcagattctgtgtgaagggcagagtgctgtgcagggcccaggggagaggagatgagggctctataccagctgggccagaccagctgtggccttgggcctttccctcatcagagcgtggccctgctgtgggacagatactctgctgggtctcccctctcaaaggagagaagacactggggactttctagtcctgaggtcccacttttctaagacactgccttatcttcagaaccaaaatcttcctcccaatacaaagaaaaggtgggaggaatactgaccatgtcatgataccgggattctagtttgagctcactgctgatttggccagtcgcaagctagtcttttgctctctgtgtctagtttgagctcactgctgatttggccagtcgcaagctagtcttttgctctctgtgtctcatttccttacctgttaattctggtgagggcctggtgtggtggctcatgcctgtaatggcagtgctttgagaggccaaggcaggaggatcacttgaggcaaggagtttgagagcggcctgggcaatatagcgagacccaacctctacaaaaaattttaaaattagctgggcatggtggtgcatgcctatagtcccagctactccagaggctgaggtgggagaattgcttgagcccaggagtttgaggctgcagtgagctatgattgtgtcactgcactccagcctggatgacagaggaagactatctctcaaaaaaataaaaataagtatcctgatgaaagaatctgaataggaattattcatgagagtatataaatttatgtgattacagttattagttacatcatcctagaaggaagtttctgtgtctctccacccatttcctgtaatcggagttgctcagcctcagcagcactgacatattgagttagagaattctttgctggggcaaggggtgctgtcctgtgcatcataggatgttgagaagcatccttggcctctacccactagatgctacaagcatcccatcattgtgacagctaaaaatgtttttagacattgccaaatgttctcttggggacaaaattgcctccagttgagaactcctgtcccacattaaatgctttgatagcatgacctatacaaaaggctttttcctctgctttcttcatttaagaaacatctatcatacctcttactaggcactgggctaggacaggtagaatgacaataagacatgtcccctatgcttaaggaattgtctgtcacaagtaactggcaatgccacagaagtggctgtcggtggctctgtgaaagtgctgacagggcagaggcaagagagagatgaagtatccagagcagcagcggcctggggcgggtgtcataacctgggaacgcttcgtggaggacctggtcactggttttccgaaggccagcccaggtctcggagtctcagagttctgagatgtgactgcaggatgctgctgagcctggggaagcaggtagggagcttgcagcccgtggagaaatcaattccatggcgggcaattgtggaggtagggctcggttctaacacagtgggatcctctctttgcatccagcaggctccagggtctgctaatcctattgggagaggaaagcatgaacttcagtttcagcactgtgaccttctatgtctttggtgatttttctatgttaattgtccttgctatggtcctccaagatttaatagaaggagggctggttttccattcctagtcacctaatagtgaatgcagtgaggtggattgagagatgcatttgacggtgggttttctttactgttggggagaggaagtacagaaggccagctggcctcacatatccccttgggatatgtgaacagggaaagatgatggcaatatcttctttgtatagtgtctcttagctttttctaaaagcattcttcttgtttttttgtttgtttgtttgtttgtttttgtaacatagtcattacagccaccactgcttcatagttgggcagatatgttgagctctcattgagtaaatgaggaaaatgaggtacagagagactgtgtcttgcccaaagtaacactacctgttagtggcagagcggaggccacactgagttctttgccccagaccacatgggaaagcagtgttgccatcacaggaggacagaacagttgtggcaaagggaggggatttgctgagctggtcacgaagagggaacaatgttaaggctgagttcaaaaactctgtgccaggtgccttctggggaccagctccaggcacgctgtgtggagactctaagagaaaaccgatgtccccaaccctgccctcaaaaactcatgctgtgctgtgtgaggggaggggaccagcaccaagtgagccattgcctggcccttcaacaggaccgaactgggatgccagaggtcaggaagcatgatgtggggataccagaacagagagggaggggacagatggggaggaggagcagtacttttaaggaatgacggggttctcaatgagcttctgctcattttattaataccatgaggaaacagtaggaggtcctggaagaagaagggacctccagctggtcccatagcccatgtgggacctaagggtcccagatgctcctgaacacgctgccatccctggtgtgtgcaatgggctgaacttgaccctgtggtcatgctgagcagaggaaagaagccggtggctggcttggggaacacagctgctgtgggcaggggcagagtgcctggggaggtggtctgcaggccacaggatgccttttccaaagcacaggggtgtccgctctgccttcatgctgcagggcctggctgacagctttagcagtgagagcctgtgagcaggggagcccgcagcccgaaggcttctgatcactcgcagtcatgggcagccgagcagctgcttatgactggtcattgccgcccctggtaatgaagacccccttggatcctggaactgtgcttcctcttgtggccgagcaaccacaggaggcattggagtgagagggtgagcaggcagtgaggtgctcagcacatactccctgctgtcctgtaaggccctcgcactaaggggcttttactctagttagaaagatgaagtcttctgaaggaaatgttttgttcagagctgtgtaaatcagtgttccgttgtgcctcacatgctcagtgccgtgggctgttggagctggaggagtcgggaagattttatggagacgatgggtgtggaaagaaggtggggcttgggagggcagaggggagcaatgaagccacagtgagcacagcctggaggggagagtgtgggtgtctcatgggatgagacccagggctgatgtgcaacgtggagtgttgcctgggttgaggtggcatcttgcagtcatcagttgcttggcaaatgcccactgttttccagtgccaagtgcccactgagcccaggcagctccagggcaccatctgtcaagcaccatgtcccagagtgaaaggaggaaaagaagcatgactcttagctccagctgagctgcaggacagtcagaaggaaagggagcatttgttcctcgtcccttctgatggagtggggcagtaatcttagcaaattaaaaatagtgattaattctaggttgccttaattctttctctatgaagactccctgcttactctagacaatggtgatgtcttgctctctgccttcttttttttttcttactagtgtttttttttgagacagagtctcactctgtcgcccaggctgcagtgcagtggcacgatctcagctcactgcaacctctgcctcccggattcatgccattcttctgcctcagcctcccgagtagctgggactacaggcacccaccaccacgcccagctaattttttatatttttagtagagatggggtttcaccgtgttagccaggatggtctcgatctcctgaccttgtgatccacccacctcggcctcccaaagtactgggattacaggcatgaggcaccgcatccagcccttcttattagtttttatgatttgtgtttaacaacctcagacaattgctctctggcttcttttggcattttcaccatgtttgttatgtactgtcttgtataaaatttcctcttcaagcggggatactcagaaagctcacacagcatctggctttttattctacactgccatactcaatatatgtttaaaaacatactgggttttgagtgctagccttagctttgtaggacatgtgagtggttgaaaatggtgcacatatctctgaagactggaaagtaatctgtaataatgtaaatgaagttcatctacatgattcttaactgaacagctgttgtgatcatagctaacagcatacacaacgtatgtgccctacgcagtgctaggcatggttccacctgctttcagggaccattacatttaagcttcacactaacctgataaaataggtactgctgttttcccccattatatggatgagggtactgaggcccaaggggacatgaagtgacttgccccaaagtagacacccagctggtaagcgaccatgtcatgattgaaacccagatctgcctagtctgaaactcatccttttaatgcttgagccaaataatggggctaagcatatatgcttgggacagtgagtgaagatgcatgcccttgtggataaaaacagtaagagtaggctctggagaggagcaggaatgatgagtcttggagggtggggaggattcgggtgggcaaagaagaagggtatcccaggtgataatgagaatgtgcacaaaagcctcaggcacagaacagaagatgctgagatggctcaggtgcctgcacattggtgtcttttagtctatgcctaatccctgacttgagctcaagggtaactcagtggctgtaactcagtggcagcaggtacttcacatgctgcaggaaaagattcttttttgtttcttttttgcaaatgtggccactcatctcttgtcttgctttttttttttttttctcctttggcagctttgacccaaagagagcagtgcagcaactcagagcctgcggggtattggagacgattcgaatcagtgcagctggctacccatccaggtaactaacgtgcccgccagctgcctcctggggctgccctagagcagccagagtttggttccccagggagccctctgtgtaccgtcggccagaaacagatccttcaaaacggttcccaaacattgaggcccaagcaggatgctgatggaaatgagactctcacattagcctgaaaaattgggaaggttagcagtcacatcctcttggctgcttttctctaaagtccttttcagatttcagatttttggtgttggtctaagtgatgagctagctagagttgcaaggaggatttccccttctctcaattcctaccttgtcccctttaccattcccccaccctttctaacagtaggaaaatatatgtatttaccatcttaactactttttaaattttttcaataggttttttgggggaacaagtggtgtttggttacatgaataagttcttcagtggtgatttctgagatttcggtgcacccatcacccaagcagtatacactgtacctaatgtatagtcttttatccctcaccatcacccccctttcccccaagtcctcaaagttcattgtatcgttcttatgcctttgcgtcctcatagcttagctcccacttatgagtgagaatgtaccatcttttgttttccattcctgagttacttcacttagaataatggtctctaactccatccaggttgctgtgaatgccattattttgttcctttttatggctgagtagtacttcatatatacgtaccacattttctttatccactcattgactgggcgtgtgggctggttccatatttttgcaattgcaaattctgctactattaacatgcctgtgccagtgtctttttcatataacgacttcttttcctctgggtagatacccaatagtgggagtgcagtggcatgatctgggctcactgcaacctctgcctcctgtgttcaagagattcttctgccttagtctcctgtgtagctgggactacaggtgtgcaccaccacatctggctaatttttgtatttttagtaaagatggagttttaccatgctagccaggctagcctcaaactcctgacctcaggtgatccacctgcctcagcttcccaaagtgctaggatgacaggcgtgagccaccatgcctggcccaaatggtagatctactcttagttctttaaggaatatccacactgttttccatagcagttgttctagtttacattcccaccagcagtgtaaaaacattcccttttcaccacatccatgccaacatctattttttgatttttcagttatggccattcttgcaggagtaaggtggtatccccttgtggttttgatttgcatttccctgataattagtgatgttgagcattttttcacatgtttgttggccatttgtatatcttcttttgggaattattttctcatgtccttagcccactttttgacgggatggtttttttttcgtgctactttgagttccttgtagattctggacattagtcctttgttggatgtatagattgcaaagattttctcccactccgtgggttgtctgtttactctggtgattatttcttttgctgtgcagaagttttttagtttaagtcccgtctacttatctttgttttcattgtgtttgcttttgggttcttggtcatgaagtcgttgcccaagccaatgtctagaagggttttcccaatgttaccttctagagtttttatggtttcaggtcttagatttaagtctttgatccatcttgagttgatttttgtagagagtaagagatgaggatccagtttcattcttctacatgtggctagccaattatcccagccccatttatcgaatagagtgtcctttacccactttttgtttttgctttgtcaaagatcagttgactgtcagtatttggtcttatttctgggttctcagttctgttccattggtctatacacccgtttttataccaatatcatgctgttttggtgactgtggccttacagtacagtttgaagttgggtaatgtattgtgtccagatttgggttttgttttgttttgttttgtttttttgtttttgctagtcttgctttggcaatgcaggctcttttttggttccatatgattttaggattttttttttttttagttctgtgaagaaatatggtagtattttgatgggaattgcattgaatttgtagatggcttttggcagtatggtcattttcacaatattgattctacccgtccatgagcatgggatgtgtttccatttgtttgtgtcatctatgatttctttcagcaatgttttgttgttttccttgtagaggtctttcacctccttggttaccatcttagccacttctaagtgtacagtttagtggtattaagtacattccttattttgtgctaccatcaccatcatccatctctagaactcttttcatcttgcaaaactgaaactgcggcattaacaatatttccctattctccctcccccagtccctagcagccacctttctactttctgtaaatctggtgatcccaggaacctcatataattggattaatacagtatttgtccttttgtgagtggcttatttcagttagtataccttcaagcttcatccatgttgaagcgtgtgtcaaaactttcttccttgttaaggctgagtaatattccattgtgtggttataccccattttgcttatccattcattcctcaatagactcctttaacttttgaatatagaatgaaatctgtggtgggaaaataaagtttctttgagttaaaaaataactatcatgctctgatttgccttgcggataagccactgaaccagtccagagcttgttggagctatgccaacattggatcccctctggacacttgcctgaaataggggtgaagggtggctggtgaccccactagctcttgtgaaatcacactgcctaccagcatcatgtagaccaaacatctgccattaattggagctgagctgaacagtgtagcagcccagagcctgtcccactgggaccctctgtcctaacaactcgctcatatcagaaggtggaaggaaccagaagtgggaatggagggatgtgatatgggcctcccctcctccctgtcttctctccacctggcactttcccactgtagtggaggaaccatttcgtatgcagtgattaattacccataaacaacttaaccacaaacaattcctaaatgtttggcctgagaaggaagctgcagatggaattaggaatttacatttgacctggaaagtacaagagctgtcagtaatctgcaacacccgggcagcttttcaaaacccagcgggtcccagcattgttcaggatgaactgctctagctaggttgaaggctgttgttattttcttttcaaccacatctgtccctgcttagaaaaaaggacagagagtgtcctgggcctgcctctcattttttgaccttagggtctgaacacaaatagctaacaactctgttaatgaggtgggccaagcttgtcacctcagatgaaggcctggcactccttttcccagtctaccctgcagtctcctacatcggccttttgatggaggggatggggctcaggcaatgggtgcagtagttcagttttgagttcaaaccactagtctgacaaattagactgcctttcattgcctgcttacaagcccagggttcagatcagacatatcttcatccaatttaagaactagaagaggaccttagggagctgcggagctacttgttttcaaaccatcttccacgggcagctggctgcactcctgctcctggctgcactcctgcttctggctcttgtatctgccagtcttccaggagaggacatacctacagaaaacatttccttatccactgtttctcagaactgtgcactgcaacccatttatgggttaggatatcaattcaatgggttgtgtcaatgaaaagagtcaaactatagaatatttgaagagatttcttctgagccaaatatgaatgaccattggcccatgacgcagccctcaggagatccttagaacatgtgtccaaggtggtcaggccacaacttggtttgatacattttagagagacataaaacatcactcaacacatgtaagatatacaatggtttggttcagacaagtgggacaaccggaaggcgggagcttccaggtcacaggcatattcaaagattttctgattggcaattggtggggatattatcaatagaaaggactgtctgggttatgataaagggtggtggagaccagggttttatcatgcagatgaactctccaggtatcaggcttcagagagaatagattataaatgtttcttatcagatatagagtctgttctattagtaattccaaagggaggagggtataatgaggcatgtgcagctccccattcccagcatggcctgaactagtgtttcaggttaactttggaatgcccctggctgcaaggagggatccattcagatagttggggctttagaattttatttttgttttacggttgtgaccaatatactgtttttgtttttttcatgaaataacttggggtggaaaatgggagagggcaatttgtgggagaaaggacattgtggcatggtcatagttcagtgttatctatagggatgggtgcatcaggatgtaaagcacatgtttacaagtgagacacagacaaggaagtgagctggttaagattaccagcctggttggtggttgagttaggcctagacctgccattcctctgccccaagttatgctgttgctgctgccaagcatcttactgctcgtgtgcaggaagtgttaccatcccagcaaaggtttatcagaggaggaaggggtgaagcaggatcctaagagactgccctctggggccagctccaaacctgagacagtgcaaaactccctcctctttccagcttgtgggagtccagactgcagagctgtggcctgccagaaagctgaaagagcctggtagttgaattcttggactttggagtcaggcctggattcaagtattgactcccacacttcttggctgggtgatcttggagaagtaaattaatctcaatgagcctaggtttccctatccttaaaaagaatgatcatactcacttggtaggttgttgtaaggaattagataatgtatctagagttctcagccagcactggacacttgagcatttagtaagatatttattacttattgggatatgagcaagaagctacctccctatgggtgtaactatctgggtagaatgtgtctatctcagaactttctggtggtatttttgtgaaatcccaacatgtgcggccacctgaaaagagcattctgaaattcccagacctcttcaagcaattagaaagctcagtttaaaaaacatgtaaagaagtctgtcaaaacagactggagctgaatgtcccatgttaaactgttgaggatcactgtacaagaaactgtgggattgcaggtcctcacaaccatcctgtgctgtacagtgcagaggtctggaggtgagcagagagacccaaggtgctcatggaggacttgtcaggtaggaggtgtgaacattaggaccatgtcaagcaggggagaagaaacaagggaagcatgtgacaatgagatattctaaggcaggtggaacctctgggacccccctcagtatataaggggccaccgatttcacaaagaactttttaacagaatgaattgttcaataatagaacaacagactacacaggatgttgcttcaagggtttctccttggagaacgttagggaggagctagaagtccatggatctgacgtggttaaccatagaccatgctcaggcagaggtctatacacatctctgccacctctgattcactggctgagctagcttgaagcctcgctgtgtgaaatcagagtgacagtgtgtgtcgcccacacttctactggtcttgctgtctccatgcaaaatggtcggttttagagggggaagccagtggggagaggattttgcttctaggggctcacatgggttctatgtagaatgagaacagtttctggcctttgtggtgtccttctctcctgggaatctttctcttccacatctcatcctgcaccgagcatctagccctgtgttgcttcctgggagggaatgaaagattcaagtcatgggccctgcccagcagggaagtgatatgagattgaaacagaacaacatataaccagatgcaaggttgtagtgcaagtgcaggaggagctgcaacttcactgaggagttgagacttgagctggactttgaagggtgtagcgactgcctgccaggaaacaacatgatgtctggtgctaggaggcacagtaagttgcagagggcttttctggccgctcactgccctgttcctactgcttactcccctagttgtagcatgctgagagaccaggtgtgattttgcctcatccaggcaacctcatttttagcagctaaaagaatgcatttccccaaagtctttagacccacgtggaaaatggattctcctactgttcattccaccttgctgcgaatccgagctgccagcagagtcaagatgcccacaacccctggcctcttaaggggcagctgatagctgtcttttactgctattctgattgttttggacttttttctagcagatacttacatgtgtatttgtaccacttctttttgtaattacaggtattgtggaaattgtaaggaaggaatgactgtatttctggtatcacaggaactgttctctaattctgtgaattaaatgtgtggaattagatctagaatgctgccttccttatcctcctggcatttgccatcttagcaagttttgctaaagggtcaaagagaggattccctccccaaactgctatttgaaatgttaacttttggaaagaggcactgtgttttgtgtcacttttgttagtactgtattgagctgcagtcgaatcatcctcaccatttaatccagagcctaatccttttcctctcaccacaaccaagccacagcatgtaggatggcatttactttgaggatgagcggtgagagggcaggaagctcttatacctgtaatattttgactcagcaccattgcttaatcttttccatctgccaaccatggtaaccatttggagtgatgtcactgattaaaataataatgctacctaactgcttaatccaggagattggtatatgcctactgtgtctggggataaagcaagtgaggtttagtggatactgtgtgcccaacaaggtgttagctactgaaggaaatatacaagtgtaatgtgtgctagcttcagtgtggagttgagcagttattttgttgatgtgactttaggagaccttcataggaccagagggacctgagttgggtgctggataaattgggagttttctacaaaaattctgctctttggctgctgaaaactcaacacagcgaagtgattcagctcatattagcttgtcaagtaaccatacaactttgcacagctgtttccaaaagaaacttcaatggccctctttgattaagggaattacaatttatgccatctccaacagttcccgtgtggaagcagccaaagtgaaggagatggcaaaggaaaagaaaatgcgtcatcccaggactgcagaagcctgtgatgaattatccacagggctgctcccaagagcccgagcagagggctttttcggcagagttcctgcatccagcctaccgatgccctggaagaggaattcttaccccccttccccaaattaataaaatccaccaagccagagagcaggaatgcagcattgcaggacagcagtagctgccgggtgttccctcagcctgccctcgggcttccctataccggtctatttttatcctccctgagaattatggctctctgtgagtctgatttaaaatgaaaatgtgtcactcaatttgaaatgctgtgcagcggctaagaaatatgtccattgttatgcacataaagccctgtgataaatgcactgcccaggaagagaggcttttccacccgtcacccagctcctaggtctcatgcctgtgcagtcatctgtctccctctccagagagtcagcagctttgtgtcctggagaaattgtgaagcaaatactgcttaccccgaaaagtgtgtgtgtggtggggggaatgtacaaatgttgatattataaaaaaaaaaaaaaaaaaaaactctgcttgaacttgagttctcctccacatcctcccaccttcacttcataaaagtggcactttctgaaaagacttccacttcttcctcaactttcttctccccagtcctgtgaagagtaaatagcataagattggagaactaaagggaagctttagaagcggcctgcttcctctccctatttaatcatggttgaatttaaaacagacacacagttacttcccttgctattaaacatcccacagaggaagaataatagagaactgattttggaatgatatgagtcattatctcaggatctcacagcctttgggtctggctcttttgtgtgagatctgtcttcgttcctttggactggagcctgacccacgggttttcacgcatggctgcacgtcagtcatggggacatactcagcagtctcagaagctgggccccctcagacctattaagtcagagcctgagactgagtcctgaacatctgcattttgacaagtttccccaggtgatttaaaaatgcatcctgccttaaaatcattaccctgaaggcatgtgttgccccctgggtaaactacaagccacttcgtcacatccaagcagtgataggatggagtgggttttcctgtgtcctcactttgtgtctcagctccaactcggagccagtggggaggaattgtgtttccttccctctgcaacaaagttctgcaggcttcagatctagggccactaatggggctgagtctgtgttcccctaggaggcccaggacatagttgggggataaaaggaaaggcaaacatggagtgtttctgatggtgtgagtgctgggtgagcatgtgacaacctttgcactggaacccctccgtgagtttcagagctgaaaacttgtatgtattactttataaaggccacccacaaacctcttatgttttcatcatcttttcaaaatttagatataatttatctactataaaattcacccctttaaagtatgcaatttcagttattttcattatatacagagttatacaaccatcaccactgtctaatttcagaatgtttttatcaccccaaaaggaaaccctgtgtccattaatagtccccactcccagcccctggcaagcgctaacctactttctatttctatagatttgcctagtttggatttttcatataaatggaatcacataatatgtgtccttttgtgtctggctcttttcactcagggctgttttcaagatgtatccatgcgcagcaaccgtcagtagtttattcctttatattgctgaatattatttcatcagatagatacagcacattttatattatctgttcatcagtggatggatgtttggttgtttctacttttggggaagtaagaatgctgctatgaacacttgtgtacatgtttttgtgtagacacattttttctcttgagggtataccttggagtggaattgttgtgtcatatggtaacactctcctcttctgaggaccttccatattgttttccacagtagctgtaccattttgcattcttaccagcagcgtacatgagggttcccgtttctatgcattctcatcaacatttgttcttgtctgtccttttcattatagctattctggtgggtgtgaagaggtatcttgtgattttgattggcgttttcctgatgactaatgatgttgagcatctttcatgtgcttggccatttgtacatcttctttggagaaatgtctgttgatctcctttgcccattttttttattggattacttgtcttcttgttgagttataggagttataggagttctttatatattaagaatatgagaaccttataagacatacgacttgcaaatattttcttccattctgtgaaccatcttttcacttccttagtagtgttctttgaagcacaaaagcttttaattttgaagaaatctgtttatttctttggttgtgcattaggtgtcattgcattaggttgtgcattgcctaacccaaggtcacaaagactaactaacatctgtgttttcttccaagagttttactgttttaggactttgatccattttgagtgagtttacatgtaagagcccagtctcattcttttgtatgcatttatccatttgtcccaggaccatttgttgaaaggatcacattgaccattgaggaaggcaaggtagacagtgacaatttcatttaagggataaagaaatatacccaagaaaagttaagtaatcaggtcaagtcctccagatagaaaagggtagagccaccataccgcatgtccacaggttaaggatgcctgttcctgtgagcctttgagaaggtgtccctctcttctctgattctggcctcttatgtccctttagaaattttgtccatccctagtacacttccaagggaaactcttgtatccagaatcatctatttctctgctgatttgttccttcaaaaaggaaaagaagtgtatgttgcttggtggcataatgaagatgatccatgtctcaatatccagagacagcctgttggtcctggtaggtatgcctcacagcatggccaaacaattctgccccacaaattgctgctggtttccatgtgagaccttgtagggaacaaagtcccactgaggctcataggttcctgtaaggctctttaactagaaaagaagcatatacctcttgcattccacctccatgtgaccaggaatcctccagctaggttgcatgatggtataatggagtacctgaaaggatgggttgacccacctaattctgaccggaagagctctgagggattctttaccattttctaagggaaccttaggttacccatcaggacatctttagggattctttttgtggactgatgtcatagaatttgtgtgacttagggccttatgccgtggtcttactggagggactctagggtttgtctgatccagccagtcccctcatgaggaaacatgcccgagggagaagaagcacaaagtgctgtaactctgcagctccataccatctgtccatattggtccattggggcccttgcaagcaggcatgttgttctgcagaatatttgcacgtgcagatggttaaacccggtgttaggctctgtatgggacctccgttagccaaacaacatcccaaagctactgcgcttcctgcaccattcttagcagccgtgttaccactccctgccttgagcctgaggagctcattacaaggaaacatctttccagactggtgggttctgctgaatgcctgtcctggcccatcccatattggcctttgttactgtctctgatctctccctcttcctaccaggaagcagtcacgggtcctgagcttctcccatacacccagttgtgactccttgaccctgtcagggcgcctgctccccagcaagctagaggcactccaggtgaagaagcccttgattctggaggaagcacaccactgaagtccagaatgctcagccaggcccctgacaagcaagtcagaatccagggagagcagggctgagtaagaattacattcctggagtcactagacttgggatgagggctcttctcccaccattaatgtggaatggaatggaagagaagccaagccaggattgggtgattaggttaaaagacgcctcctggccagtgaaccagagtcacaccgagtggggaaaggcgtctcgatggccatctaatgaggatgggggtcgtgctgtggaggtgatggaagtcgagaaggtgtcctgttcttctggagtaaacgttttacaaacatttgggagcatttttgatgtctcagtgaatggggtcggggataatgatccaaagatgctgcatggtgttaggactgtcccacacccaacggtgctgccccaaagccagtagcaccctctgtgagaaacactggtaggaaaggtttaacgtgttgaatggtcaggagaatacccatttttaaaactgtaattggcaactgagtataaggacaccatgacaataggtgctgtaagggttaaacgtggatcagagacagacttgaaggaggtgcaagtcttgcagaggagctacccctgcatgaacatatccacaacacgaggtggaatgctctctgtcccacagtggactcggaaatagctaaaatgctgtgagagggggagattccgtcatggcagcctcaagaaaccctggacagcctgtggtcttcatgagtgggctgttccagctttaggtgattgcagtgaacacacacccaaaggtccccaccaaatcagaaagcccctttaaaaagttctatttttggaaaaagaatcacaaattctcttgagcttcactttgaagattttcctcttaaaggtgagggagcctttcttgggagagttttatctctgagggtttgttttctcacagaaatccaccgaaaggagaattcacatttgatgctgggtccttcggggagcgacatctttacagccattttcccagaccccatagtgggtactgaactctcttggtccctcctgagggtgtccccaccctcacggccacgaagcgatggtggtgcttctcagtggacggtttgccttcacacaggagctggcatctcctctcccctcagcctctctgcacaccctgtctgtggtacagctgtgtgtgaaggacacctttgtgagaaaaggggaagggagtggcttaggcaggaaacaagagaattccggtctttggaagctttggagctctccatacgccccatctcctgaactccctggctactaaagccctgtggtgcttgtatgaggtgggtgatgttctctccactgtacaggtagcggaggggaggcatccaggctgggactggccccagtcgcactgccggccggcatcagagccaggcttctgtcctcctgttctccaggttcatcctgtactggccttgatgtctttgcagccacagctcctcactctagtaatttccttgagtatggatctgtcagcagtaagaggttttcaaattagaagcatttaaggtttttagcccagctaaatgatgcttcaattatttccccagtgaaattgcaaactcttaaggagaactaaagcaagtgtgtatgcaaataaccatggtgtataatgtgggcagtgccctcagacacacggaaggaaagggcagggcagctttaaagggggagcccgcacctgagcgggtgggtcagcaaagccgaaagagtcaaagatggatggtgagcacagggaccaaggggactcggactctgtgaggccctttttcatatggtttcttccacctgattcttacccaaatccatcttaccccaagataagtgtctatatttaaaacttgggggccgagacaggaagagcctgggagaaattcagccatgctggcgtgtgttaaaacacacatctgatgggcagtttgtcagctctggctctctcttccccagggttccggcattaagttgttcaagtatgggtcagggcttaggagtgttctgaatatttattgtacatgatcaaataattaaaacaatatgtagctaggcaaataaccttaaatgtttccattgttaaagcctcctgtcagagataatcagcaactcaatgggtttggttcacagtctttccactactagagggacaggaaatagtttctgctcggtgagtaaagggcaaagggcagagcaaccctttcccaggccataagacagaggcctcggtgctctaagcgccctgcgcccttccttctgaagggaatccacatggacctgatgagcagggccttgtaaagactcatgagctctgagctgaatacgggctcttgttcccttgtgccactacgtgcgtgacacatgggaccaattaaagagggaatgggcatagagacaaagtaggttagtagttgccaggatctgtgaagaggggagaatagggcagaatagggtgtgatagttgcacaacttcgcaaatatactaacaattattgtacactctaaaggggtatattttacattatgtgagttatagctcaaacttaattttataacggtaaggagccattttacatagaggaaaaaaaaaggaaaagggagagatgtcattttggtatttgctcttatactcaccccttctctgagacccatggctgtgttagacatcttccaccagaccaggaaaagcgtttgcaaaggagcaatgaggagggggaaagacaaggagctcagcctccattttccttctcatcccaggctgctgggaggaacaagtcctcctaggaacccaagggccgcaatgctggaagatctggagctctaagagaacctgctccagagcacggtgtgcccgtactgcccaccatgctgcagctgaatccaaagctgtatgtgatactccacagcactcgtttctttttctttctttcttttcttttttttttttttttttgagacaaggtctctgttactcaggctggagtgcagtggcatgatctcggctcactgcagcctccacctcctggtttcaagtgattctcctgcctcagcctcctgagtagctggtactacaggcatccaccaccatgcccagctaatttttgtacttttagtagagacagggtttcactatgttggccaggctggtcttgaactcctgacctcaagtgatccacccgcctcagtctcccaaagtgctgggattacaggtgtgagccaccacacctggccagacttttaccttgtttctttggacaacatttttaaagggccctcttaaaaggcagaagtgctccaggagaagggatacaatccacttactctcttttaatatctcgaaatgagtgagtttacctgagtatgagacgggagagttccctggccccccatcacagggtgtgctatgggggtgtggctctctgtttgctgctgtaagctcaaaccccttatggaatggggagcaggcagaagggcaggtgcaggaaccggcacaagcccttttgggctctagccccacagcagcatctaggggtgggagcctgcgactcctgaagccccagtgtcacagtgtggttttagctctgccgtcggtggatggcttaagtgttaaccagctcagtgcccacttggtacccaggcccttgtacagggtcctggaagaatcaggtcacacatggacctgaaggatggttgctggggggtggttattgagtggtggaggtggctcttagcgggatggatggggagctggaagcaggggttagagtgggaagatgatcttcccctggagtttggccatccagtggccaaacttctctcccaccacccccaggtgaactcctctcagtgttcagatgctctttctcttctctctttctgtcgtgctgttctgccactgatctgcttgtctctttgtctccttgtctgcctttggagcctggggtttggagtttatatgggtataggatagggggtgtggtgggccaaaaggcaactttttggttgcaaaaacaggaatgcccatcctcatttagggccatgggtatccaggcttgagggtagggcctttgccagggaactgtcctcttctgtccagtatttccctgtctcctgtccatatcaggtagttggacagtcacataaattacttccacgtgaggggtatggacagcacatgcctcggaagatgagagtgggtggggggctgcctgtacacctccactgaggacacagagaaagtggggataggctggactgactttcagagggatgtagagtgaaaattcaaagtctccttagagtagggattgtgctgagtcactacatgactatatgaagaagttgttgaatacctcccaaaaattgaaagaaaaatcagtttcaggagaatgagcatatgtatgaatcgagaccaccttaatgagaaagggacagaccctacctggaaatagcagatttgctcatcggaaagactgcatttgtttaagtagagatcatttcagaggccaaggggaaaacttaaggctttctttaaagattcccctcccacacagaccaaaacagcactcacctacataggtaggggtgttgtaaatgctcttaattatgtgaattgctggacattttctttacagtgggcctgtattactctaataatcagaagaaaaaaatcataagcaaaatctactttggggagaaaaatggttccttctatactgattaaaacataaaccatgttatctctccaggggttaggatacggccacttgttatttgttaatgtacatatttctgcatttaaaaagctgtttacaatgagcagtattctataagaaaaccaacatttgaaaataaagctgtgctctaggtaaggctcctgcttctgaggagtggagcactgcatgcttgggcaatatattagactgttctcatgctgctaataaagacataatcgagactgggtaatttataaagaaaaggagctttaatggactcacagttccacatggctggggaggactcacagtcatggcggaagacaaaggaggagcaaaggaacatcttacatggcggcaggcaagagaatgagaaccaagtgaaaagggaaaccccttgtaaaaccaccagatctcatgagacttattcactaccaccagaacagtatgggggaaaccacacccatgattcagttatctcccactgggtacctccctcgacatgtgagaattatgggaggtacaattcacgatgagatttgggtggggacacagccaaaccatatcaggcataaacttcctgtttagtcctctaagaagtaccttcaaaactcaccttttttccagccctccagccacaattccaagaatcacattcacagtgaaattcttggagggcactggggaggacaaaactcccctgggactgttctttgctgctctgagaatgactttgtgccacagtgttgaccccatagggaactgtctgaggtcacgcctggcttttgtgtggccaagaggcaggatgtgtcacctgatgcccctttgctttccctccaggtgggcctaccatgactttttcaaccggtatcgggtgctggtcaagaagagagagctcgccaacacagacaaaaaggccatctgcaggtctgtcctggagaacctcatcaaggtgagccacacagcccagctccaggagaggcctgaccaggtcccctaaagattgagggggtggcgtcgttatctacattttttttttggtcttcatccttcttactgaatctatttctgggatattaatccattttcctacatcagtgactagaaaaaaaagcaacccattctccttatctagagcacttcccaaccttttttacagctcagcaggcatagaaaatggaattctgtggcagcgctcctctcgagggcaccagctgcagggagtctgtcccttgcagacccctgacccagcaatggatgaataaagtatactgacacacagatattctgctctgccagttcagctgagggtctgagccacttacaggctccctgctgagtcctgtaaacagttgtgactgggccctgatcagacttgcatttattcagtaagattagttaacaaaagcttgagtcaacaccactagaggataattgacattgtggacttcccaagtaaaaacgcacttacacaaccgtggtacatcaaaggttagtcttaagattatatgagtaaacaagctatctaggtaaactactctgcctttctttattactattttcatttgtttatctagaggtaaagggatcaggccaccttcagccagatctgttaccaaagttatgcaaacttctaggccttccaagaagatttgtttctataactatctctaacatttttcccaccagcctgactgaactccagcagaattctttgtacagcttgcttgggtttatgatgaggctactgctaactgcaagctgccggctcaggatctctggcttctctagttctcaggggctacatagcacggcccatctggtacacctgggtaagggctctgatgtggagcccaggcctagccctgaagccagcagaggggaaggtagctgctgcatctagctggttgcatcaccagcctcaggccctcccccagatacttgttttaagtaaggcaatagattttatgttttaattgaaacaatttgaactcacacctgacagctgagactggagaactatagaagcggagctattggggccttttgtgaggggcaaatccttaaacatttccatggtgccagacattttggggattacagcagagtatgatcattaatggctcgataaaggttaaattatatcaaaaatcacttgaacaaggtaataaaaataattacctcagaaattttaatttttcaggttttctgttcggaaaatctatccatctggagtagctcattgccagatgatcaggatctaaggtcatgttttattttgtaaatgtgtcgcagccatcttcccagcatcatcttagctgctcaagtctagctatagacactgcagaatattatagtaaatgtacgcatagctttaaatttgcctttttaaaaagagagcctaaatactagcccaccttgccatgccatcttttttttttttttaaacagggtaagggggtaacaggctggttaatcaagggctatagttagctggactccggttgattgaggtttttgctgtggtccacctatcagtgtccacattttaacatcttactttttatggacaagaaaaatctctgttaaaggtcagctgatttcagggcctgcaagtagcccactctgccatgtggctgccttctcatttgtctaggatcatagtttccctcttctgttccttcgctggatttctccaggattaccaccaagacctctgattcccaaagagggaactctggaggggacccggatcagactggctgagtcggcccccacactgggctctcctccagttaatgggaccacatgccactgcctggggctgctgctgtgatgtgctcaggacactgggcctttcctggcacagctgcctcttctcttcactgacggggagcctgcctgcttctcagtgctcggcttcagtgcagcttctccctcctgcttcccatggtctagcatgtggcacttcatgtcactcttagagcccatagcatgctgacctatgttccagatgtgtttgtcctttttcgtagaggacagtgtctttatgtttacaccacctccttagttatgagtgctgagcctaatacgcagggggagcctacctaatatttatggaacaaatgaaaaaacaagtgacttgcctaaagaaaaagtataggaatacatgctgtttcctctgcctgcaatgctttttcccctcttttgcctgcctgacaaagtggtattcttccaaactgagctctgaaatacctcctagcctcccagatgttgttagctactccatcttctatgggccagcagcactcacctcctcccttcctttattgtgttcatccccttatgttgtaattgagggcttgtcatttcaccagactgtgaacacataaatgacaagggtcctgttgtggctgtgttcctagcacaattcctggttgtcacaggaatacatgagttggtgcagctggctggggaactagccaagagctgctcatgactagaaacctgccagtaatggctcatcctatgaggaatatacagaaatcaccctcattttacagatgaggaaactgaggcacagaaagctgatataaattgcccaaggttgcctaggtggactgattctaactcccgctgtctaaactacattgccctctgatccagtctgattgagtaatgtcactgagtgcagttatccttcctggagactgaatagagacactaatgctaaagatttccctggggtcttctatttcctcctttttatttttctcctcttcttgggccacatctggacacccatacttctcatgctgagtgacctgggactttgtatcgagaaactaagacttgacagagctgcgtgttaacttagaggggcacatgccagttccccaccctgtcccaagcaagttctaagtacgttttagaacagaacgatgagaagtggggacaaaggtggcctgcagggcaggcaccaggcacttaaagaccaccttcctggaggggcagcctggggctgggggctgcttcgttaggctgtcagtgaggttttaataaattgttgtggttgtttaggggagaaaagtggattctggtggcctctcccctgcaaggattttaggaatagcccctatcattcttaacctgaatttgtttattctttaactccacagatacatactgaattctttgtactctaatctggaggggttagtgtgagggttataaaaagagtgcattacatggaccctactctccagaattaataatagtctaatgtaacgatggccataactgtagaggaccacatcacggagactggctgtcgtgcaagcctgaatcttcatcacagtggcgaaggagtgtattaacaaacatctgcagggagccaacggagcacaaggatgtgtgtgagcactgtgtagaggagacagtgtcacgaaaggggatgctgcagttggagacttggggcctgggagacccagatctggggttatcctttgatatttgctcaagtcaccttgagcaagtcacttcactactctaggcttcagttttatcatctgtgaagtaaaaggagtggcttggaatggattgctaagtttgctttcagcccctgcagtctgactcttggagaaaggttctcaaaagatgattgatcgactgatcagtcaacagtcagttctaagggttagaggaagcagatctgggtgggagatgttctggagacacacagggtgaggacagtatggagatgaggctgatgggtgtctcagtggagcaggtgagaccctcagagaaatccttgttcagaaaaagtggccttgcagagcatatcatcccttcctgttttttttccgaaatagggaatgaagcgcaggtactgttgttgcttggatgcggtagacagcccccagcctctggctctgcttaagctggaggacccaggcttgttccctgactcaggggcttagctaccgtgctttggcttcctaacccctcctggctgagccatggagcctccccaagcagggcagagatcaaagcagggccgtggctgcctcaaagctcccaagtcccatccagcccctgttcctctcagcatgagctgaaggcccagtgggtgcatggctctgagcagacacagggaggagagccaggcccagagcccactcttgccagcttcacgagcagcctggcccaggccggggactcagtcagtgacactcaagctggaagctctgctgcaagctcagccttagctcaggcaggacagccttccctgtgtgtggaacccgactcctagtaacccaatagggcttaacctatgaagaatgatgattcagcatttttcagggccatttgccaacatgaaatgcaatgttgtgtgtgtattttccttggacttggctcattccttcctttctcattatggtcttcatgccagtgagcaaaatgagatggcagttgatttacaaagagctctgtcatcatgggttactctcccagtgctctgtcccaggcttgtccacaggaaccctgctgggttgtctttcctcatccaaaggggtgagcccagggaagggcaactaattttaacctaatggatgtaattaagacagtaattacaggtccaaaacaatctcatagttttatttgggggttatttgcatcctgtaattatgcatacaactgtgtggccatttgaggataatctttttaaaatgttgatcagatcaggtcatttccttgctcaaagcttgcctgtggctctcaccccaattttatgctgcaacctacgaggcctttggtgattggctcctcccaccaatcaccttcagttcccccagctagccatcctggctctcctgatcctcagatatacccagcagttgcaccactggacataggcatccactctgcccttctcctggaactttcctccttccttcttttctgtggttgcctccttcagctcatttaggtctttgctcagctgtcacctccacagagctgccttccttgagcatcctttttgaacatccccatcccacgctcaccagccaccagtttgttttcttcataatcctcaccattctctgaaaacggaaagcatctttatttgcttgtctgtctgccctcaccatgatgtcagttccttgagggcaggcgtcttgttcactgccatgttctagagtctggcccgtagtagggtcttggggtctgttaagcaaatgctgagactttgtgtccatctacagagaggggtgcatgaagtctggccaggggattctgcatgggaagaacaagggtggtatgggccatgttatttctctgctcactggtgaccaaccagatcccctccctaccttgtaaaggaccccgacaagttccagtttggccgcaccaagatcttctttcgagcaggccaggtggcctacctggagaagctgcgggctgacaagttccggacagccaccatcatgatccagaaaactgtccggggatggctgcagaaggtgaaatatcacaggctgaagggggctaccttaaccctgcagaggtactgccggggacacctggcccgcaggtgagccagactgtggcagctcagggcagcagatcatggtggggaagatgggggtctgcctttctcagctacttggcttctctcttcctctgtgctgagagtggttcctgttggggccatgtctgcatcttggcttttcctcggcagctgggcctatccctataatcaatgccttctcacctcagggggtaggtctagtttccacatctcctggtttccccaggctccctccatcctaccagcattagaaccagctggttttgccacaaaccaaccatttcccctttgcctgaaccccaaagtaaaaaactaactccttttaggaaaagagaccaatacagcctggcacagttaacctgtgcttggcctcattacttattccacagatttcataatgcctcggagtcaggtgattagggctgcaaaggtcctgggaggccccttttgcgagttactgcacaagccaggatggagagagagtggcttgtctaagcaggagtgttgacctaggggttgagtcaggatgccaatcagcctcccctgcctgcccccagctcgaccccgagcagaagaaactactgcagggttccttcctcacggacactgggctgatgaggcactacagcagcaggagtgtgtcagccaagacaggctgaagacagcctgccctctgaccctaccctcggttgttaggttttgagcccaggcctggttcaagtccagtgccctctccagaaaggaatttccttagagaagtgacaataattgccacaaagtcttgtgtttggaggccaaacagagagctagactagggaatcagatgcatttcagcaaacaggtgacacatgggctgagtgggtcactttctcctttgaggctttgctgaatgatttccaaggtcttttttagcatttcacactgagtctctaattgagcacttgttataggcctggcagcaaacaagacccttcagaaggggaggaagtgttagactggctttatctgggaggtgagatgggaaggcagaaaggcaagagaggagaggaaatggccacattccatgcatcccgagcagaaagggttgaggagataaaggaaacagagattggtctgggcctgagaaggtttagtcattcagcaaacacttacccagtgcctacagtgggtccaggatgatggagacacagcccctgggatctccaagcctggggaggtacagaggacaggcagcaatgtgaacacatgatgtagaatgctactggtgaagtagttgaggactgcccaggcacagtgaggtagaagagtgctcagataaggatcatagaggaagtcagactctgactgagtttgaagcttgtgggaagcctttcgagaccataaggaaagaactaacactgcttttctagccacaacgtcaaatgcctaaggcattgctacatttgttaggggtgaagagagttggtttcccctgggtgtgtccaggtagggccacagagggagaggtttgcatttgcagatgtctcagggttctctgcatcagggcggtcaatactctctccctgacactgcctgtttcctcttgctccccaggctggctgagcacctgcggaggatcagagcggctgtggtgctccagaaacattaccgcatgcagagggcccgccaggcctaccagagggtccgcagagctgccgttgttatccaggccttcacccgggccatgtttgtgcggagaacctaccgccaggtgagtagccactctgagggcctcagggctgcagattcagaactaaagtggcaacagatgaattactgccaacgtgaacctctgtcaagcactcccaacttttttctaaatgctttcacatctctgctctcaccaaatcctttctgaagtcccacaaggtaggaagggtgtgcatactgttgtcttagtccattaaatgttgctataacaatatctgaggctgggtgatttatgaagaaaagaggtttatttggctcacaattctggtggccagaaagttcacaattgaacatctgcttctggagagggcctcaggctgcttccactcatggtgggaggtggaagccggtgtgtgcagaggtcgcatggtgagagaggaagcacaagagtggctcttttaacaagcagctctaatgagaactaacagtgagaaatcacccttgaagaagggcatttatttgttcatgagggatctgcctctatgactcaaacatctcctgttagactccatctccaacataggggatcagatttcaacatgagttttgaaggggcccagcatccaatcatggcagttttcacaccccttctgatacctgagttgctcagagaagccaggtcacctgcctgagggcccaggccagccaacagcagggccaggtgacccacctagggctcattcacacttgagggcaggcggtggtattgggcatcatcaggtctaactcctccacttaacggatcaggagcttgaagcccaacatggtgaggtcaggagggaggccccgacctcttccctgccaggttcttgctctttgtgttgttccagtgaagccaaaacccttgggttcaggagccccacatcaggacacatctgttcaaccaggtaacaccaacacatctgaagcacagagctgacttgaaacacgaattggaaggaaatgtctaaaatggttttctttttcattaaatgaacatctgtctcttctatgatcacagaaggtgtgattttctaaataataaaagtaaagcacgaaattgataataataaaaatgtggtcagggtggagcacaccctggtgtagtatgtagagaaacccaggccattgggagaaggttctgtgagtgttcttgggtgatgggtggcgttggtgtgctgctcccatggaaggggcaggtgatgtttgggagtttctcagcaggggcagcatgtgcaaagagtgagcactgatgtggctcccagctctgtcactcatggctgtggcactgttcattgctcagcctgtttgcttgtttactcatttattccacaaacatttattttaccaggtattagggcgagcacactgatgatgctttcatatcctgagtggttttttaacttggtagaaaaaaaaaaacagtgaattacacaccaagtttgtaattataagccattagcctgctgtggacactcactgaagtatctcacttccagctcagtgccaccaggaggggacctccacctggtaaatgggtagagagcaagtggatgatcattaggcccctacaaccttgaggttttcagactgtggtttcctaacccataaaacaaaaagtaaaacaaagctgaaaagagtttgacagctgattccctgtggatatgtaggcgcagaacctcgctgaaatgtgttataaaacaaccaccaaagccttagatcttagggggcacattgtctgtgtaactcctagaaccaaggctgccctggcctcttccctccacaggcagtgatgtatgcttccttcactcctgtcctgcagtgcaaacccacaagatgtgtatccttgtttcccgccaggtcctcatggagcacaaggccaccaccatccagaagcacgtgcggggctggatggcacgcaggcacttccagcggctgcgggatgcagccattgtcatccagtgtgccttccggatgctcaaggccaggcgggagctgaaggccctcaggattgaggcccgctcagcagagcatctgaaacgtctcaacgtgggcatggagaacaaggtggtccagctgcagcggaagatcgatgagcaggtcagtgtctgcagctccctacctgggtgtcgggggcttgggtactggagcattttgagagagcccacagcttccttgaggaactgcacatgccgaagacccgagggagcacagacgtcctcagaccacagcagatactaactgtggcaggcagatcagtgacccctaaagataccctcagccctgggatctgtgagtgtgttaccttatatggcaaaagggactttgcagatgcaattaaattaagaactgtaggatgggaagagtatcctgggtgagccaggtgagcttgatataatcacaggggtcctcctaagagggaggctggaggatcaagttcagagaagaagtgatgacagaatcagaggtgggagggatgcaggcagccttgagaagccagagaagacgaagacatggactctcccctagagcgtccagaaagaatgcagccgtgccaaccccttcagactcctgacctccagagctgtaagataatgatttatgctatcttgagtcataacttggtggtaacttgttgcagcagcaataggaaactgacacactagcccaaggtgctggtgttttgcccttgcaggggtgacatagggtaatgcagcagcagctggtgtgcatggagggcttgctgtgtggggtatggggctggcgctttgactggagtagcttgtctaatatagcggccctcctacggcaagtattaccatccccctttttgtacaattgaagacactggaagggcacatggcatcctaaagtcacacaggtggcagtggcagggccgaggtttgaaccccagctgtctggctccagagcccatgctctgcatcactttgcccttctgcctctctgtctgcctatctgtctgtctgcctcttttggaaagagtgtttgctttggaaatcagaattcagttcttctgcttaaaagttgagtggctgatgtgactactctgaacctcttttcttatccataaaatggggctgacagggctgaaagaagaataaatggtctaatgcatatgcagggcctggtatgcagtaggagaaacttgaaaaatggttagcactcttatttttaagctttgtcctctttctaccctggccaccttcccatgtcagccaatcaaaggggtaacaagccattgattaaatatccctgtagggggttgggtaccgtacaacgtagtacaagagattcgagacaagcacagaacactcagctttgtctaatggaatagacgaggctcacatgtatgcatgcacaaacctggacccccactttttggtggcccacatggccagtcctccttcccttcagaagacctttattggatgcctggctgtttcaggtgctttgctggccttgctggacagaggatggctgtgacgtatgtcgcatgctgtatcataagggaggaaatcgcatgccaacaggctgaacagcattgatcctaaggattttccaagcacctgccatgtgccaagctctgcgatatgtgttttgtgttcactcttatttgatcttcatacaattttgtgagatcattttgtatatgaggaaatggtgggccagggacatcaagtcccttgccaaagtcacataaatagaaagtgctgggaccaggatcctacccgagctctgatcccacagccataatgggggcattgcgggttttttaaccccaaacattactgaagggtttcagtcctttcccgtgcatgcctactgctgcgtttggctcccagagttgaatggaggcccactgttactttgtccatgcagggtgtagaggtggccacagaaccaggcttctgaggtgccccagagggtgcctcctagggaaggaaaggacatgaagagtgtgtgtggcatggagaaacagaattttagagtgggtatggctttgtaagtcattgggatttaatgtatctattctatactgggcatttttaaagcttctcatgacccagtagggcaggaaaaaagcattttacacctaagccagctgccctgaacaggagcccaaaagtggtgcagagatagcaatagaatgcctctgtttccgtgctcttgcaaaagacaaggctttctgagaagagactgtcactgggtgtttctctgtgttagttctacagggtgccttgtttggcttggctccttactggggaagcaaagcagagagcccaggcacagggtgggcacagggcttgtgcctgcccctggtcagcctgctgtgatacaccaggtcagggaggagggcacatccactcagagggaaaagagtgcaaaggaaaaggtctgctgtctggcactggccctttgaaaaacacaagcacaaagcatgccaaggtggcagtggctattgtggctgttgacaggaagaaaagacttgcttagtcaaatgttgtgagttaaccttccagccagagtgcagtctcagggatgagtaggcattgaccgctgcaccctgctgggagccctgtgtacatgctggctcccccaggccttgctttccagccttggggctctgcattggcattgctgatttctaaagttaacttgagaggataaaaataaatctagcattttacaatccacgtgcttgaaaaatcaaagaaaagcagatttaaatggcctatttaaaaaaaaaaataaaaaaagctttttgccttaagcttcctgcttggcaaacatctgtgagtggtggcaggtgttagctaccctgggcaggatgccctgtgtgtagagggtgatcagaaaagacgggaggagtggataagctcttgctttcttgtgcccttgcctgcactacctgactaggcacgctgtgctcttctcacgtattaactcatttaatccccaccagaaccctaggagataaacattaatattattcccattttaaggatgaagaaactgaggcacacagaggttaagtagcttgactgaggtcacacagctagtaagtagcatggctgggattgaaacctgtcaggctggtttcagggtatgttctgccacctctgaccaagctataagatatttagctattgggagactcttggaacatgtcaggagaactcctcagtccaagggagactcttagccttagtttgggttcatgctcatacagatagcattgtccttgcttgggaccggctggcatttaaagtggggagtgtgacccagtgtcaaataacatgcttgacactctgttacaagaggaagcattgacataatctccattagagctctatataggggcttgtttcattgcaatctcttagcagatggggccagctgtttgcaagtgaattttttttttcctataattcctggagacaacttaggcagtggtcctctggtcacacaaggtttctaagccagaaggggaggatctgcgaacaccaaggacaccacaggtgaaggtgtcccaaggtatttgtgagaacagcatagggagtagacagagtgcccactggacagaggcctgggttctgtctcagttgtattcacaaccagagctgatagcttggaaatgattggggctttagttcttccaaggggattcgcctgagatctctaaggtaacatctagctcaaaaattcactgataaccatgatctggctagagtagggttcctatccccagactgtgctctagaatcccctggggagcttttttctaaaaatgtatcctcactgccaagaagtcagtaagggaggaaacaaagataaaaccagggtaaggctagcacccaacattcatatcctaaggccttgtacacccacctggaaagaaaagatgcaaatttggcaccaagtttctatgcaagcagtaacaggaagaaaactgagtggcttgagagttcttaatagaaaagaaccatgcagttcaagaggatttggagctgtccgtggtgctgacttgtttttcctgtgggctttcataatctgtgacgtgacaagccacatccttcaccatatcctacggtgatatatacaatgctggttcttgagaccatttcttgcagtgtccctgggataggctgtggtatgacgtcattcagtaaaacgatgtagtccgtgaactcggctctctgccagcctaactttagtcaagcacacatttagagttggccagtttaacttacaatttatttataatgagagtaaagttccttagacacttatgaatataaggttatccttaaatatattttatatgagaaatatgacacaaatatatggagtcagtagccttttaaatcaatttgattccatatacttagtagtcactttgtaaatatgttaaattcgttatatgtaatcatgcatatatgtcatatacagtcatgcatctgttaatgacaggggtaccttatgagaaatgcatcgttaggtgagtttgtagttgtgtgaacatcatagatttcgcttacacaaacctagatggtgtagcctgctacacacctaggctatgtggcatagcctattgttcctaggctacaaacctgtacagcatgttactgtactgaatatcataggcaggtgtaacacaatgatatttgtgtatctaaacgtatctaaacatagagaagggataataaaaatatggtgtaaaagatggcacacccgtatagggcacttaccatgaatggggcttgcaggcctggaagatgtgtagggtgagtgaatgtgaaggtccaggacattactttccactcctgtagactttataaactgtccactcctatcgactttataaactgtccactcctgtagactttataagccgtacacttaggctacactaagcttactagaaaattgcttttcttcaataattaaccttggagtactgtaatatttttactttataaataatacttttaacttgtggcttctttgtaataaggcttagcttaaaacacaaacatgtacaactctacaaaaattttttatttcttgatatccttattctgtaagcttttttctatttttaaaatttatttttggggtatcccattcttcatgatgtgcttatttcacattgcatatctatcaaaacattttatataccccatacatatacacacctactatgtacccaggaaaattaaaaattaagtttaaaaatttttttttacttttttttgttaaaaactaagacacggatacattcattagcctagacacacacaaggtcaggatcgtcagtatcactgccttccacctccatatcttgttccactggaaggtcttcagggcagtaacatggcagggagggtttctggggtctccgagggtgtgggcaccccatgccctgccctctgccaggcttggctgcatggctgtgacacctgcaggtgcaaggacgagccttctggggcctgtccttctgaagtcagatgtccagaacagaaaatgcaccgcctccacaagcccccagtgacaatatctggatgcccatgaaaagacataggagctccccacccacaccccagacagccagagactcgggcaactctccagggttctccatagagaacttgaacaaggaagatagctgatgtttactgagcccctagcaaagtactttatctccctaatcttgataaccaccctctgaggcaggagttactattatattcctgttttacacatgaggacactggggcacagaaaggttggttgattaggttggatgtacacagctgatcaaggatagagctgggatctgagcacatgtctgtccagctccagccactcaactccctgacatccctgagccaggtctcaggcggtgtcaagatcaatgcagctgggcctcctggatacatcatacttcgcattagagtcctgaggtgccatctttgtcaatagcaggataggatgtgcctcctgttaccatgcgtgcctctcttcatactccaacaagctctacctagagacctcctgcctagttatccttccactcctagtgatttgacccaggctgtgccatctagagagagcagctgggccaaacctcatgtccagcccagagcagagatgaagtcagagggtggctactccagcatgtgttccctccctgtgccctactcctctgtgcagagaccctcagcctccagtggagacccagactggagtggataatacagacgtgcattcggtgttcaaatagaatctgcttgattggatttcttctttgtgatgccttagatcaaggctgcaggcagaccaggcttgaaggtgtgtcaggttgtaactgggaggttcccacagagtgctggggagcgggtagcatgtctcattctgttgtgttggtgcaggaaatggactggtggcttgtgcattgccgtactggtcacaaccacaaggccccacagcatctgtggcattttacagggtccaagggcttttcttttgctgctcttcactgttttctgtgaagtttaatttcttatgtgaattagtcattgattcctgatgctccagcttatcggtgatttggccgctagctctgttctgcctggcgctcctacagaccagagcaatgaagaataatcaatgaccattgttgcctgcttgatgatttggagagccctatttcttcctctccactttcctcactgaccactcttagctaatgccctcaactcttgcggtgctgatttcttcccataatttgcagtagcacttgataccagcaatagcttcttagggctctgggcccatgggggctgtttcacacctgtgtgttgcctgagtgggctgggattgagtatcccatctgcaggagcatggtttgggcagggtgggtcagggcatcagttccctgagtcttagagtcttatggggcaagccatggctgacaggggtgagagagattccaagaccccatggagggcctccttggaagagaggatgctgaaggggtcctttgtctcaaagccagcgattagattgcagctctttgtgctggcaagtccacaggcaggagggctctgtatgaaagagcaaagaaacctaaaaagtgaaggctgcaaacccagagagccagcttctttgtttctgcaacttaaaaataaggtataggatccacccagccataaagccacctgctaccaggcagcttccagctctgcacatgctcacgaaagctccttgagctctttgaatgtcagtgttgctgttctttgttttcctctatttctgtaagtttacattagtgttttgttagggagatgccaggcaagcacttgagcatgcaatgattgtgagacttaatcctaccttggaagttccttttttgattgccttcatgctttttccctggtaaaataaccttttcttcccccacttcttctcccttctccttgtttgctgatgttctccacagaacaaagagttcaagacactttcagagcagttgtccgtgaccacctcaacatacaccatggaggtagagcggctgaagaaggagctggtgcactaccagcagagcccaggtgaggacaccagcctcaggctgcaggaggaggtggagagcctgcgcacagagctgcagagggcccactcggagcgcaagatcttggaggacgcccacagcagggagaaagatgagctgaggaaggtatgctcaggccagaggggcaggcgctggcaagcagagtgggtgggcacacggagccacctctcagagagcactgctgcttcaagtggtaaaattgccatggtcttgggctcatgtgcacagactgaccattcatctgtgtctagacagaaagtggcatgctttggggaaacccacacaagcatgactgcgcttctgctgttagctggacactatggcatcccctgggaggggcacatggtgtctgcctgtgagcattgtttttatggtctagaattaggcccagggctggctctgtggcccgcatccttgttggcaagaaagccgtgacagaggctggggctgatcttgatgctgcctgcaggggagggcagcttctgggcacccctgcccatgatgcagcactgtgctttggtggaggtgcctcacctttgaacacttaaagtctcagcctgtcacacccaccctggtgggcttatttcttacaccatgaaatagaacttcctgagctttgccccaaacctgagtatcagggcatagagattccctgctccactgccaagataactgttccagccagggaagtcccaagggcccctggagagccccccacagacttgggtcattgctgttctgcctcccaccaccgccccacctcccaccaccatctctacaagccacaagggaaatagcatgttgcccgctttttcagtgtttgtccatcaatggggagtcgcagtggatggggatctaagagggagagatccagtgttcagggtgttggagtaacaacttcaaaattggggcaggctggatgctgctgcaggaagggccctgcggtagaccttggagtccccagattcccatccccactctgccattcccaagcatgtgcagaaagcctcactggccttagttccctcatctgtgtgtatatttataaaagttggttcagatcatctccaaggccccttctagacttgcacctggctgccaccatgagattgtgtttggcttctggaaggagcagaggcccttggccctacgtgggagtccttctctcttctatttcccactgccttttcctggcctgagccttcacatgcagctgaggaacacacagacatccgtggaggttatagagcctacagtgccagcatgtgctgggcttgcatagatcttcttcccacctcgggcctcagcaccatcagctcctgccttcacccagaccccagggatctccaggggccagaggtgggatccaggtgtggagattaagggaagaagaaagtaagacgcaggcttcccataaaaggccacactcctgatgtgctgctttgagggccctctgcccacaggaccctctgcccagataagtcacctgccagcctgcccaccatgagacatgaagtggattcattctttgggagaaagcacgtggtgcttggaaactcctgttaaatgtgtctacaagtcttgtaacctacaaatcatggaataccacacttgtggtttgtctacccttgggagcagatgaatgggatggtgacctttctacatgaataaaaaccagaaggtgaggtccaaagccagaaaggatcaagaatagaactggaaactcctgagactagtgaccctgggagaaaaaacattccctgcatgtgtgtcccagtcagatgagacatctgcaaagtctgtttacccagcagatccacaaaatcaggtctcacctatctctgtcccaacagatagcacttgactcatcagcttcccagccccgcgtccctgcttcctgctaaatgctacaacttggggacttcagcactctaaacacccaagtctccatcaaagggagtgcataagagtttataatatgaaaatcttcattggaggagcaaaacagagaagcagactccctcctcctctccttaagaaatgttgctactcttccctagcaatgatatgctgacctaggtcttaaagaaaattagagcttggaattggtaacaaaaaattaaggacgctgcaaggaggggaacgctaggagcagagtagtgcaaaagccccttccctaccccaaatgtaagcaaattccaacttagaaacactcagaaaccaacaggagatgactcatgaagtggcatgtccacctctttcctggaaaagaaaaagtggaagcaaacattctttagaatcttcagaatctttttgttgtggtggttggaggtaggtagatgagctggctggcttttttttgttttgtcttctgtgcctcctcagggtataatatttatcaaaggcactgtgtcaatttcaataaatgctgagtaatcagacaattggtttcctccaaggcttgagcaggggcctgctctgctttgagcgagattgatgagaccagccaagcacagtgagggggccgactgctagtagatgtttaatgagtttgatatttccatcagcaaaggcagcgagtgtcgtattggaactgctatgctggaaaactctgggcttgccatctctgacgatattaattggtgggccacgtggctgccctgccttggcctgtgggaggccaagtctccccgagggcaggaattcatctctctgtccacagagtccagagcagctctgtcgcataggttagatgacatccttttctactaaaggtatctgttgttttggcgcttccacggggtagtccacacccaggcccttagcctccttcccttttagcctgtgcattgtgtacatttcgttctttttgaaagcttcagcgatccctatgccggctgcttttgtacagctgtgctgttttgcatggctgctctgtttggtgaaagagaggtggcccccagggctgccctaggcacagaggtgacagctcattattcagaatctgctctgaaggctgctcaatgggaccagagcaaggcttagcttggtgcagggctgtggtgggtgaggaggaaccacccacagccaggtgcctggctctcagagggggtccctggtccttgtgagagatgactagcaggcccccaggcactgaacattcggactagtggggctgggttgtgcattgtatcaagacatcagtcatagaaccactagccactagttgattgccttgggtagttcaagttataaaggttttgatttctccaaatagaggtagagagatctggcttggggaatgggggctctcatagcagagtgtgttgagccttctccccaaaggtgtggagcagagctactttgaccagccaagagggggttgtgctctcagcagcaccaggactcatggttcatgtggaggctgaggattattaggaaggggacactgacccatctctggaaggacgttgtcttgctgcagaaagcacagaagctcatggtccttcattcagcaggtgtttgaatgcctgtatgtgttagaccctgttctacacactggggcaaaaggtgaatggtgtttgaaaaaacccttctcattgttaaggagcttaaatgtgtggggatgggggaagaaagtacagagaggaatctaacgtgaattaccccccaagggctacaaacaacaatgaagcagagtaaaggggatggagggtgacctgtgggggcctgaggggtatgatttcacttttgatggccacagaaggtctttctgagaagacatctgagtaaggggagaaaataagccaaggcgatttggggataacaggtgacaggtgtggcacacgtgcacaggccttggggcatgagtaggctgggtgggtgtgaggaccaatgaggtgctcactgggctcaggtggagtaagtgaggaggcaaacagcaggagcacagtgcggccaggtcaggaaggatcttctgacttcaagcgcggccttgacccatgaaacctccagagagatgagcaactctgtcctaggcacttcagcttctgtgagcttaggggtgagagaggaattaaaacacatctgcaggaccattttgaagatattttagccattgtttcaaagttgtcttactatccaagggatgttgattttcaacttttgctttaatcactactttaaaaaacaaatttatactatgcttacttagaagaacattctcagaaaatggtcaaataaacacttcaagattttgcagaattaaaggtattgtccctacctagggctgtgcctgtaaatgtggtaactgcacagcatcaaggacagatggcagaggaaccttttctgattggcattgtccaaccagttttcccatgtttgctactagaaaccttgcgctgggtcttcttatagtactaatatccctcttgaaaacataagacaaaacaaagcccctagctacatttgtatccccaaagacaaactagtaaagacagttctttagcatgttgctggggcatttacttaacttaatataggtactgtattagcctcatagatacaggattttcctccagtgttgattctgataagctgtcccaaataagcttttagaagaaacactgagtaatgttgcctgcaagagttaagactaaccactcccccagtccaaaaaaaggagctgctgaatggtgttgaatgagtcctgaaacctaaggtgttatttatcatgctcaggggatgcagccgcctgttttatgttgttaaagcatctcccactgcaccctgcagccctgacaccacaaagtgggggccatttggctgcagaagtttgttacctgctgtgtctgccaacagctgtgttagctggctggaaagactggggttggctggtacctggagaaatatgatcaaggaagcattctctcacccacctggggtgtggagctgagtgtgggattggtcctttcctgctgttcatgaaagatcaggaacatgggtctacctccaaaattgtttaggcaagcaagaaaagcaaatccccctgaggccactttaatgtatggcttagaataataaagccaagtcagagacctgcattcatgaatcaaagagcgagacagagggaagaaacaagcctcaaaacgataggaggtgtaggtggcatacatgctgttaaccatggcactcccagactgtagccttggctcaggttttagatcataggttgttgcaatgaagtcacatgttcttaggtggcattcataggactggagatttcaggacccacttggtgatgatgtcatgcactctgtgctggtcagatggcatgttccatttcagagggatattgactgtgtgtagaatgctcaaaggatggcgaggggtcttggtcttctcaggtgacctactgctctgtgagccatctagatattaggagaatgttaaggagaagcaaagttttgctccatggtaaggtctggttacttcacagcctgctgtaaaacctaccagtagttgactgattcagaggatacagccttgttcctggcaggatggggcaagacccctgccttcctaactgtgacatagatcatgcttcattgcaccaccctaggctttattctgtagaagtacataccatgtggtttctcctgttgggttgttttcagtttgattttacttgtatgtctagaaaagtgaaatctattttgataatttgccaacctaatttaaaggtgctcctgaagtcattgagtgaactgcctccagcaatagcaaattagatgcatttgaagagtgttttcctacattgtatgtgctgcctaaattgaattatttgattaaacaagctcatgtattctagatattttggtcaactataaacacatttatttaaaaaaacaattttaaagggagcccttagttgtgactgagggaatgcaggctccttaacttggtctgcagggcccttctattcatttgataagctttcaggtgctggcggtggcctgggttctgagggtgtgatagtctggcgatataatccctaggtccacgttgaggactctggtccaggctgagcaggcaggtgtatgaggaagcattgctgtcccacaggctctggagggatgtgcaggccctgtcagagcaggacaccaagcgtgggggcaaccccaccaccccgtgtggtacaggaatgtttcccaggagagtgccggtcaagagctaataatgagaagaaagtaaccagtaaagaatgggaacgacagagcctgtcagaaggaacagtgaaacattcaggcagatcctggagggcgggaagaggctggggagaggagctgggcccacccaggtcgagttaggagaataagaggagttcagtgtttcctgaggacaaaggaagagaagccattcacaagctgattctccctccctctacctacccagccttgacttttctcagtgcccgtgctgcaaccacacgttttggcaacgtagaactcttcacattcccaaacccgtgcccttcctcctcccagacctttaggcatttgttcttcccacctagaatggccctcagctgcctgagacatcccacttgcaggcctaatccagatgacccccacctcttgtgaagccttcatggaccctgaggctaccttcttttccttctgaatcaccttattgtagtgattctcaatcggggtgattttgccattaggggacgtatggcagtgcctggagacattctggttttcacaaattgaaggtgagaggagggtgtgttgtattagcatctagtgggtagaagccagggatgctgctgaacacccagtaatgcacaggagagtcccttactcccccaagaaagaattgtccagcccagaatgttgacagtgtcaaggctgaaaaactttgctttataggaagctgctacagcccttattgatatcattactatgtatgcacctgtccctcatccctgccaggctggacactctctgagggcaactactatattagactgttcttgtgttactataaagaaacacctgggctgggtgtggtggctcatgtctgtaatcccagcactttgggaggccgaggtgggtggatcacaaggtcaggagttccagactagcctggccaatatgatgaaacacatctctactaaaaatacaacaaaaaaaaattagccgggcgtggtggtgcatgcctgtaatcgcagctactcaggaggctgaggcaggagaattgcttgaacccgggaggcagaggttgctgtgagctgagatcgtgccactgcaatccagtctgggtgacagagggagactccatctcaaaaaacaaaagaaacacctgtggctgcataatttataagtaaaaatgtctaattgactcacagttctatagtctgtacagaaagtgtagttctggcatctgtcctgatgagggcctcagggagcttccagccatggcaaaagttgaagggggagcaggcatcacatggcgatagtgggagcaagagagagcggggaggtgccacatgtttttaaacaaccagatctcacgtgaactcagtgagaacttatccctcactgagttcacgctagggcaatgaaaacgttgcttccccttaacatcctcctaatatctagatggctcacagagcagtaggtcacctgagaagatcaagacccctcgccatcctttgagcatcctacacacagtcaatatccctctgaaatggaacatgccatctgaccagcacagagtgcatgacatcatcaccaagtgggtcctgaaatctccagtcctatgaatgccacctaagaacatgtgacttcattgcaacaacctatgatctaaaacctgagccaagactacagtctgagagtgctgtggttaacagcatgtatgccacctacaccttctattgtgaactcagtgagggatgagttcaccaaggggattgtgctacagcattcatgagggatccacccccatgacccagtcacctctcaccaggccccacctccaacattaggaatcacatttcaacacgagatttggaggaaatgaacgtccaaaccatatcaactaccatgagtcagtctatctcatttggtatcccccagccctggcaaggctcctggtatagaggtgtatcaggaaatgtgtgatggatgagtgacagccttgccctgtgtcatactaggggccagaactaggcttggtgagtgggtgcctctacggataaaacatcgtcactctcggtcggtgcttcttcttctgtaccttgccctcaacaccaggtcacattttagcctctgaagacatacaacatctgttgcattaattattataggcaataaatattataggcaataaatgttattctttggcaaaataaattgccaaagaataataacttggtataattagtttgatgcatgtatatttttatcagctttatctgatttgacctcctgttgggcagaaagccaacccctttgcctgactctccataccgagagtccctgactgtgcttatcatttacttgtggggtgaggagttctgctggatataaagacataagaccagcagctctcaacctctagagcctcagaattacctggacaacttttgaaaacatgcttgtcagagcctccttcttgtaactcatggaagcccatccacagataaacggatgagacaaactgagtctgcttgaattgaagggaaagaaagattgaaaaactccttaaatttgaaggggttctagactgttaaaagtgttggtcaggtgccggtggctcatatctgtaaacccagctactttgggaggccaaggtgggcaaatcacttgagcccaagagttcaagaccaacctggccaacatggcaaaaccccgtctatactaaaaatacaaaaattagccgggcatgttggcaggcacctgtagtcctagctactcaggaggctgaggtgggaggatcaccagagcctggggaggtcgaggctgcagtgaaccgagatctcaccacagcactccagcttgggtaacagggtgagaccttgtctcaaaaaaaagggtgttaacaaagtgcttggatctttttgcaagcccttaatagtattgtattgtgtatcctacttttctctatgggcccttaaaggacaaacctaatgtaaggccactacagacccatcagcagctccccagagtagctgaggcacctttaagtgagagtcgctgccttctgagttcctggggtggggagagccagtgaccccaatccttagctccagtgtgttgccattttttcctgcccctttctacctgatgccgagggtggggcagctcctcccttattaactcacctcttggtgccttgagcttaatttacagccaggagaggaaggaaagttggcatttaagcattgtaaccagttgaaattcaaacctcatgcatttggaggaaatgaacgtccaaaccatatcaatttaggcttctgctggtttagtccatatccctagggccacctctctgggttttaatgccatgaagtctagaagagtttgaaaggtgcctgtctgatgggggtgcaggtgggtactcaggggtctgtatggtcatctctcctctgctccacgtggtcatctcctaggttgcaatcccagtagtcaccaattagtccctctgccattgcacacttgctagtcattatgtgttgtggtgctgtcctgaggaggtcatttttgagactctttctacacaggttgagacgagtcctctggaagatgactgcatcctgtgacttaagctagaaagggtgaggttgttctttgtgtcagtcagcgtacaagtttttgtgtggactaggttttcatttatcttgggtatctgcccaggagtagcaatcctgggtcacatggcaactctatgttaaaccttttgaggaattgccagagtgttttccagagctgctgcaccattttatattcccaccagcagcatatgagggttctgatttcttcatattctcaccaacacttgttattgtctgtctttattatagccatcctggtgagtgtgaactgttatctcagtgtggctttgatttgtatttccctaataagatactgagtgtcttttctgtgtttatcggccatttgtatatcttctttggagaaatgtctatttcagttctttgcccgtttttaaaattgggttgtctttttattgttgagttgcaagtgatttttatatactcatgctatgagtcatgtatcacaggagtccccaacccctaggccatggaccagtagtggtccaggaaccaggccgcacagcaggaggtgagtggtgggcaagtgagcaaggcttcatctgtatttacagccgctccccactgctcaaattactgcctaagctctgcctcctgtcaaatcagcagtggcattagattctcataggagcacaaatcttactgtgaactgcacatgcgacactttccttataagactctaatgcctgatgatctgtcactgtctcccatcacccccagataggaccatctagttgcaggaaaacaagctcagggctcccactgattctacattatggtgagttgtataatgatttaattgtatattacaatgtaataataatagaaataaagtatataataaatataaagtgcttgaatcatgctgaaaccattcccccgtcaccctggtccgtggaaaaattgtcttccatcaaactgatctctggtgccaaaaagtttggagactgctgatgtatcagataggtgatttgaaaatattttttcccattctgtgggttgccctttcactttcttgatggtttgaagcataaaaactttaaattttaatgaagttcaatttatttttaacttggtggcttgtgcttttggcattgtatttggcttgtgcctaatccaaaggtcacaaagatttgttgccatgttttcttctgagagttttatagttttagcccttacatttaagtctttaatgcattttgagttaatttttgtatattatgaggtagtggtccagcttcatttttttccatgtagatatccatttgtcccagcacctttgattataagactattcttttcctcattgaattgttttggcacggttgtcaaaaatcaattgactgtcaatgtgaaagtcagttttgtttcattgatcagtatgtctgtctttatgccagtatcacgctgtctgtattactttatcttctagtaagttttaaaatttagaagtgtgattattccagctttgttcatcttcttcaagatcgtttgggtattctggatccctagatattatatatgaatttaaggaacagctcatgaatttctgcagagaagccatgcaggatcttcataatgattacattgaatctgtagatgaatttgaggagtgttgccatcttaaaaagtgttttgatccattatctcaagatgtctttccatttattaagatctttaatttctttcaataatgttttttcatttaccgagtatgaattttatacttctcttgttaaagttattcctaaatattttatgccattatagtggaatcgttttcttaatttatttttcagattgttcattgcaaatatatacaaatacaattgagttttgtatattgaaattggaccctgcaacctgaactcatttattctaatagtttttaagtgaatttcttaggattttctgtatacaagattgtgtcatctgcagatagcattcattctggatgtttttatctttcttgcctattgccctggctagaaccttcagtacaatgctgaatagaagtggcaagagcagacacccttgtcttcctgatcttaggggaaacgcattcagtctttcaccataaagtgtggtatgagctatggaatttttatcaggttgaggatgttcacttctatttgtagtttgagtgtttttatcataaccacttgctagtatttagttgaggatttttgaatctatgttcataagagatactgggctgtagtttggtttttagtgatttctttggttttggtatcagagtaacactggcctcatagaatggaattgggaagtgttccttctaatttttggaagaatttgtaaagagtagatactgtttaaatttttggtaagcggtggagtggttttaaagtgtgtatttccatttcatgcccagtaagagtaatgtagaaccatctacatatattgatcaactgctctatgcagtgacttctgcttggtacttcacatgcgtcatctcattcaatgatgagaaactctgtgaagtgggtttcctcttttcttttttttttttttgagatgatttcttgatctgttgccaggctggagtgctgtggcacgatctcagctcgctgcaacctctgactccctggttcaagtgattcacctgcttcggcctcccaagtagctgggattacaggcacgcaccaccacgcccaactaatttttgtatttttagtagagacggggtgtcagcatgttggccaggatcatctcgatctcctgacctcgttatctgcccacctcagtctctcaaaatgctgggattgcaggcgtgagccacggtacctggccgggtttccattttatagagggggaaacaggtttatagagcccaggatctgtgtggctgtgaaacttgttgtctttgccatataccacacttaggatgtgatcacaagagattattctgtggggaatggtgacggatcagccagccgtgggggaagggagatctcatgtctggaagcctgaattttgaggggccactggcatgtgttcctcattctctccctgcctgttttttgcaatgctcagctatgtcctcatccatgtcacaaaggcagggatgtgattttagtagggaaaattacttgacagcctcctgcagaatgaatctgtaggggatccaagcgcaaaggtgaatcaattgcaatttagcccccatgttataaaagaccctttcccatcctcctctataccaactaatgatttcaaattctcttagaacacagctgaattgttactttttaaaaacccatacaaatagttgctctaataataaatagcaaaaacattttttaaaaactttcttcgcactttttttttttttgagacggagtctcactgtctcccaggctggagtacagtggcgcgatctcggctcactgcaagctcttcttcctgggttcacgccattctcctgcctcagcctcccgagtagctgggactacaggcacccaacaccacgcctggctaattttttgtatttttagtagagatggggtttcaccgtgttagccaggatggtctcgatctcttgacctcatgatctgcctgcctcggcctcccaaagtgctgggattacaggtgtgagccactgcgcctggcctcttcacacttttaattcttactcctctttgagtagactacaatttttgtttaattagtattttttcttttataccttttttttctggtaatagtcaccttattttggttttgtcaacatcatcagaagtccagcactagattagacagttgagtgtcaatagcaagttatctcttttccagaatttgaactgtgctggtccaataagacaggtaaagcaagtgggttgaagaccagagatcatttgttcattgtgagcttttggccttcctaagaccagatttgagagcccaaaatttagcaagacaggcaaacaaatacaaaaacatgaaagctgacgtggacccaatccctgttggactgaacaaaaggggatgaatgtgggaataaagacaaagacaaaagagtatatttggaagaaggggttgggggctccttgcttccagtaaacgagggccctgagtttttagctcccttcgtatttattgagtaaaagagatagggagaagggtgtggttgtcagtcagcaacttgactcggtgcaggcttgcacaactgcattctctgaacagtagtctccagatgtgccagtagataaccttaaggagcatggtgccagggagtgattgcactcagcaaaccttctggtggcaggtgcagatgtgagtttgcccacatcctgcattcatgataaacagtttgctattggatcatgtagcctcagtggaatgctgacttggtcacgatccacaggccttcagctctctacagaaagcctgttatctttgcaagttcctcaacaaggcatgtgagcttgtgatagacttttcatgatgtgtttgtggacattagatgaccataaatagtgctgagctcatctgtcttgttttaatgggatttttctttcagtacacaatttttccttgaaaacaaaagaagctttaaccaaatcgattttcttaaaaagagcatttacacgtatccagttaaaattcaaatcccacaagaggagcctctcctcttcccagcatcatgagacatttttcccctattgctctcttccagcgagttgcagacctggagcaagaaaatgctctcttgaaagatgagaaagaacagctcaacaaccaaatcctgtgccagtctaaaggtaagtaccaaagcacttgagttttatttggggttttaatctcttttcctcactgacttctcccaaagactcctagcaagcatgcagttagactagaggctacagtggggaaaggattttaatagaagaagatgaagaataatgacctttaagatcccactaggacatttggcctcaagagtgtaaagaggtgagacacgtataatgggcaacattgtacatgagacttggagtcagggaggcccgcacttgaagcatgattctgccgtgtgcttctgtatggccttgaataggctttcagtttgttcatctactacatggacataaaggtccagacatcggggggctcatgggaggaatgaggaagaggctgcacgtgaagtgcttaggagggtgcatgacactcagcgagcgctcaggagctgtcgtcatcgctgggtttcacatttgtctttcatgtccatccacgcatcatggtttcttctacccagtgggtcatctgttaatgtttactgaagaaacagtcttgaatcagatcccaggtcagcctctctcaagtgcccaccagctcctgggctgccatcagtccccatgtgccactcggctgtggaggagcagggagagtccacagaccccagtttctgcttcaactcactgtgattttgagcaaatccccttctcccatactcaggttcctcattcatgtcacaagaggatggaaccacatgacctcacagtcccacccaatatcacatctttttgaaaatgtgaactgttttcaaatgtccttttaaaacacttttctgtccattaatgtgaataagttttggcaggggagtagcccatccttctctatttgccttctttccttttaccccagtcgcctttaatctccctgcactcctaagaactgaaagatcaggactaggaaaggagtgtggaataagccttcattcttccaggaatgctgccagcagttgctgtgacagttggcagaagagaggctggggcatcaactgagggaattctcacctacgctgccaacttctctctccccattccctgagagcagggtctttctctccctctctgaagactaagccagagtaatgagactcacctttgctctgcagtaggtgaggagcgtaatagattcatcaagagcctctgatgagctcgtcatgggcagcctcttaacaagagattaatcggaaaacatgagtcaatacatgtgagggaatccatccagaaaaactgcagcttagcgtgttgctttccagatgaatttgcccagaactctgtgaaggaaaatctcatgaagaaagaactggaggaggagcgatcccggtaccagaaccttgtgaaggaatattcacagttggagcagagatacgacaaccttcgggatgaaatgaccatcataaaggcaaggggggtgcttctgctgtgccatggcacaggtccctggctcctgtccagcttctgaccacgtgatctcaggcactgctttctgatatgtgatgctcagtccatgtgtcatatatgcagcacttgccattactgcagagaggcaaaggtagctggactgggtgattcattcctactgacagctccttttccaactttggggtcatgaagatctcagttatgagtttaaggaacattctacccaagtgtgttatctttcctgtttcctgttacgggaacattcctgtgttgagacagtaatggggtgtgggagttctcagcttcattagtgtgtgtgtggcagagagacccacaagggcctgattgtgtctcctaatctgatgagatgcagtatacatagagacaattttatgatattttaggatctgtcattcttttttaccccatgtaaacatttcctccagaaatgagtattcaaacaagatggagtaagttaattgcatagaagccaggaagaaaagctgaataggaacatccagagaagtctaaaattgtcctaccaagctcaattttcacactgacagccaaatcagatgcaggaaaaaaaaaagtatttttaaatgaacagtataaatggtaaactatttttaatatgctactattttcataaaatttgaggagtgcaggttgaagggaggggccattctgggcaggtgtggaacattcctttcaagggagaagtgggtaatgtgactgcctttgtgcatttcaagagcaagactgggagggaaaggtttttccaggacttctcggagaaattgacccaagtgttaggaatttgcgtttcattaagagatgaaaagtggatgactacagtaagaactgtaggtgaaatgtttcatagggctagctttatttagccatcattccaagaagcaatgatacctattcttgttgacaaattaggcagaaggataactctagggcctgccaccatgggaggtaaattctcatgaacattagttcctaatgagctatcacgtttttcttgttgaacagcaaactccaggtcataggcggaacccatcaaaccaaagtagcttagaatctgactccaattacccctccatctccacatctgagatcggagacactgaggatgccctccagcaggtggaggtgagtgatgcaggctcttgggtactgtcctcctccagagggagtgtgtgtttttttctgtgtggaactgtccaagagaaatttactcttctgctgatggtgaccagagtgcccaggggctaattctcaagagcaggatcacttggactacagtggatttagagacagttctctggagttaacacttactgtgtaaagcaatacattattgttcaccttacaccctatccagaaaggaaagaagaaggtggatctctgattcctcttgaaaaaccaagaagctgatgcagagaggtgaaataggtggtttaggaaggaacagctaagtcattaaaatagatacaacttatccccacttaatatcatagtgcatatagtaatatcaataaataaacaagaaaattgccccctcacttagaagctggataaaactcagaacaacaaaaaatatttggaatgaaagtatgctgggtgactgtatctttgttggtaatagcctcttagtcagtcactaaatataccacacagtggactgtgtggtctgtgtataattttgtcaaaggtacaaaagatacaatttttcctctggcatttgaaaagaaaatcacaggcacatgcgcgcgtgtgtgtgcgcgcacatacacacagaaccttgtaaagtatgtggaaataacatggaggagagacagaataaaaacaaatgggtttggagcagttctttgtgcaggatctgctggtcagtgctagagaaacagtggtgactgagccggagaagtccttgccctcatctgacagagagctagtcagtgagcagttagggaagaaacatgtgatatgattgcaggtcctgctaagtgctataaagaaaaataagagaccatcagcaatagagaatgctggagcagagggtggagggagagaaggaggtccccagaactgaaggtctcctctctgttgtgcggttctgcgtggcttgctgcctgccagacgcacttagtaagccttgcataactgctggcttgagatgcttggctttgcattgcggtcttttaagtctaggcccttggaggtttcagtcagcctcaactccaggcttatcaccctggtgtttgtatgtgtgactatctacatgtagacataagcattgtcatcactggttttatgttctttaaggaagccaagactggtccagtgctggttaaacatgaagccttggtggaaccagtgcttattaaatcctggtggaaccaaattatattgtctcacatgtacatacatgtgcttaaaaatccacatggatgtgctcatacacattacccattcacaggcagatagacgtgtttgtacacccctatccccacgcattggagtcctggagggcaaactcaggcatgaatccaaaaggaacaaaatctgggaaatagatgctttaagatctgttggataaataggttccggggcagagcaagcattgattccatttcaagatgcaatcaagtgatggctgacagcacattgcagtgattggtaaccatgttgattcctcatcaggaagtgctatgtcccaagttctatagtttctctggtgtgagaccattttccagaagtgagctcttttaacttccaaagaaagtgcctgtgtttttatccatttgttcttggaatatatggttggtcattttaagtggctcacacaggaggaatataaatggctgagactcagatgttatctggacagaaaatgagcctggagcaccaactgtgatatgagaaatgttagttggttgtcattggctttgtatttgagatgcaaattgatgtttgggaggagagaggagacagatggctgatagagagggaggcagtgaagtgctgtgtgttccctaaggcatgtatttaggaaaaccttttttctgtgcctgtcttcctttgaaggaaattggcctggagaaggcagccatggacatgacggtcttcctgaagctgcagaagagagtacgggagctggagcaggagaggaaaaagctgcaagtgcagctggagaagagagaacagcaggacagcaagaaagtccaggtacgtgaaggggctgcagtgctcttatggtgcttggatgagagaacaatctagctcttgtgtccagggctcatgtggcatgtgtgaccacatgggattgtgctcctgctaagtctcagagggctcctacttagtgcattggagtcatgctgagtcttctctgagtgcccctacaccgcccagctgaacaggagtaagctccctcatgccccgggtttctgttggtgaagctagggggaagtctgtggcatcatcacctacttgcaaagaggggagctccctgccaggaggaccagggtgtgtaataagagtgtaaatacagcagaagtcaaatgtacacagagatgacctatcgccctttcatacctgggatcttgcatgggcttgggttcagcctttttgggtcagaggcagaccaagtgtgtgtcactcactttcctctctcatggctgcacccttgcctcagtccagattatcagcagcctcttgggtctagaaaggatattgtttgaaatcttagtagccccaaaagtaatcattccatctcaaggaactactgggcacccatgctgcattcagaactatgccagtgccaggcacgtagtaggtacacaaaatgttcattaaaggacagcagataacaatataagagaaattcccagccattgaggaatttaaatgttatgaggaatttagatgttacgtctgggagaaccagacataacacaggtgaaaagtaaaaaataacattggtagcacttaaataaatgcaagttgagtgcaaacaggttggtgccataggagtagagaatccattgactatagcagtgctaaggaggaaagaaccatttatttctttggagatagaaggaccacttctaaagggtacaaggccaattctgccatgggttatatcatcagctgaactcatagtgggtttgaaaaaggcctttggtatgttctcaggcctgaattattaattgtggagtttgacacctaccccatgttctcaatccctaccccttccctcacttctgtgtccagtcattttttgcaacacctgtattccctttgcaatcaattgtgatacagattctgatctatattgctggcaaattcttgttttttttccccctgagcagtaagtggggaggtaaatcttgccgatgggtttaaatctctcaggtggacttgattcagaatggaaagtgaaaagattaggtttctaaatgactcattgaattagaaggaaagctgccctgacaggcaagtgcaaatcaaatctatgaaaagctacacagatgacatcagacggtgcctgatgtacaagttcttggcctatccagctgtacctaaagattcattctccaggctccccattgcagacatgccagctaattttggaatcttggctttagaacttctctggataccaaataaaaaagggtatctttttcctccaaaataaccactgaacaatagttagaactctaggcctgggccatagctctgtcatgtatattaaggatctctctttagggagaatggccttgtttctgacagtttaaggaaggaaaggcaggtgtgggttgggagagggtatgggatccctctacagcaccctgaaatggagcttttggaggtcaagttcttggattcgcttttggtccaaagagggatcctgaactacctgggtcttcattctggagagagatggctcaggtctcaactgcagagagaggccatgcactgagtgaggaatggcagggaagcccatgggatgtaccatcagtatggaagtgactgaggcgctgtgagggtggggcctctatgacagtctacagtcagtgcatttgacctcccacccagccacctccctttctcaagcctggcaaagtcaccttggccaatagggtgattcctatgggcttcccacttacgaacgtgactgccagcccatcttaatagagccccttgagtctgagtaggtgacctccactttctgagaatgtaatgtactcaatatcatccacggacacatggcaaatccatgctacatagaacacaagtacagaactctcaccggagcagcaggttgaatgcagaccctggacagccacagcctcctataccactggtggtggtggaggcaaaacagacactggtaccttggaggggttttaagcccagattgcagggctggaaacagtgcggtaactgtaggcatccttcagctgggaggagtacaggagatgctcagatcctgttcctgtctccaagcctggggcacgctagtgcatccacagtgggaggacttaacactgctagctagcacgtaggtaatctcattaagtgatctgtccatttttacctccaaaaatccatcttaatcagggactaacacccactacttgaaattactccaagtagttaaccatttatgaagctgtttctaccccttctcattggcaatttaagtcaaatagcagctaaataactgaggaattatttgctcggctgaatcctagtgagttgttattccagaaattgccatagacaagcactagctttggagttctgatgtcagacagcattacagagtgttgtgggccatctctactacctgcggtagtgtcatggaggaagcagctctctgcaaggtgcttagagtttagttgggaaacaacacactggggagctttcctccctcataaattggaacgtaacttgttagccttgttactagagacgtagttttacagtgtgtgttagcttcctagggctgctgaaacaaaacaccacaaactggatgacaaaacaacaaaaattcattctctcagagttctggaggccagaagtcagaaatcaaggtgttgacagcccgtcttctcttgaaggctttaagggagaatttgcttcatgcctttctctcaacttcccatgtttttggccatcgtggtgttccctgcctggcagctgcgtgactttagcttctgcctccatcttcacatggtcatcttccctgtgtcgtcttccgactggattagtgtccacccaaatgaccccagcttaacttgattacatctgcaaagaccctatttgcaaataaggtcacattcacagtttctaggggtgaggacttcagaatatcatttgggggggcaaaattcaagccataacacagtgctatacatattcaacctataagtgcctgtggggaccatgtgagtgaaagtgggggtggggacaggagggaggtgttgatggaacacttcatggtaggctggagtgttgagctgcactttgaaggtgggaaggaagtggacttgtggagggtgggggtgttgggtattcacgcacaggcaggatgagcaagtttgaccacagttggaaacacctctgtggaatatcttgctcgaggtctgcacttatctttgtgtctctatccatgcaggcggaaccaccacagactgacatagatttggacccgaatgcagatctggcctacaatagtctgaaggtaagattcttgggggacaggcttcctggaacactcccctggcagagggcagatgacaaatctgggcatcaggaaatcaggccctgagccccagtctgctaacaaggagagcagtaagcaggtagcttcccttttccatgctgtagtttcttaacctttggaatgaagaaaaatttgtatctactacaggaatgataataaatacataacctacccaatataatttcagttaaaatatggccactaaaaatcacttaggaaaaaaatcaaggcttgcatgggtagacatagggcagagggatctgccagtgtgtcctctgctggcatgcagggagacagggcggtagaacagtgggaggtgagtgggtcccatggcagggaggaatgcacagaaaaggggcttccgaacaggcccaccccattcccatcctcaaagacgtggtaatgtgggaatttagcctatctgccagtcacttacaggactacaaataactctggctggttggtctgaaggtagtgagttatttcaatggactgttcacagtctgttacagatcgaactccttgttctattccttcccctgtcttactgctgcacttgacttgtcaaaaaataaataacttgtcaaaaaataaataactctggtaacagctacattgcccaggagaacagtcttgaatcattcccatggcttatttctaattttttaaagtgtggtaaaatacacaaaaaatttaccatcataattaaccctttttaagtgtatagttcaatggtattaaatacactcataatgttatgctagcatctcaccagcacttatctccataactcttttcatcttttaaaactgaagcccgtacccattaacaacttcccagttcctcctcccccaacctctggcaaccacaattgtactttctgtctttctgcattagacaattctaggttcctcatgtaagtagaatcgtatagtatttgttttttgtaattggcttatttcacttaacatttgtgtcctgatggttgatctctattgtagtatgtgtccatcttcttttaaaactgtgtcccattgtgtgtatagggatcacactttgcttatccatttgttagacatctaggttgcttctctgttttggctattgtgaataatgctgtactgaacatggatatacaagtatctctttgagaccctgctttcagttcttttaggtatataccccaaagtggagttgctggatcatgtggccatcctattattaatttttggaggaactgctatactgttttccatagcagctgcaccattttacattcccaccagcagtgcacaaggattccagtttctccacatccttgccaacacgtagtattttcttttcttttatttatttatttatttttttgatagtagctattctgataggtgtaaggtgatatctcattgtagttttgacttgcattttcctgatagtaatactgagcatcttctcatgtgttgattggccatttctatgtagtctttgaagaatgtcttttcagtcttctgaccatttctgaattatgctgtttggggttttgtgttgagttttaggagttctctacatattctagatattaatcccttatcagatacatgattggcaaatagtttctcccattctgtgggtcatctttttattctgatagtgtcttttggtgtacaaaatgtttaaattttcatgaagtccaatttgtctatattgttgcctgtgcctttggtgtcatgtttaagaaatcatcaaatctgatgtcataaggcttttgccctatgttttcttctgagagttttacaattttaggtcttacatttaggcctttgatccactttgagttaatctttgttgaagatgtgaggtaagggcccaacttaattcttttgctgtggatgtccggtttcccagcaccatttgactttttaaacaaccagggccacacagatggcataggagggtgtgtcatagagatctccttctggagttattgattagacttactttcctcatgtgatattctaaagattcaaaaccctccaaggagcctgggagtctttcagtgggataaatgcctgcagcaaggggacttctgcatgctaaccttcacccgcctttcccaagggaggcttagtgcctggggatgaaaatgagcatgtgaactattataggtagcactttcggggcatcaatcctacccacccttttagaagtaatgagaggggcccagtagctccccagcagtagatgtgggactgatggcatcagcatcactgagcttgctggaaatgtagattctcaggtaccccacccccgagacctgctgaatcagaaggctgggatagggcccacccatctgtgttttaacaagccctgcaagggattctgttgcccactcaagtctgagaaccactgtactaccctacgcatgaaactgcctcccggactcctgcattaaaatcagcgcaaaaactcctcctctcatttagctgtccttgaggaagatgccccttcttgattttacaggcctcgtctccactgccaagcatggggcctggcacagagagggcgcaataaacatttgtcttaaactgccataagtctaaatagctgctccactctgctgctgttgacttaggccaggattctgaggatgtgagacctggttttcccagcattgtctctgatgaaatgattttacttgtgggccttgtcacagaggctggtcccggggacccctggggttaaaattacccatgtaaggaagcactcatgttgaagaggctggcttgggtgcttctcaaccaggcccagcccagacattcaggggactttattaccacttactagtattttttataataatggaaattgggcttttaggcagaacacggtcagcttatatttagtgagctcccgctgtgcacatccctcctgaatgctctgaagtgtgcaaagggatgggaagtgtactgtgccctccaaaattatagactctacctgagcaggtaagtcaaagcactaagatgatgagtcgatacacctggccactcagctgcctcttgcaacctgatccttagccagttggatttgaaaaagctgcccacaggtacatgcacaagatgaggctactctaggaagacaccttgacaagtagtgattttttgcttaaacccttttaccagaattttagaaatttctgctgatccttctggaatgcaaaaattaactgcagctctcggcagaagcacattgactacgtaccctgcacaaggcttaggtgcccccatttggggtaaggtcatgtagaagggttctcagggccagtcactcctgcagagcattgtctccggaggcctgagtagggtggatggaagatgggtctccctgcagtgactgttagccccggccagtgtgcaaaagcagaggagaatgagtggtagggatggtgagggcaggaagggtggctctaggggaagctcaccattccctggtgcctgagacaggcctggtagccaaaaggagccatgactgtgctgacctggaagctggctgggcagacagaccctccttacggccagcagcagtgttggtttttctttatcgacctgctatcagccagagctggattcaaatcaggagatggtacccactgactcagagtttgtgcaagaatgatagagaactaagagtccagcttggcacttaaacacttttcacctcaactgactatccagccattggcttatccaatgttgaacgtgcatcagaaaagactcagttgagaagatccttcgagtgtttttttttctccttaatgtgtcctttttatagacatttttcattttatttgtaaatttattaaagtaattctgttcatcttagaaaaattttaaaatacaagaaaatctagagaatttttaaaaaatccatattcctgccacttaaaggcagtctctgatattatttggatatttatttctaatgctttttatatgcatatttatatagttgttatatatataattttttattctgctttttttctcactataacgagcatttttctacatgtctttgtaaacatgatttccatggttgattaaaattttatgacatgattatcacaattatccattctctaactgatgaatatactctcatgttttacttttataaataatcctgtgatgaaactaggctttttctgagagagaactggactgtccattttattaaaattcctcataattttaaaacaagctgtatccattactgtttactgtggctagatttgtgagagccattttcacaactttagcttgttttatggaacacggatcagttttactggcttaaaatcttacagagttatagaatggtggtatagtgttgactatatatagaatttcaatgaacccttattcaaaattgtgccgcctccagtggtaacgctcatcccgtgtgaaatatctactttgtagtggtcatcctcatagagtgctttccagggatggactgacgtttaagaaatagacacccaaactctctacagaaaggtttcctgcccagtccaatgtccagctaacctagggctacccagggacaggaaatcggaagcatgcggtgtgcagggcccagcctcagcacactctcccggggcggtttcacccccacccacccacacatcctcccaagacttcagtcctcaccaacatactgatccatctctagcccataattccaactgctcactgcgccgtggggactacagctgcacacatctgaaccctgaaaccccatcttgtctcaatagatgacacacgtcacccaagcatctagactttcttcccactcacttcccacatccaagcagtctccaggtcttgacagttccacctcctaaatctctgtatctcattcacatctccctctgctccctgccatgggccatgccacgttatactccagccaggtggcccatctccccatgcaaaccagggaaacccttctgaagctctgcgatgaccagctcactgctttttcctggatccagcttccttccctggattttggaatctcttgacccccaccagctctgctctgtcttctgcatgacagcatttccccggcaagtcctgcttgttcttctctgaggcctttgtacctggaggcctcttgtctgcctttttcacatagctagctgctcctgtcctttagctgtcagacctgttccctccccttaccctctggccctacccctctgagtcagtggatggcattcttctgtgttccccagtcactctggattcactcatgtcatagtgtgttccaggctgcagtgccatgatctgtactttagtgtaattgataggttctaagcaggtgttgtgcctgcagcacctagcacagtgcctggcctgaagaaggcagatgatgaagattggtgggaggcagggccggggaatgggactcccttattctccaactggaatggcatagcatttgggtgcacaaaaatatgtctttcacacaaattcgtctgtttccatttatatgaggtacctagaaggttcaaactcagagacagaaagtagaatgatggttgcagcagatgaggagcggggatggggagttagtgtttcatagggacagagtttcagctggaaaaggtgaaaaagttctcgagatggatggtggggatggttgcacaacataaatggacttaatgtcactgaactgtgcacgtaaaaataggtaagatgaggtcgggcgtggcggctcatgcctgtaatcccagcactttgggaggccgaggtgggcggatcacgaggtcaggagatcgagaccatcctgactaacatggtgaaaccccatctctactagaaaaaaaaaaaaattagccaggcgtggtggtgggcgcctgtagtcccagctactcgggaggctgaagcaggagaatggcgtgaacctgggaggcggagcttgcagtgagccgaaatcacgccaatgcactccagcctgggcgacagagcgaaactacatctcaaaaaataaaaataggttagatggctaattttgtgttttatattttttaccacaataaagcatgcatattcttttggcactgttgaccagaaaggatgatgagggaatggtagtgaacctgtgggggaggagaggggagtggagaggagaggttatgtgtgggggaccagtgaggtatggttaggggagatggtgtccaggaatggttagagaatgggataaatagaaatgtcacagatgtgccctgggtagaaatccttgaaaaacagccagagctttcaaccaacctggctctgtcttgaggcacaatctcacagctgagtagggcctggcgtggctgtcagcacaggcacacagccaacagctgtcaccgagctcagttctggcctgtcacagctggaggaaaccttagccaccagctgttctcactcccttaagccacacctgaggaggctaaggttccaggactgtgcagtgtgcaccttgagccaggaggggacccagggctgcctccacacccagtgctcctctagcatgtgacactggctctcctgaggatggccttggctgccagaagatcacccaggcactgaggggatccttaactcctgaacttagtaaatagactcaccataggcttggtgactcatcaatgatcattattaatcaccttattttggggccctcatcatgtctgcagagttactatctctatgcatggttctaaatcttctggaaatcaccacatatatggtggagtcacaggggcgccctggaccaggagtcaggagccctggccctctgtcctgggtcagtctctaaacttgctgtgagccttcccctccctgggctcagcttcctcactcagcaaatcaagagattcattctccccagcggtcccctggttccatcatgctatggctctgtaacaaacatgcaaccaatgcatactcatccacatctttgggtttcctttgggaaattttgaatctcatgtatcccagggtcctgccggcagtttgtgtgtgatcatcagacttcatctcaaacacaaagttaaatgtactatccagaaaatatgaagtatgttccaaagttgagttcctatagcacattcaattctgtatgtaggtatttttcctctgctgacagggacagttggtggctttctatatgaccaaaacaacaaaactgtgtccctggtgtatcttccaagtctaattagtccgggacaaaaatgatgcttcctgaaaaatagggagcaaggggttctctgggcaaataagtttaggaaatcctgcattcttgtatcttttcttggaaagtcacaaagcgtgtgaacatatttagattgtaggaattcttatgtttactatatgtcatttaaaattgtgagcccagcatttccacaaggaggagtttcacagccaaacatgtttagcaacacgaacactgttgaatcactttggagactgccgctctggaggcattgtgcaggtgcttcacacttgtgacttgaagtcatgagttcacatccaggccccagctttgactgcttgctgatggcagtcagaactttccatgtgtgtcaacgtttaaagagcgaagtttcccagtggacaaaagaaggggaggaggggaggcccacacagggagagagccctagggcagggagtaatggcagcggcccttgggctgtcttccagaggcaagagctggagtcagagaacaaaaagctgaagaatgacctgaatgagctgaggaaagccgtggccgaccaagccacgcagaataactccagccacggctccccagatagctacagcctcctgctgaaccagctcaagctggcccacgaggagctcgaggtgcgcaaggaggaggtgctcatcctcaggacccagatcgtgagcgccgaccagcggcgactcgccggcaggaacgcggtaacaagatggcggcccgcggtggggctgccgaggggtgaccctaggtggtagattagtgtttttttaattatctttacccacgagggtctaaaacctgaaagagcagagtctctcgctgtggggtctcctccaaaaaggcagagcaaaagccttgctgccctgtcagcatgaccttccctgggggatgcagctacaagcttctggactcttctgaagttaatatgaagatgtttaataggtaacctcagggtggccttttcaccttataccccttgctgtttgctttctgaagtggagagagtcattggtcctcctcagtcccccagggtggcaagtcctattcactgtattttcctaatgttctcactttctggggcagactagagccagagggtggggacagaggccacgtgggtcactccatgggctctaaaaacctgagccacttctgggcatgagcctcgggacagctggggtaagcaggtgctgaggagtgtggaggattccagctgaaccagggtctacctgtgtgctctggacttgggtgctctctcctcccaggggcacctcctggccatcttcccccaccgccccacatgcagctctgtctcagcctggcctcgttgttctgtgtctcttccaagatgaccttttggagtcatgttcctggcgtgggtttgattgtggttatctctgttctttccaggcctttgtcttttcccaaaggcatgtttttatacctgtttgtatataaagccattttgtggcaattgtttaaccagagttatttttttatctggggctttctaggagccgaacattaatgccagatcaagttggcctaacagtgaaaagcatgttgaccaggaggatgccattgaggcctatcacggggtctgccagacaaacaggtaaggccgccgcggtcaaatgtgctggacgaggccgcggagaagggccctgcccaaacgagtctgtttggggttttcctcaggtgatgaccatgtgctcagcatcagagaattatttattagaggacacagaaagactgactcagaacccctgccctactgttagctcagcaaggctcgagcaacacgctctcagcatctagagcccaggtcccctgaaaaggattaggaaaaaggagcttccctgggaggatgacaggagtggaataggaaggtctggctgagaacagcttttcttcttgagaggatgctggctggggaggggggtggggggtggctaactggcagcagagggctgcttagccatctgctgcaatgcccttctcatgcatgcagtgtgtgtcacacagtgggggcccaccctctgtcattcagaacagatggaacccaagctgggcacttgggggtggaatggaagcatttcacctccaccgtcttagccaaaatgagatctccctggatgtgagtttagcaaccactgtcccctcgaaaataagctgagccagggttaaggcaagcaagagtgattgtctgagggcagcagcagggccaagcgttgtcagcagacagaacgcagacccccaaggcagagtgtctgagaaggtgcactgcagagtccactcctcacggtttagtagcggtcacatgaccgataggtgcctcagttgcctcatctgtgaactggggacagccatagcggcatccttcctgtggctttgggaagatggggtgagctcctatcacctgtgtaagggacttaggacagtgcctgcctgtggtgcgcacatgatgagtgttactgccgtgatactgttgttatcatctgcttcctcatgcccctgtgggcacctataaaaacggagctgtctggccgagcatagtggctcacacctgtaatctaagcactttgggaggctgagatgggcagatcacctgaggtcaggagtttgagaccagcctggccaatgtggtgaaaccctgtctctactaaaaatacaaaaattagccgggcgtagtggcgggtgcctgtaatcccagctactcaggaggctgaggcaggagaattgcttgaacccaggaggcggaggttgcaatgagccgagatcatgccattgcactccaccctgggcaatgagagcaaaactgtgtctccaaaaaaaaaaaaaaaaaacatggagctggcctcttccctggctacctttctctcttacctcaactaatagaatgttgatcaagtatttgttcaaaattggtgaaaatagcaaacatttcccaaaaatgtcattaggtggcactgtgagtgccactttaagtttttttgcaagaatgtcacagagtcactgaagacttctggtactttgattcccagatcttttcatccagtccctctttctgcagagaaggagactgaggcccgggggggtggaacagcttaggcccacgggtggcctgtgcctgagtcaaggtagaatccggaaggcctgactcaggctggggcagtttccagccactgagtaggtaatcagaagttgaaggtggtgtcacaggctccaggaggaaattaaatttatttcaagagaggtataattcttttccctaaaggagggagaaaaggaatgaaggtgactctctcagtgctaaaactggagtcaagatttagtcattttaaattatcttgggttgaagataagaaatgagatgaataagaaaaagcccaggtgatactaaagtagaagggaagaagcagctgtgtgcttggtctgacaagcggtgtgcgtatctccccgatcttcagagccgtcaccattggcagcctcttttattcatgcagcggttgtcagggatccagaccccagtttaggttttcccaggggctgcttaataccctggatttgtcttcctttacagcaataataatgatggtgataaaataaaaatagcttttattatatcttaaaataattctgttcccagcaagcctggtgtacaataggaaattaatagcctgtgaaactgagttaagtacagaaaaggagctggctgccctggggagtggaggcctgaagagccagcttcgcagtgtgtgctgcaccaggtgctgtggaagtggccatggtgggcctgcctctctcccagtctggcctttagctttgggaagtgttcatgattgctgcaaatcccagcattgagggaggagaggcagggaacagggacccaactgggattctgtggagcccatgacaaggggattcccattaccatgagggccaccctggcaactggggtgctttggagatagacagctgctctgcgtttcctacagttttcctgtaatggagagttctactgtttaaatataaattatatctacacatgtgtgatttgtgaaagaccatttagaattttgatgacatctatcctctccctagaggaagttacactcatatgctgaattttgcttagatttctgggggcttccatcacattcccagtcatagcctctttaagcattcatgatcctcaagttcagaacttttatcacttgctaaccttcataagtttgtagagttttgttttggtccctataactgtgtcttttcccttgttttgaactctggggagagaagctattattgaggagctgctctgagaggagctgcaggaatgcgggtggcacttctgcttccacaaagctttctccttttttacctctgggaactaagagacaccagcatcattatcaccattttatatataggaaaatgaagggggaagagggctgtgaacatgagctgggtgctgggcagtttgtcttcttttcagggctgtatatgggagaaggatggggaagtggtttaggagggcacaagttgccactgccctcagcccaacctcacctcggggtgagcacttaaagtcagagttaggtaggggcaggagtgtggccagggctctggtctggctctttgacagtgctcctttgattcctgtccacttctacccaagccttatcaagagtgtaaaactccaaagtgagactggtgcattcccgaggtcccagaaaacctcctagcagctcctctccatccagcaggtccccggcaagacaggaggcctccaggcattggcacctgggcttggtcgggcgcacctggggttattattcacacccgccgccccccgccaatacacacaccaggggcctgtccgggacagcggagactgtgtttgacaaggaactgtgtgcagtctcaagatttgctcggagctgttggctcatttgaccttgagcctcggctgctgtgggctgccttgctcagaatggcaaagaaggcgggaagagctagcttctgcccagcccctccccagagggcccagctttaaccagtcctgactaagagctcttggcttttttcaaggaggtgatcatttccttatgttccccaaagttctgctggtcctgagttggcagcacagtttgggtctgctgtaatttcatggctaggtcatattaatccacaaactgttcaccctcatatggccaggcctagggcctcagatgtttctctgttgttcctggtgtttggagtgtgccttccatttcccagaggtcccagggaatatgctaggaggttgaatagaaagcttgggtatgaactaaagaagttaggctgtctgtggagcacacagtgggctttttagaaccgggaaactgaccatctctgagctggcaggaaccttgtctgtttccccaggaaggcaggttcttaactgtggcggggccgtggttgatagatcctgtttttccaatatcttcacagaggccaagtaaatattatcctaggccttgtctggctttttataagatctggaagaaacctttgcaataaggttagtaattaaagatctggaagaaacctttgcgataattcagtaggctactttcactttacccgtaaagaaagagaggcccagggcgtggaggtgattagcccgggccacgggctcattacaggtggggctgggagttgccccaatgctaggttctccagccagtttcctggatgccgagcctcactgccccctgtggctggagactgactgcagtgagttaacttatctctgtgtgtcacagtggtctctctggaaatatttgtagatttattaattgatatcaagcacttacattttcaacaaaaaatcctgagccaagtagtttgggctttttcttttcccaccaggaggtggcgctccctccctggccttggcccataatggcctaagtggagctggaggagctcctccaggggttctttcctctgggaaccaacggctgaagcaagttggttgactggtttttagtttactcgtgtgtctgatttcctgagcactgtgggctgcctgggctgcacagttctctacttttatctttgtcaatagtgcctggcttgttacagaattaagaattctgggagtatggccctgtgaggctggtggcctgggcattcattaatcctaactttcttgtgtgagtcagcttcgcgtgccccaccctagagagctctgcagtctgtagctttacggggacgacagaggtgaggtgaacctctgagacagagccccagcagcccctccctggggggtggggggctggaggctggaaaggagctttagttcaaggtctggagaccctgggtcctggcgcaggagtcagtgtctctctggtgtgggaaaggaggtgggtggagcccaggatccctgcacttgttccctttcagcgctgatgcgctctacttccggccctccccaagaatcactgcagtgggtgcctacagtcctccagtgagctgtgcctttgggttaaagcaccagccatgaaaggccgtagtaaaatgcaggcactaacatctgagacgggatgatgctgagttatgagtttgggatttgttaaagtctatgttgatgttaatgatggagaggtataatgaggcacatccgacccccacttcctatcgtggcctgaaacagtctctcaggttaaacattaaaagagccctggctgaggaggaagtcccttcagatggtggggggccttaggattttatttttggtttacagatggtttgcaccctgggaatgaggacgaggggattacaggtcctcatttagggctgtttggatgcagttcttgctccattattcctgcctggaaagctggaatctggcctgcaggaggagtactccaggaacagaggctgttaggagcagggaggtgcggcagagtcctgctgggggcagcaggcccctacctgccctcctccacccaactctgctggcccttgagtatctctgtgtgcccagggctgcgcaggttgaggacctaggtggaggtggaacattggacacacctgacctccaggagctgcccttgctggcatggggcagacactgggtgacttggacacagcaaaagagtttgcatgtagaggggtaaagagttctgctttcccaaattgagtaaaaagtggtaacgcaccccagtcccaaggtcaaggggagacatcattcagttctcatctagggcatcacaaaacttgttttagctattggagaaagaccctgcaaggagagctgaagttaagattagttaatatttttgtgcctttaaggagtcccagaaagatctgcattgaaaagcaggtagtgtctgcagtctccttccttaccctgggtgggcctgacgtcccccaggggcttcccatgctgctctgcagatgcaatgtgttccccaccatgagcctgctcactgcctcccgcttcctccatgcacacttagggttctctcctcccagccccttttgcatctctccctgtgcttgtctgaatcaatctgattgagggaagcaccatgtgtgaggctatgtgaatgcttccacactacccacactgctgccttgctgccatttacagagttaccagaacaagctggccctctgctgtctctggggcagcatgctttcccacctggggttattagcaggccccacatgagaccacatgaacccacttccaggacagtacctgaaactggaggacttatgggagagatgctgtttgcaggtgacaggagaggaggaagggaaaatgggagttcttgagccttgcctttttttcgtttccaaaccttggctagaatctcctcactttccaggactccctgcctgcctgtctcttccgtctacactggacaccctgtttttctgtcctttgtttctagcaagactgaggattggggatatttaaatgaagatggagaactcggcttggcctaccaaggcctaaagcaagttgccaggtggaacatattcctttcttcctgtgtctgctttgtccgttgggcctgctcatgtctatgcttaaccgtttttcagctacagtgggtgcgagagcacggggaacagttggcatgcagtctggctggtagcccctgtggttgaccatctgtcactgtgcccaggctgtacagatatggctgagggtggctggttgtttgggtcaaggtgatagcatttagtggacctcctgaggtccagcctacttgttctataggtgaagaaagagacaagagcaggaggtcacatagcggcaggcacacagctctttagaacaaggctgagaaggaaacatacctctggggaatcctgggcctgtgctgctttcacactacatattggccctcctaactgcaggatcagccaaaaatgtctgcctgatctgtgctgctggctgtgctccaaatgtaacctgtgcccccagagcctgccatcagtacgtgtgctggtcctgatctccgggactccctggagctgatggcagccaagtgcagtgcatgcgccttgacatctggcctcacagcaccttcatggggtggggacactgaagcccggagggtttaaggaaattgctggtgaaacagaagatccagaatttgaacctggttccagctgataccagagtctgtgcctgaaacccactggccctcagcagtgggtgagcagcttagccagacagggtaggcatgcagcaaaaggacaccatgtgatggtcacaccataggccagttgactgcaggtggcttttaagagctgtggcatagctttgcctattggagcctgactcaacaagagatggactggtagtcatcgagcttgctttccagagaggaaaccgggactcaacaaggtggcatgagtgctggacccagctccctcagccaggtggtggcggagcaggagccagaagccctcatgctgcttctccttgccgcctgctgaggatgtagtagaggtactgttgcaccaagagcatctcttcttggaaaaagaaagtttactcagctgattgacagggtagtgtttctctgggttcagatgtggccccacaatctgtgagcaaggtgacatggtgggtctgtttccttgtgaatggaataggaccttcctcacggggcattataaggaataaggttaatacaggtgaagtactttgcacatgcctgatacgtaaccatggaataataaatattagctgctacttctattactatcatggttattattcaataagatcagatttctgtcccaccaagtagtttgttttattggaggaaggatccttgtgtgaagccaggtgattcctcgtgcctctccatcagcagatcagacatggtttcatgaatcggcaactgaatgcattaataaagcacagacctatgaatcaagagtcctggtttctagaatcagccctgccactggtcgtggcctcagagctcttttggccttagttttctcacctgcacgatgaggtggctagcctaatgtttaagtaggaacagaccctggctgagtcagctacagtccacctggagaataagacatgaacagtgaacgtgctgcacaaggcaggagagaaatcctcagggcagctcgcctagaacccaagagtgtctgttctctctcattaaatgtataacttattggtgactacttttaatgtgcttactgtagccaatattggatattatctaaatgctgtatttcatttaaaatcctgatttaattacccaattatcctccacaaatctcatgttatttttctttagtaataggtaatatcgcctgtagtgaatgagtgattttctcaatcacttcttcattcatgtaactttgttgaggagccactgggagtcaggtgttacacccagtgctgctatggagctgactcagctacataaaatgtggttgcttatatcaacagtgtagactttccctctctctcttgctcccttgtagacatggtcccacctgtcttatgataattctcacctcccaaaccatcagaactgtaaaaaacatggcgccttcctccagggcagccacggcctccaacagctgtgttagaggcacaaccagttcctacctgtgtgcctaccttggtcataattgttatgtgcattcctggaagacactggggtggattttttccatgtaaccatgtctggaagctctttacagtacagtacctctcccccagcaccctagctttcttccatatgaagcctgctgcactgaatcggaaagctggtttaagtaactaagtccaagaaggacaacatcatggtcatattagcatctaacttcctgaagatgcggctgcctgtgagccttcattaatctcttgccttctattatgatgggagcattgcccaggtaactggcacctcttggtcttgggccttttgactcagaatgttataagacttctcctcaatctttgcaagatctctaggtctctctgcttcttgtcatgacaccagctgatcttacaccttccccaagatcatttgcaaatagtcttagttttcatttttggctggaggaaacttgtatgtaaaaattgtatatgcaataattgtatgtataaaataaaatggggctagtaataatggtaaagataaaaaaggggctaatattttgcctttctaaaacttgtggagaatctgccacagggaaaatatgtgaataatataattagctcagttttgccagagttttatcttaagaaggaggttcttgtgaactttggggcagatgtagatgtttttatttaaaagatgctttaagagatgtatttctgttgatggacattttgacagggagacagtctttcaatcccaaaccattaaactatgctcactgaatgaggaacaagggtcgagagaaaggcttaggaccagaagtgcctttggccttggtttcccatcatctgagaggaggacactttggcctgcttgccttgtggtccccatggcatctgtctcctgctgcattcatccctctgggggatgtgcaaccgctgctgctgtgtgcttggctgctcccctgttatgtttctgcctgtgtcccctcagatgggggccctggcctgggccacgtgctcacctgtcctctccctggcacaggctgctggaggctcagctgcaggcccagagcctggagcatgaggaggaggtggagcatctcaaggctcagctcgaggccctgaaggaggagatggacaaacagcagcagaccttctgccagacgctactgctctccccagaggcccaggtggaattcggcgttcagcaggaaatatcccggctgaccaacgagaatctggtgggtagccatgtctagtggaccccagctttgggaagtcacgttctagaagcaaatgggatcggggttgcctttggcaaaactgacaaggttcatgacccttggccctatagtaggaacagagattctagaagtctccggtcaagaccccttcactggagctgaaagatctcagacagccccactcctgtgtctggggccttgtcgttggctggggggcgtcacctgccttcttgctgaatttcactggtctgagctgctttacctggctgctggcttccaagaggatgaaagcaggaacagcgagactcctcaagactcagtccctgaactaactgttgcttctgcccattgatcaaaaccagtctcatggctaggccagatatggtgagagagagattctacctcttgaggggaggagtagtggaagaagttgttggggcctctttgcagacagtcaccaaaggagccccagcaggtgccagagaaatggaagagggcccctgtcttatgagagcttgcagattggtcagtaggggaagcaaggtatgtaataaagaagagaaagtagatagtgtttttaaaagcatgattctgcattgagttaacaatgagtattacaggaagagaataaatggtggggcgagcttttgggaggacatgaggcttgagctgagacaggaggtatgaaggggatgtaaatcatggagactggcagagggggagggagaagaaaagcatggaccaaggcacccagacaggagtgaaggcagtcggagggcggggctcagcagtgccgatcaccttctggagctgaacgtgcctgtagagtgcagcacgttcatgtgcccgtagtgcatccagtccaggagtccggccatggctgtcatttcactttataaccagatcatctgtggttgggtggccagttcacttgatcccaagaggaaaagtggggtcccagactcacagctgaatagcacttacatacacatgatcttccctccctccctctctctccctctctttgtctgcaagtcactttctgttgcatatacgtgtgttacctggtggctttatgaaaagaaatgcaccatgttaaagaaacctacctggccagcttctgccaggtagaggaggcagcctaggaaatgcatttggtggcctatgttccctggagggccattgaccaagtagtgcagtgaacaatcaccctataaagagggctgtgcaccatgcaggtactgcgttagctcacggcacaccaacacaaggttgccaaggccacacttaggagagttagtgactggaaagaggtgggtagtcagtcctaccttaggagtcctaccttaagagagcaaaagaaaacagtgcagtgggcccctctgctggggtggtgacactgggtcatgagtaggggcctgtgctgctggccgggcaaggaggaggaggaggaggagggctccagtttgcagcctgctgagggactccttccagaacgtggtcctcctcatttgcccagacagaggctaggacccctaaggagagccagctgcagcaggttccaggggctgttggtgatgtatattcacctacttagcaagcattcctgcctaccgtgtgccagctggtgaagcactgacctcaggcagagaggagacagtgtatacacaagtaaccacagcacaaggtgcttggcagtctcacagggagtgtaagggaagtcaggggaaatggcttgaggctggagtggtggggaaggggtctgtgtagaggggaggatgtgattgtccctcctggtagcaacttgaaaagtttagcgccatcttcagatgtgctcatttttcatttccaagattccttatgaattgaattcattattctgtaagcttttgtaattttaggctttaggactttgggccttcgtgtctccacaagtttacaaccactgtggccagcactatgttccctttatttgttctaaatttgttgatttcaagctttaaagattcccaggtggttccaatacccctacaaagtttgggaagcatagctctatataattccccttagcacattaagaattcagccttctgggatttgtagggggttgggggttagacacccaggcatgtcttagcacaaagccaccgttagtgacatggatcttacaatcacctctgcttgagcatttcgggaggggtattggattttctgggctttcctgagaagatgactgagatgtcagagctctcaaagacaggagtcaaagcctggcctggattaatctttccttcttgaagcatctggtgtataagatgctgcaaataggcattagagcatttattgcctgtcctcccagggtgtagtgaaggttttcaaagtaatggtggaaaagacacaagaaatgctttatcttgtggatttgataatattgtacagaggagcttcggactgatggtggtcatagtaccagcgtcctggtcccgatccagtctggagcagccctgggctccccattcactgggctggccaagtcttgtggccccaagagttggttaatcctttgcaagagtcagagttgtagccgaggattcagtggggttggatctggacagggttatatgaacacgaggcaggggtggcagtgcagcggagctggggagccagggaatcacatgctttggtgctgcttggcaaggcacctaacaggggagacggagtctgagtagaactcagggttcacaggagaccttcggtagccacagagattcctggctcaattttctctagacacctgggtcctttctaccaactggcctctcacacagaggccactcttaggtcactgaataaggttttactgtctgccgcctctcctgtcatttaagctgggtttttagatgcctctcaatttaagaagtatttttaaagatttgcttctttatcaagatgaataaagttcctaacaacatctataactaggtgtgtagcttgggatggccacatccctgggactgggccaactcctgtcaacaggctgatcttaaaaagttgtcacccaatgtgtttgtagaggctccaccatggaatactcgcttctgtcttcctgtcactctctagtcaccgaagccggctctagtggtggatggagcagggctcctcttctcctctttgtgtccctggccacagaggaccactgctcagctgggatggaggtgacattaatgacagcaaactcctccctcagcggcttgctgttctaggtctcagtgggctgatgggcttccagtggcaacagctgctagggtctggggccacaccagtgtcctgttttgccgctgggccctggataatctcacttgcccacttgctcttccaacctccctgccccctgcattctcacacctgtccgttccttcccagggcgctgcccgccccaccctgggactcctaggctgagtgtgtctcctggggggttggcatggcaaccggaggaggcttggcttggggaggcttgggattcagcaaggcgccagagagcctgacctgggaggagtcttgccttgagagaatggactctgactcatcatctcccacttcctgagttccagagcaggtggcaacagcctgtgaagagcagctctcctggcagcgtccctgactggcgcatttctgacggctgcccacgggccgcactggtcacctccaactgcaagcaggattttacccccaccatcccaggccgggctgatgtctgttctcacactgcttcctctgcttccaggaccttaaagaactggtagaaaagctggaaaagaatgagaggaagctcaaaaagcaactgaagatttacatgaagaaagcccaggacctagaaggtagcggggtgtgagtgagtgtgttttgtgaatcacaggtatacttggccacgcctgtgggtgtgagctgtctgcctgccctctgcacattcttcctacatcactgatttcttggtggctctgcccagtccagccaggcgatagaagttggatcccatgagcttacccatctgcagttgccagaatatggacaaaagacacttgaattcagccagtttgggtgcttactctgagcaaggctctgcagggctagaggaatggggaacccagaggtgacctggtggtccctgccctcaaacggcttgaagttgggaggcaagattgatgtgaaagaatgctgtgtaacacaaagacctaaaccccaaggtcctcactccatgctatggagtgtcaggattaaacttccaatctgggatcttcaggtagagatttaaatcactcttccagaaagacctagaatgttctctccctctgactccctgctgcaaatctcactgtgtcactctttacatatgtcaccctgcttggaaccctctttcagcccctcactgcttggatacccctccacatccttccaccctcagctcaggagccacatgctcagggcttgagtctcgtcttagacagtcctgaccccacttgtgtgttgggcacaaccctgatcacagttgtcattttacctgtttaatctcctgctcctctagactggaaggtcttagagggcagggatgtctgtgatctctatccagggggacacttctcttcatatctgcccatgtgcccaccaactttggatttgctattcctccagtttctcattctcctagtctcttggcttcaagctttgcttactcctaaagacctatcactccctcttttctgatgtttctctgtgtctgcccctacccttgtgtccagttcttgtcccctgttcccagattgcttagtagcttcccagtcctgttttttcacagcactgtctggcctttgcctttgccttattgcctgcagaatgaaatcccagccctagtctgccagccttcatcctctcacactctcccccacctccactcagagcctcccttcagccactaggagttcatggagcacccttccctgggtgtcactcgtcctggtcctcttccattggtcctttcccagtggatcagctcctttgaacctggatgtaagagtcccacccgcccttcatcccacctcttctgtggggtccttccagccccaccaccatcagcacccacatcatcagcacccacccttcatcccacctcctccgtggggtccttccagcccatcaccaccagcacccacatcacacactcctggcttggtgcctgactgagctgtgtcatagtgtttccatgtgaatgtacagatgtgtctccttagttcgactggccagggacagattaagcatgccattgtatctgttcccatgcttaggacagcgtcccgtgtgcagtcagcactgagatgtgtttgggagtgatgctgtggttgcccactgtccctctaccatggtgtgaggctgaggagaggcctgagtgagggttgaccaggcctttataccttcaaccctgccactgaaactcttcccaaatagtcatcatcttatgtagttgcaaagactgcacttggcagcttcctaaacctgaacctgcatttagtggctgaggacgtgtccttactatcaccatcaccaccctgatccaccacccacaggtcacagacagtgtccaggccttgccctgaacacctgggtttgccctgcggctgtgtcacgatggccacgttgtggccacacacagggaactgagtgtagtgggccaggccgaggccaagcacttcccagaaaaacggtatctcctttccttagaagtcagtagggaaagagaagcagctatgcaggagcggtgagagaccatgctggctgtcatccttcacaagttttctctggtctgaaacctgcctgctgtcttttcggatgtttcctctcccctatccagagtgtggaccccagtgctggatgctgagctcctcacacttggggtgtggctctggctgtaggaacagactccgcaaagagagtggaagtttggagaacccagtatgccccctgccccaggtgccatcctccacctgccagagatgccccttcccctgccccaggtcccatcctccacccgccagagatgcccgctaccctcaggcctgcagctggaagtctcatccatgcttcctgttttctttcctgctcagctgcccaggcattggcccagagtgagaggaagcgccatgagctcaacaggcaggtcacggtccagcggaaagagaaggatttccagggcatgctggagtaccacaaagaggacgaggccctcctcatccggaacctggtgacaggtaaggaccctctgtgccaccctatgctgcctgcccctccttcagcccctgctcccatctccatccccagcacaacccccacaccccttccttcacctcctgcacagcccccaccctctgtctcctacttgcccttgcacctgcccccatcttccactccccacacctactctcatcctccccccagctcctgctgtgtccagctgctattctcgatggcaagacccactgcttctttgttctgcccatacgatggaagtgggaggggagccacccacatgcttttcctcagcagcagccacagccccctttccttggtgcagctctctacgggccacagtgctttggcaatgatggaagctcatgcttttggagcacatcctctaccagactcatccctcctttaatcctcacaacctccctttaagtcagaactgctgccttctcattttacactgaaggaaacagagactcactctagtaacttgcccaggtcacacagctgggaagcagtggatcaaggattcagactccttctgtttggttaggactttacagtttaaagtgctgtgtggtacagcacatgtgggtgtggtctctggaatcacatgggctgtgttcagacctggcttctttcctaactagccgcacatggccgtggctgtgctactcaccagtgttcttgtgtagagcacaggaaaggggatcatgccgctggcatggagttgtgagaatgaaagttcgtatttcgttgctcatacatggtccctggaccagcagcatcagcatcagcatcagtatcacccctgggaaggggtgagagatgcagagtctcgggctccgtgccaggcctcctcaattgcaaggcacataacaagatgccaggtgacattcacaggctcattaaagtgaggaatgctgagcttctgcagtctgtctgggatcaccctggtcccactgtcaaagttcatcagggttggcttttactgtccctgcgatcatctgcagtttcttatccaggcatgtggctgaatcagggctggcctgccagcctcccacccccatgtgctccctggggccaccaggcagctgtgagaaccactgctcagaattccttccccagctgggctcctaggactgaaagaccttccacactagctgccaagagggcagggttttctctgtgaaaagaggagcccccgccacccctccgagtccctcttggctgctcagcaagggccaggagggagtctgtgtgacctgtgcagcttgctcaggtttgtgcccagtgctgctttgccagtcgtaccagctccctcccctccagtcttgtgccccatctgccacaggccactgcaacaggccacctccctgctctgtaccaacccagtccagcatcgccctgcagagccaggaagagtcttagaggagagagtcctgtgggaaagaggagaaatctttggtggtctgatcctctggaccctgagccagcagctcccttctttatggcaccttagtgaaatgggatgatgacactgacctgcctgccccatgatgtgaagtgtgacaaaggcgaaatgctgtgttaaaactgcaaaacccttctcaaatgtgaggctttcgaaggagtggtagcttttgcaggaatatttgaagttcaaataagaggcaaggcaagcattattttagagaaacttatgtaagactgaagtccgactctgctgagcactgtgcctagggccgagggacccaggaagaacagattgtgacatctgccttaaacagatttgctccagctgtttggtttgtgtgtttttagtagcctgcttcttagatgtattttgctcttttaaaaagcttaatctcccctacagttgtccagcaattaattaaatgtggtgtaagtttatcttaaacttccttaaacagactgcatcttgttcaaatgcaattaggaacaaacctttcatctctggtgaatgaaactttcaataaataaggctgcttgtgtcagacaggtggctccctcctgccatttgccagggtttttacagagaaaaccctgccatcagcatgagatgacccttgctcaggtggccccaggaaaggtcatctcctgctgagctacctaggaaaatcctgcagtcatcttccctccaaaagaccccatccaaacaaatgccaaaacttgactgccgaccacctacctcttaggtacctggcactggccagttgctgtggaggagaaataaaactagtgtcatcgtctcttccccaagatgctaacatttagctggggcacccaaacaagctttatttaatcacaatagaacattccaagacaggacaagttgtttgcaatctgcacatggatcaggtttgaagtaagaagttatggattggaagtctgggcctacaaaatacattttcctggataaatgactggcattctaactagagccaatggccaatccacagccatctgctggacctataaaatgcccaaatgtcaaccatgtactcaagagtattatggcctacagttatcatttaactagaaggatgcgttggagcagggacaatgtaacccaagtaccaactggagctgctggcagcagagcccagcccaggaccagcctggtagaaggtttgcaaggatactgcccacctgcaggtgggagggaggtggcctcccttcattgccattctgagcctacaggtggctcatgaggcctcgtttgggagggtatgagtgtaaagaacaagggctggagatacagtgcagagctatggtgagacccctggggccttgtgctcctgccccattctcacctgtcatcttgcctttgcaccaggcctttccccctagttctctggccttctaccaccacctgttgccttaagtctggctcagctggcatggtctggaatagaaaatggtctgacagctgcttcctgtccctccagggccttttgcaagaaagggccaaagggctgagtctgcagttaatggggagactcacaaggcccttccagtccagccagagcagcccttgcccaggcagggacaggagtgtgggatacagaggagagcagttgggggaagtaagagagccgctggagagatgcatgccaagcagcagcaccggggtggggaaggggggcctgcctgatctatttggctgtgaagctgggcaagcacggctgggtaatttgttcctgaactgatgggccagagattgttccaacctccctagccctcagcaggctggccctgtctttgggcacatacaatttgtctaattctggagccagcccttgccttctggaagtggtggtgcccacgaatcaggagttcctgcccccatgtgggagctaggccctgtcctcagccttccacttgccatgggcccctgttggctgcggactgaggcatctgtgtaacttgcaggcacttttcctccatattgttaggctgaggcattagaagcctgtttcagggttatagtgcagacaattaggaatgtggttttgtttgtttgtgtttttaaccacagtgtctgaaactactggtaggcatgctcgggagtttgggtaccctgggtggcttctctcccaatcctctttgagacatctattcctagatgagctatggggaaatattgaaaacacgtctattcagatgaggattctgacagcctccattgtcccccatagatctaacttgccatttgctgctctcgttgcccttagacttgaagccccagatgctgtcgggcacagtgccctgtctccccgcctacatcctctacatgtgcatccggcacgcggactacaccaacgacgatctcaaggtgcactccctgctgacctccaccatcaacggcattaagaaagtcctgaaagtaagcagcccctgcagaaggtcatggtttgtggtgggtagagtgaagccagccccttactgttgcttctctgtgtctgggtttggctgtagtgaatgctcctagggctccaactttgaaggtaaatgagccacagaagcatccatataaccaggatgcctggcagttcccagagaaggatgctcaggcccagcaatggcagaaagccgaggactctggtgtaggtagccctccagctcctccctgctgagcctccagacatgcccagtgcttacagaagccttggcctgcccactgccagaggtgctagggagacatcctgctgcagccaagggtgtgtgggcctcaccctggagcaagttcagggacacccctgaaacatgggccctctccacctttccaaggggccgggtgcttgcttccctggggggtaacacagggagggctgtgacattccatcacctcccaaggtgaggcaacctgggccaggacagggcttgccgcatggtgttaaaggtgctcgggaatgccacctgaaggcacaaggctcttcttgaatgtagtgcagccactgcagaaacaggctggcctgcagggagggtgaggcctgtccacacatggatgagggccaggcagtgggggaggtgagattcttgagggagatgaaccctcagtgagagggatttctacctgctagcaggcctgtgccccgagtattattgctcttagagaccatctttagttcttacacattactgcttccaggatacaagccattctcaaaagctctgagtccaaaccaattctggagtccactgagctgctggttgctgctcagaattccagagccagcctttaagtctggtttcctgccctcagtagctgcattgccctccacaggcaattttatccactcacggctctaaaacatatctgcatgctcgtggctctcagatttgtgtctccagccttgatcctctttcgtgagcaccatccagctggaatcttcggccagtctaggccaatttagggctgacacaaatgtcacttccttaggaaagccttccctaattctgagctaaaatagcatgtcccagccccagcagtcactttctattcaacctcatttctttttttttttttttcttttggtcgtacctcataccactctgtcatttaaataatgataacgcttacttgacagaatgagctgcgtgaagtcatcagctttaatgcagcagctgtctcatagctgtttgggttgctgagcaggctttttcacctagttagggtttgtagccattttctagagagttaaagccatgatgcatctgacatctagataaatgggacaccaaactattttgctgttatgctcttcagcatcccttgtgttggataactggcagttcagaaacagagccagctagcccaggcggttagacgagagcccggggctgttggggcagagcctcatctgtcactcagctttgcattcattcttcagccatggaaggcagcctgtcctttatgtgtgtccctgtatgtgcaccactgatcaggagaccaaggtgggggttctgtgcaccatccctggtggtagaggaacactcacacagcctctcagcaatgggtctcaaccccgtgactggcaagtgccctgcccagcctcagggctgctcaggaacactaggtaagggtaggaaatgtggggaaagaggtaccgaggaagcatttcaccagatgggagccacttagagctgaggatgtccttttcttttcacagaagcacaatgatgactttgagatgacgtcattctggttatccaacacctgccgccttcttcactgtctgaagcagtacagcggggatgaggtgagtggggagccaggcacccaggaggcattcctgcttcatccaaatgtggttgagaagtgctttgtataccctcagaggtcagtggggtctttggagcacccttggggacctcagaccgtgggcacaccttatcatgcctcgtggctggaagcagcaataaggccagccacaggagacctgcctctaggaggccttgatgagcccaaggggccccaaaaagcactcctgggttatgtaagtagagtctgcataacccatgatcaatagaggccctgggagtctccatgaaactcttgtaacctgacatttctgtatcagctctagaagccccactgcagtggatactggcagggagctcagttgcctagtgggtcaccctgtctcctaagccaactgattaatctgtccatttcaagatagacaaagatggccacaagaacagaggcacaccataatcagaactacgtgtgtgcaaactgacctggaggcccagctccatgcatttatccaaattggattccttgacctgaggcccaactactaaccccatcacttcacaatccacaccggacctgtaaggcccagctttttctggaactcacattcctagctttggtccctgaaagaacttctcccatgctctgcactctgcccaatgacctagtaatatgtggcttgtttccattctagtttctctggtgagaatcccagcttgttccagatatgcccgctcacaggttcctgtaggtcttccaacttttcttccccttcctttcacatatctcaccatccacccttcccaaggtcaagacatagtgtaaaccaaaatagtgcgaccatttttaaagctttattccatcttttgtgccagaaccaattttgacagactcttctccctgggttagtaaaaggatatgcccttcctttcagtcttaccttctttgcagttggcttgacgccatctctctcctaagaaccagcacttcatttgatggcctgcttttattataaaagagatgggccaaaggttaaagaaatagccatttcaaaccccatgacttctgttacaaaatcataatatccaagcatttacttgaagcatagaactacatgtaatgttatttcattgaggtccatcactttacccaatgttatacacattctaaatgggaggttatataaggctagggcaggacctagaactccattacattaggttgtggttacatgtgctcatattctctgggtcaagagctgaaccacagcatgaccagatccgtgtagtccaaataacaaggaagaatgattgactctatcttcatcattacaattatccccttttctgcctgctttttttcatattaagatggctttgtatttgacacagtacaacaggccttgctgaagatggttgcccttttgggagcactaatctttttggcagatactggtttccctaggcctgaatgaaaaggacattggtcacatgagcccttctgatatcagcagttcccttaacttacatgtgatttcatctgattaatacagaaagctaagaggacacagtgcggtagctatgaaatcactttagttcatctattaattctgataaccagtgatagaatctgtataaaatttctcctcatacaagcgtataatctggcccatggccacactcctttagaggctgcacatcatctaacattttagggggacctgatatattgaggaaagcgctggatgaagggaaaaagcagggatccctttctctggacctggtaccaacctaggttttgctaccgtagggaaatcacttcgcctcagggatttggactgagcgattcaggctttctctctcatgttgagtttttctacatccttcaagttcaagggtcatcaatgaggcctcaaagaactgacaggcttttgtaaaacatcatctacatagggagggcctgagtaggccccctgcccaccaaatagatgactaaagttaccagagccctggaagttgtgctgggcccagcagaccagagaactcagtagtgcacgcctctccctctgcagggcttcatgactcagaacactgcaaagcagaatgaacactgtcttaagaattttgacctcaccgaataccgtcaggtgctgagtgacctttccattcagatctaccagcagctcattaaaattgccgagggcgtgttacagccgatgataggtaagctggcagcaggagagctacatcactcatcatggtgtctgaaatgaggggaaggcgtggtcagcaccctctgcctttcgggaaccagatatcttagccatgacctccagaaagccagaaccttccagtgaaggcagaactgaggtgtgcacatcatgcttaaaaagctgtgaaagtatttgacacagtgcaagaggcatagatgactttccctttatctctttttctgtaatatgttgtattttttcccaaattttaatacataataaatgtaaactcaaaaggtacaaatgcatatacagtgaaaaagcataaccctcttaacctattatgaacttgattcatggaaaaaagcaggagtgttcatgcgaaaggacacagcagtcggcacgatgcatcagtatttattagacacttgctttgaaccaagcagtgtacttgggcactgaacatgaaatcagaattgagaaatgagagcagttacattttcaatcggaagaaaaattatgtgtagatgcattactcactgtgctctgcaaaggctgggaaggaaagtgtacctggacctattcataatgctttccccaggttcttacaacacaagtaggttatgagtgaatcccaagaaggaccaatctagaaatacattacttgaaatgaggttcattccaaaccctccttcctgtctggaaatctttttataaggcaccagacagagggagaactgacatatcaagctggagatactcagaataatgtgaaggttaatagcagcagttctggagtcagacagacttgggtttaaatcctggccctgccactccctatcagtgtgacctcagacaagttatttaaccgctttatacctcaacttcctcataaaaatgggtagtactttatagagttgttggaagattgaaagagatactgaacataaagcccctggtgcataggtaatggctgcttagtaagtatgacggaccaatgaagctcttatttacatagtcagtggctggacgaggatgacacccaggttgctcaattctcaaactgtggacttcagcacaggcgataccaaatcgagctggtacatgcccatcatctttgtctaattgccagtaaattaaatgaaaatgctgtccacagctgttttattccatacagaaatcaacacattagaaattttttgccaaatgttataagttcctaagcatgtcaacattgcacacctctggatggtatcattgctaaagcccggagcactaaatgatttgagtggtccaatctttgcattgttagtggggaatgcaagcttctctaactgtgcttttatttcagtttctgccatgttggaaaatgagagcattcagggtctatctggtgtgaagcccaccggctaccggaagcgctcctccagcatggcagatggggataactcatactgcctggaagctatcatccgccagatgaatgcctttcatacagtcatgtgtgaccagggcttggaccctgagatcatcctgcaggtattcaaacagctcttctacatgatcaacgcagtgactcttaacaacctgctcttgcggaaggacgtctgctcttggagcacaggcatgcaactcaggtaagggaggagcaccccccaacaacacagatagagtgggccctcactgactgcagctagaatcagaacacaagactgctgtttctaaaaatgaaatccaaatctaattgacagtccttgtctccatcagtctgtgactcaaatccatcacctttttacctgttggtgaaatccgtcgaacactgagatggttgacttggtaaacaaattagttcaaagcttaaagatgttgacatactctaagttaaagactgaatacaaagcagataggtcagagagaaaactcaatgagttaagaggcatgaaggctcacatagaagtataaatacatttgtgaatgttaaatataaatacttacaattcagtatatttaatgcctgtttttccctgttaacttatgtagacacttcaggtatttcatctttgcttgattttaagtacccactcattcatttattcattctttattcaacaaatagttcctgagtgcaaggcacttgccatgctttttaaccgtgtgagataaataatggcactagctgcagcgggcctgcaaaacacaacaggtgtccccttctcagtgaattaggaggaccggcttaacatagcttgctttctacctatggctaaggtacaatataagtcagcttgaggagtggcttcggggaagaaaccttcaccagagtggagcagttcagaccatggaacctctgatccaagcagcccagctcctgcaattaaagaagaaaacccaggaggacgcagaggctatctgctccctgtgtacctccctcagcacccagcaggtacagtcactttgcacctctgtcaacatggtattccaaggaagccctgagtccattccaagtctgttctcgttggtggttatttgttagtgttgcactcccaccctttatatacccctaatgagacaattttgaagtgcagctgatgggatattcctagatgaaccaaaaaccatttggtctgtgaaacaagatgccacagatactgttttctagtaactctctatccctcttactcacttaaaaagataaggtagcaaactcacaaaacgttaagtttaggtaaaaacttctttaaatataatgaattctggaatgtttcttacatagaaatccacaaattttcagaaattggcagcatcaggtatttgctttctttacaaatataactgtaagaaaaaccttttctttaaaactaattgcaatatggtcatattttcactcacactcatttatattgttttaaatgaagtcattaagaacttaggggcatttaagtgttactttccttttccctaaaaaatgtataaccatgattcagttgccgacacattgccagtccctgaaagataaataacaaaatccaaactcagtacagaaaaacacatcttaatatagcaaagtgaacacctttccttacctcctctgcttactattaaaatattaaatatctaactctttaaaaaactgcttccttctgtaaacatttccagaaagtcttcaaacatttttcttctctttaaatacatttcacttaaagtaagtttccttctagatgcagctggcattgcatttgggcagtctacttccaccaaaccagtggtaggcagacaaaagagtatctcctgttcaaatactcatttgtaaacaatgttgggggacagggggtagttaggtattaaacaagacctttctcatctaaggtaagatctccagtactcttcagaagaaacctttaaattactagtagatatgaggctgaggatttcaggcaactgcattctaaactcctcattgtgtataccaatgagcatagtggggaggggcaggtgggtttacaggagacatgagttcggtgagagggctcagatccacctgacaaagctgtgggctctagtttcctggatgcaggctccaagtgtaaatgtcagtccagctccatctgtgttgtgggccttgtctaaagaggatcatactcttgtaccaatgtcacatattctttaaagttcaaaagttgtctcatgttcatttagctctgtgctaaattccgtttttatccccaacagattgtcaaaattttaaacctttatactcccctgaatgaatttgaagaacgggtaacagtggcctttatacgaacaatccaggtgagttttaagatagtaattttataaagtccagtctacgactataaaggaaattaaaaatttgggctttaatcttgcttctctttattactaaaatactggttacatatatgctgggagaccttacattcctagactttctacttaggtaaacatgaaccgtatcacccatgagtaacttactgtttacacacagaaaactcaacttttatcatctctgcctctcagattatagacatagtttaagcattatgtcatttgccactagcatgttactgaactattagcaccaaatggaattaacaatgtcagcagaatatcagccctaaccataaatggaactaagaaatgttctttaaagaaagcaatttgagctcttaaatctttgtctaagacttataatataggccaggtgcggtggctcactcctgtaatcccagcactttgggaggccgaggtgggtggatcacgaggtcaggagatcaagaccatcctggctaacacggtgaaacccggtctctactaaaaatacaaaaaattagccgggcgtggtggtgggcgcctgtagtcccagctactcgggaggctgaggcaggagaatggcgtgaacctgggaggcggagcttgcagtgagccgagattgcgccactgaactccagcctgggcgacagagtgagactcttgtctcaaaaaaaaaagacaatatttgcttttaggaaaatgcttgaaagaaaatgtattagggaaaacggttatttaaatctgtcttttcctaagatgatgggaatgttttacttaaacatgagcttccttaagctgagcccaaggtgatggctgagcgcctgacctttgcatgtgatagtaactgtgacagtgttggaatgatagtcatgtcgcagtgattcagaaaacaggccacacttctcccatgattacctgtggggagcacctcaggggagacatagcactccctcaaacttttaaatgaccttgttggccagtgaagggatattgacacaaaacaaggattaaaaaggggttcagggggaagtcatcagagggagagtcaggaaaaagggaaccaaatggaggtttatcaaagacactgaagaaacgtgaggaaacatggagctttgtacaagaacctgttccctttggaatactcctgggattttatttggagctccttacagtgtttcaatgtagatccagagatttagagagccctgaaaagagctaaaaaggggtttgaaaagagccatggcaaaaaaaaagcctaaatgaactttagcccagcatctaagtagggaacagaggccaacagagggaacgtctgggaagtggtgcctagtcagactaaaggttgttctcctaagggcaatgacagaaacacagtcgattgttaaagacacaggccgcagaatggggcaggcagagtgagtctctctactcaccaacatgtatataacaatggggttgtgggtggcgctgacagaaaggatccagttaggatgctcatagtcagctgctgaatgggaagagtttgatgacagaagccactgagatatctgaacctggacccattatatggatttttatggagggctgataatttatacaaaagtgcaagtttagaaagtcttgtttagtttcgaatatctgagacacacattagagggagaactataactgctcataaattggcaaccccactgtttatgagaattcaggttaaaaaatatatgccacatcatactgcaggtttaatggatcaaggacaaagggaaaatataatggaggttaagcccaactattctctcaaaatatgtacagtcagattctgaatcttcctcagtaatcaatttcagtgtctcgcagttctagcaaaatatttttttcatgagctatagctttatgttgtttctacctatacaatgctcagaagaaatggtgaacaatcagtcctgccctcctacatttgaactcacatgtgtgataaagacaagttacttgttaaagcaaaccattgcttgggcgctctgggctttttatagctttgtactgacctttaaaaatgtaaatttgaagttgttaaactcaccaaagcattcacaggaggatttctgtgaaatgaccaccttatatactttaattgattaaaagtatacatgccttttgctgttgaattgtgataatataggtaatatttcactttcttttcccatttttatactctctaaaatttcttcaaaccctttaggtagtgaagtctactgtcacatctaactaatgtggagaaatacaagggcccttaagtgctacaaagatgactttttttcccagagcctcctgccatttcacattttacatacatatgccttgtgataggttcatgataataaacgcagcaaacctcagagtgggctgtgtgtgagctgtcaacaatcccagagaatcattctgccaggccacaccagagccatcattgagtaccttgaattagtgaggctagttgcttattcctccctaaatacctttctctcctttaaacttctctcccattatttcaaaccactttttcaaatgattaaaattactttaaaattttggcccatctttcaagatgccaaacacacgggtactggaaatttaagtcatgctttctattcataattcaggtaatggatgaaaacgtgggcaattctaggttcccctgccactatagagccatcttacagtgccatgctccagctgacttcattctgtaaacctatttcccagcgattttcaaatgctgctatgtatttactgactatggcctgtttcgaggtttaagaaaaataaattgtgttttcacaaaatcaggatatattgattttcctttttggcaatactcccacagttaaccctattgacttttgtaaaagtacagcttctaccagcagttcatggttcagaggtcaatggttaatgcatgggcaggaggaacaaaggagcatattataaaactgataacagcaaatacagcacttactatgtgccagtgatggtactctgtgttctttacacctgttaactctttaaatcctcacaaccttatcagaagggtactcttctccatcccatggttttggggtatgtgtgttccattttaaccatttttaagtgtatagttccgtggcattaagtatattcacaatattacataaccatcaccactatttccaaaattctttcatcatcctaaacagaaacactacccatttgggcaaataatattctcccttcccttcaaccctgggtaggcttctatatgtaaattctagatatcacatataagttggctcatacgatattctttcgggtctggcttatttcacttaggttctcaaaggtcatccatgttgtagcatgcataaaaacttcatttttttagtgactaatattccctttatatatcccattctgtctattcattggttgatggaaactgcactgtttctaccttttggctattgggaatcatgccgctatgaacattgttgcacaaggagctgagatcaatttttcagttctttggggcatatatttagaggcagaattactgggtcatatggtaactctatatttaactttttgaggaatctgaaacttttccacagcagctataccattttacattcccaccagcaatgcatgagagttccagtttccccacatcctcaccaacacttgtgattttccagctttttaaaattatagccatcttaatgggtgtgaagtggcatctcattgtggtttggatttgtatctctctgatgactagcatcttttcgtgtgcctattggccatgtatatatcttctctggagaaatatctattccagtatttaattcatttttaaattagattattgtctttttgatattgagttgtaggagttatttgtataatctggatattaaatccttatcagatatgatttgcaagtattttctcccattctgtgggttgtcttttcactttcttgatagtgtcctttgatgcaggagttttaaattttgaggatgtccaatctatgtatatttttttgtttcctatgctcttgatgtcatttttaagaaccataaatactttcccctatgttttctaagagctttgcagatttagctccctttaagtttttgatccattcagagttaatttttgtatatggtataaggtgaatgtcccacttcattcttctgtatgtggatatccagttgtctcagcaccatttgtcaaagacactgccctttccctcattgaatggacttggcacccttgtcaaaaatcaattgaccaaaaatatgagggttttttttttttctgggcccttatattctattggtctgtatgtctgtccgtataccagtaccatactgttttgattcccatagctttgtaaaaagttttcaaatgggaagtgtgagtcctccaattttgttttcctttttttttttttttttttttttgagacagagtctcactctatcacccatggagcgcagtagtgcaatcttggctcactgcaacctccgcctcccaggttcaagcaattctcctgcctcagggaatataggcatgcaccaccatgcctggctaatttttgcgtttttagtagggaaggggcttcaccatgtttgccaggttggtctcaaactcccaacctcaggtgatctgcccacctcagcttcccaaagtgctgggattgcaggcatgagccattgcacctggccaattttgttatttttcaggattgctttggctagtcaagatcccttgaagtttgatatgaattttaggatttttttagatttctgcaaaaaacgtcattgggattttgatagggattgcactgaatctgtagattgcttatgtagtattgtcatcttaagtcttctagtacatgaacatggggtgtctttccatttgtttaggtcttgactttttcagaagtgttgcaccttcttggctagatttattcctaagtattttattctttttgatgttattgtaaatggaattgtttttctttctgattattcattactagtgaatagaaatacaactgatttttatgtgtttttttttattatgtacttcgctgaattcattagctctagcaatatttgtgtgtgtgtgtgtgtgtgtgtgtggattctttcagtttttctacatgtaagatatgttgtctgcaagaggatcattttaaattggctgcctcttatctcttttcttgtataattgccctggctagaactatactgaatagaagtggtaagaacaggcatccttatcttattcttgatcttagaggaaaaactttctgagtgtgatatttgtgatgttaaatgtggggtttttacatatggtcttcatcatggagggatttatctttttatcattaaaaaagttggattttggcaaatgcttttctccatcgattgagatgatgtgggttttttcctcttcattctgttaatgtggtatattacattgattgatttttatgttgaactaaccttgctttctgaaggtaaatcttgcttggtcatggtgtataatccttttaaccttttactgaattcagtttgctagtattttcttgagggcttttacatctgtatttataagggatgaatatagttttgttttcttacagggtctttatctggctttgatattagggttatactggcctcatagaatgagttaaagtgtgccttcctctttgatttttaggaagagtttgagaactggtgttaattcttctttaaatgtttgatagtcttcaccagtgaagcccatcttgggctttcctttgttgggaaatatttaattactaattcaatatgcttacttgttataggtctattcaaattttctatttcttcttaaatcagttttggtagtttgtgtgttcctgggattttgtccatttcatctaggttatccaatttgttggtgttaaatttttcatagtattctcttataatcctttttatttctgtaaaattggcagtaatgtcctcactttcatttctgatttgctaatttctcattttagtcttcccacacacctgtaatcccagctacttggggggctgaggcaggagaatcacttgaacctgggaggcggagattgtgagcagagatcacaccactgcactccagcctgggtgacagagcaagaccccatcttaaaaaaaaaaaaaaaattgtcaattttttgaaccaactttgatttcatttgttttgggtattgatctgttctctattttttccatctaatttatgttatttcatttcttctaggtttaggtttagtttgctctttttctgattccttaaggtatacagttaggttattgatttgagatttttttttttaatgtagacatttacagctacaaactttttagcactatgtttatcccatcccataagctttggtttattatatttttattgcctaattccccctgtgatttctttagcccattggctatttgagaacttattattttccatatatttgtggattttgcagctttcatttattgatttatagtttcattccatcctaatcagaaaaaatatttcatatggctttaatatttttaaatttattcagacttgtttgaatattggagactgttccatatgcattgagaagaatgtgtatgctgctaagtggggtgttccatatgtgtttgttaggactaattggtttatagtgttgttcatggcctctattttcttattgatcttctatctggttctatccatgattaaaaatggggtattgaaatgtccaaccattactgtagaactatcctcccttaaagtctgtcaattctcccttcaaatattttggggttctgttgctagatgcagatgtttattatatcttcttgatgagttgaaccttttattaaaatataatgtccttctttgtctctggaaatgacttaatttctccttcattcttgaagggtagttttgccagatttagaattcttagcagacaagattttttcctttcaggatttgagctgtgtcatcccactgcctcctagcctccatggtttctgatgaaaaacagctgttaatcttatttgaggataccttatacagtcagccctccatatccacaggttccatatctgcagattcagccaaccacagattcaaaattcagtattcacaggatgcagaacctgtagttatggagggacaactttttctatctataggttctacagggccgacagcagtacttgcatatccatggatctgggtatctgtgggaattcctggaaccaatcccccatggatactgagggatgactgtatgtgacaagtcacttctttctcactgccttcaagactccctctttgtcttagggttttgacaatttagtataatgtgtttcactgtgaatctctttgcctttatcctgcttggagttcattgaactttttggatgattacatacatgtctttcatcagatttgggaagtttctggcattatttcttcaaatattttgttgcccccttcttgctcttttccttctggtactcctgtaatgtgtatgttggtatacttgatggtgtccaataggtctgttaggctctgttcatttttacctcattatttttattttcttctcagactggatcatttcaattgctttatcttcaaattcactgattttcttctgcctgctcaagtctgcggttaaacttctctagtgaatttttcatttcagtttttgtacttttcctaaaatttctggcttcaaataggaagcagggaggggctctgtgcctttaaattttccagttgatgccactagtggaagccattgcatcccaaggaatgtctaaaccaagacaggcatctgctgggacccaccagatcaaagggcacaaccccaaatttttggaggacaaggtcccactgcctaccctggccagctagctactccaggaatgtgagctgctatccccatagcttcaggggagctgaagagagggggatagtagctgggtcacacacacagttcccttagcaaagatcagcagcctctccctttaccaatcagtctcccgattgttataaatgtccaatcaagttccagagttatgagatagttgacaatcactgtttctacttcaaggtagcttcagtggagggaccaatccctagggcttcctactctgccattttatgtgatgtactcttctcccattctacaggtaaagaaactgaggcataaaaaattcaggaatttgcccagggtggtgccaggattagagctcagctgtctacctaaaaaaaaaaacccatgcccttggccacttcactatagtgcctctccatatggtttgcacctgagatgtattttatattctcccttagacaattttttaaagaatgctagaattgggagagtgcttacagccctctgatctccaagaagcctaagtcagggcttctctccccactaaatacctcaagggtgaggagatcacattctcctagtcctgaagttctacctaattgtcgtagaaatctttccatgatatatgccaactcacttttgtgaattcacttaaactggctatttttaggggtactcaaactttacatggtcttattcttccccataggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgagcaagaaggaagtatatacagtaaagtaaattcaaggatctgttaaatctggtaaaagtagatcaaatcagagattgacagcctgtggagggtgctgaactatacagaattagacacaactatgtcattattttttgtacctactgctcagaataaaaacacttgaaatatggaagattttaagtttgatttcagtccaacacatatacataatttatagacaccaagcagtccccatagacatataaaaggtgtcaattctataaaatgaagctgcctagttttgatctttgcatagaactagagaatgtccaaattaaaataccaaatatatataagtcacataaattgccttcaaagggctttaacaaataatggtactaataaccatgataatggcatatactgacatttcccaaagtttgcaaaccataggtgtggttgagtttgtggtgagatgttttaagaacaaaaatatggggatgagacttctgagaaatattcccaaaatattttttaatggctgattatacacagacagtggtgtaactgacctccagaccagacattttgagtactggtttctgaagcaaaattagaagtgccagtcctcagtgtgctcaaacgcttttgtgttatcttgatttaatggaagagattattaaaatgctgctatcccaaactccaagtgagaaagatggaaaaatattttgtttctgatgctagtccatacactttccaagtcccacaaaactttcacaaaaatgtatataagctaaatattagaaacggataacaaacttgttttatttatagatgtaaaaaccaaacaagtcaatatgaaagcttttaatctcttaataccattaagcttccagtaagagcatcacataatgctctactgttccagaaaccaaatagtaaaacaaactaaagttcgcacatcagatcatctgaaaaaccttcaaaaataatcagttcagggatattatacaaaagtttgggttttttttttttaagagaataaaatggcttaggtcaactttcccttttcaggttattttcaacgtttttcaaatttagcacacaaaaaattgtaaatatctctcccacaaaataaggattttaaaaaagtaattcagtaatataacaggcttagatgtttgctgctcttagaattttttttaacttgtttttggtttcttcaaaagcaagcattcaattggaaacccatattctttccacacttttttttactgtcttttctgtatttcttgatagcagtatgctgttcccataagaaaaaaatggtatttgcaaatcatggaagaacagcctctgtattacattgagaaaataagatttatccatgaattggaagtagaacagcctgccttcaccctcttttactcaaccacccaacttaaaaggctcttggaaacacagcacactccacgctaccttctgcactgtgcccttagagcacagcttcctcagttgttctctgcatctcctggggcttaggccagtcttagcctgggttaaggctgctgacattgtgttccaatcagttgtcatgggcattatcccctctacatccacattaaacatgccggcttctcttgggcatcggcagagctgtgcctttttctttcagttacagttacataatcactgacgtccatgacacttacccatggatccatgtgctgacttcatttagaaggccaatctaaaacaactgggtttgtggctacctctttaaagttgtttgtgaaggataatttgttttttaatgcactttagtttgaaagtgagtctcttatgtaaggaccatccttaaaagaccaaaaatgccttgttagagtgttaaggagttttgacatgcagtggttccacaaacacagtggcttactatccttatacactgtcttataccatcattctctccatctctcttggtcactactctctgctgtcactggttaatcactaggtgccaagagcttactgaataaaagcttggcaattagaataaatggggagggaaggaccttatgaatagtccatttagcctaagaaatggcagatttagttcttctcttccaaaagataaaggtatatcctggaattgtacttaaaacttacagatgactaacaaatatatactttatatgtagttaatatttagatctgtcttatttaatacttggaggctagaagaagcatctttaggggaactatataatcttttgttagcattttctctgcattttaaaaaatcatttcaattcaaacatttatcagtgtcatgaaatcagtaatgactctttaacaattcaggtttgaactctgcattagatgtctctttaattttttaatatttaaaatttagttgacatttttttcaccaggtgcctttagcggttactaagataactgacatcagttgtttctctgaaataagtgttgctgtgggaataattttaatgttcaaggtgatatcatgggggagttttgtcttttaaaacattagaagcattttaaatattaagaatcaaatatttatagatcaaaacttgtgttttaagtattatacgggacctgtttacttatagtaaatgtgaatgtacacatgagttgttgctgaagctgacaagcatattacatacatgcattttccctgtgccctcatagttgcagttagagttccagtacctgtaggctcacctgggaggcagattagacccaaaggtagatgtttttcccctttccatgaagcatgtcagtgggagttgcttcctttgatttccctagtactaaattttaaggcttttgtaaaaacaaaacaaaactaggagcttggaacagttaaaaatcaacactgctaccatcaattcatcaaatatttacttagagctttcatacattaagattccagtaaccaataaattagaattcatttcttctgcataaagtaaattttcatacacttgacctactaagacagcaagggtgtcctaaattgaggcatttgtataatgcctgcataactaaatggtcactaaaatgggacagcatggggcaagaccttgtagttcttcacagaatatttgtggtcagtttctccaattaatttgctgcatgagccaaataaccataattcactttttatacccactggtgccataattagagaattagagggtgtagacagaggttaatgccaatgagaaacacaggacagggttttttttattataaaggtcattagatacaaaagattgtttttcaaaaaatttctaattctaacaaaggggatcaatcagaaatgaaactaagctactttctaaagtgacactgtatcagaataatccagatttgaatataacattttgccaccaactgacatttagatgaaggactgcctctctgaaagagttcagatcatattcaggggtgaatccaacaccatggaagaaagactactgatgaaaatattttcccactttgcacaaatctgtaaactacacctttgtttatagaaaaatgcttgtaatagtcactgtaatatttagctgtggataaaaatttgtggaaataaatacttttgaataaagaggtgtgccaaatctaaatgaaatttaaaactctgcagctacaggttgacaaagtttctttgtaatgctctcttgagaagcttcattatggggcctatattctaatacgtgtcaagatcatttaaaccagaggtcagcatcttacagtccaaaagttgggggcagggagaaactctcagataacaaggcttattgagcaattactttaaagctatggaattaaaggcagttttggtgtaggcaaagacaagtagatcaacgaaacagaatagggagtgcaaggataggcccaatcctatgtataacatagcatacggtagagatggcatgaaaaatcagtggggaaatagtcataagatctgtatggaggaatttgtaaaatataagtgaaaaacaatgacaacattaaaatggagaaataattaggtacaagaattcgaagactccataccactaaaagtttgtcagttgtccccaagttgatctatagattaaaaatcaaaatttcaactgtttctatgtgaaaactgacaagctcattataagatttatatggaagagcaaaggcccatgaataaggaagaccctccttgagaaagtgggaagctttccttagcaggcattgagacttacaaaatttcagtaattaagatgtgtgaggatgacagacatggaaattttttttttttttttgaaacagagtttcgcttttgttgcccaggctggagtgcaatggcacaatctcagctcaccgcaacctccgcctcccaggttcaagcgattctcctgcctcagcctccctagtagctgggattataggtatgtgccaccatgcccagctaattttgtatttttagtagagacaaggtttctccatgtctgtcaggctggtctcaaactcccgacctcaggtaatccacccgcctcggcctcccaaagtgctgggattataggcgtgagccaccgcgcccggccctggatgtggaaaaattgaccagtggaacagaatagcccagaaactgagcatctatatggaaatactgatacattttttcttaactgggagtacacatcaaaatcacctggaaatctttaaaaaaatttacacccaaatttatggaataagacacctccagagatggtgcccttccacacccattgttaacctgacccacctaaaaatatacaagaagacatccccagggatggtgcccttaagcacccatcattagagaccactattgaaatatttcatgatccagaaaaatggtcacagtataattagtcctcaacgtcactgataagttctaggaaaccacgagtataaacaaaatgacgtaatgacaccaattttaacataagctagttgatataaacagttccttcggcatatttatggtcatacaaacatcaccaaatttttttttttttgagatggagtcttgctctgttgctcaggctggagggcaatggcaagatctcagctcactgcaacctctgcctcctgggtttaagtgattcttcctcctcagcctcccgagtaactgggattacaggcgtccgccaccatgcctggctaatttttttgtatttttatagagatggggtttcactatgctgtcccggctggtctcaaactcctagcccccagtgatctgcctgcctcggcctcccaaagtgctgggattagaggtatgagccaccatgcccggccaaaacatcaacaaacttctaaataaagaccaaaacacttctagaattaaacactgaaatgaaagctatatatacatttgagaaagattaataaaaacaaatgagaaagttgcccacttattccatttaagagtcactgagggcccacctctcctggcagctcagggtgccagggaggcaccaggcctggacaggaaaccatcctgtcactgggtgtgctcacaaacccacactcagactgggatcacttagacacatccattcacctcatgtacacagctttaggacatgggaggaaatgagaatccaaagaaaacagtcatggggatctcaccagtggaacgtatccatgtctgtatgaatgaggctgcagcctcaattcttgccacctcagaagaaagaatttgagggccgtacagcagaaggagagaccaaggcaagttttagaataggagtggaaaggcaggaaagtacacttggaagagggccaagtgggtgacttgaaagagtcaagagcgtggcttaacctcttgacttggggttttatatgttggcctacttctgcggtcttgtgttacttctctcaactcctgagatcttgtcaggaagtggctgatcaccagtttcatgtgttttctatcgggagactgcctttctctgatgctggctgcgaccaatgactactttagaaagacagttaacaactgccttgaccatcactggatggtcacaagatgctcctggtgtgtgtgtggaggggggagctctctcctgccctgctcatgcctgactaggtacccactgtaacagggagaacctgcaaactccacacacacagtggccctggccaggaagcaattctttttttctcaccaacattatgtcaaaatgacaatgaatgaaacaatgttatgtagggacctgctgtatactatgcagtgaaaagttgacttttgaaaccaccttccaatctaaagatggattcactttttgagtggctgaccaaagaataccctcacttgaggaaagccttcagctcattctcaaagaggtttagtcctagcttcaaagcctcaacaggaaaaccacatttgaaaagaagcaaatttcatacaagatacacttaataacagttcagaaagagaaaagcagactgacttccaggaactgatttgaaactcagagctaggcctgggtcatgctagaagctggcctggtcctctgtgctgggccgtgttgttcttttgctatgaacaaccttataaaacaccaatatcagatgtggccactctgactacactaaagtgatatgaaacaagactgtaattttgcccaggcacaaaaacaagatcactgtgtaaaccatgtaacaccaaatatgccctgtcccaggtaatatgagggactgtagctgctttcccaggtgcagcttgagcctagctctaatcagccctccttcaggataagatgatactgtgacggttaatattagttgtcaacttgattgaaggatgcctagatagctggtaaagtattgtttctgagtaggtctgtgaggttgttgccagaggaaattaacatttgagtcggtggcctgggagaggaagagccaccctcagtgtgggtgggcaccatgcaattggctgccagcgcagctagaacaaagtgggtggaagaaggtgggataagctggcttgctgagtcttctggctttcatctttctcctgtgctggatgcttccttccattcctcctgcccttggacatcagactccaggttcttcagcctttggacccttggacttacaccaatggcttgccaggagctctcaggcgccctttggccacagactgaagactacactgttggcttccctacttttgaggcttttggacccagactgagccattcctggctgagcctgctgatggcctattgtgcgacttcaccttgtgatcctgtgagtcaattctccttaataaactccctccctccctcccctccctcccttcctttctttcttttgcttttttttttttttttttttgagacggggtcacagagtctcgctctgtcaccaggctagagtgcagtggcaccatcttggctcactgcaacctccgcctcctgggttcaagtgattctcctgcctcagcctcccaagtagctgggactacagatgcacgccaccacgcccagctaatttttgtatttttagaagagacggggtttcaccatgttggccaggctggtctcgatctcttgacctcgtgatccacccgcctcggcctcacaaagtgctgggattacaggtgtgagccaccaggcctggacttaaactcccttccatatatacatatgttctattagttctgtccctctggagaaccctgaatagtactgatacccaaagacttgtccctacttcctgacagtacccaatccagagtgaacccgtacttccttggatcctccccaaatcacctaaccaaaccccaaatcctaccacccttttactgagatgtgctgcagttcccaaaggcacacccatgatgtgcaatctcccttcttccaaagaacattaaacccaacttgttcaactataggtgtgtttctggaggtttctggctggaaggcaacaacagcattgtctccttctaccaacattagtattttgcagagtaaacttagatccaaggaagatttgcctaaggttatgctactaaatgaaagttgagccaaagatatagaagctgcaaataactttcagacaagtagagaaaaaagaaaaacaaatatctatcttaagtttgagacagtgccttagggttactgggaacacatcaagacttagggtaaacttaacatgagggagtttggcgtattggtgtctttattacttcctgtctacattcccttagaataggtagctaggcagacttgggcagggcaggagaaaacctcccccaccccgcccaggaatgtcaagcgactatcaggtgatggtcaggcaagttgttaaactatctaaaataatcattcgtctcaactggcgtcagggaaaggcattctcccaatagatggaaaatactagaatctggtgatcagcagcttgtggataagattttgggagagtgggctcaaacatgctcactaagaggcaaaatggtagagtttaactggtatatgagcttcctctaggaacaagactggtaagggaggaatgtctctagtgagtatgtgcacaacttcagtaaacacactgcacatgccgcccctcccaagtgccggcaggccactgagcatgccgacagcccaccccaagggaaaaatcggaagaagtaatgcaaggcctagaaccgtaccaatgtatcaatccccaaatcaagggtcaggtggcacagctgaatctctcaagttgcccacttggccctcttccaagtgtactttacttacttttattcctgctctaatacttcttaataaactctcactcctgctcaaaaacttgcctcggtctctcactctgccttatgcttcattcctttgaggaggcaagaagtgagttgctgcaggccagtacggatttgccactgcgaacaatttcattcatctgatgttcttgcttggcaacttgaactttctgaagagttagtatttgttttaagaataaaaccacattcaacatttgcgttctaattaacaaaaattgaagtatttccaaagcaattagattaacagtgagcacacacataacgttccaaactactcaagatcagcaaattcacttatctcactcattcagattcatatactcatttttaaaagttgtcctaggccctactgacttcgtcagctttccccagtttccattactgaaacttctaaagccactgctgcttaagccaccgtcaatttttagtgttataggaaagcaggagaaactgtgtttaagcataggaaaataagtaaggaaatgataatattgcatttataaaaatactgagagttaaatgtctaaaagtagaacaataactttacatctcatgaaagactccacatctagacaaaaattatcacaattttaatatacatattaaaattacaagaatacatacctgcttaaacatgatgtaaacctgaaaaggactaaatattttcaaaaataacttgtttcaagcaattttgtagcttacgtgaaggacattttttatcccaacttctattttgaaagagttaaaacctacagaaaagttgcaaaaatggaagaatgtggtacacgcctgtagtcccaagctactcaggaggctgggacaggaggatcccttaagcccaggagtttgaggccagccctggcaacatagcaagcaagactcccctcttagaaaaagaataatgggccaggtgcagtggctcacgcctctaatgccagcactttgcgaggccgaggtgggcagatcacctgaggtcaggagtttgagaccagcctggccaacatggcgaaacctgtctctactaaaaatacaaaaattagccgggcaggatggcaagcacctgtaatcccagataatcgggaggctgaggcaggaaaatcacttgaacctgggaggtggaggttgcagtaagtggagatcatgccactgcactccagcctgggcaacaaagcaagactgtctcaaaaaaaaaaaaaagaaaaagaataatgaacaactgtatattcttcatttggattccccagttggtaatatttggccatatttgctttatctttctctgccagtgtatagtcatgcactatctttcctatgtttagatgcacaaatgcttactacttgctacaactgcctacagtgttcagtagagtaaaatgctatacaggtttgtagcctaggagcaataggctgtaccatatagcctaggtgtgtagtaggctctaccattgaggtttgtgtaagtgaaatctatgatgttcacacaatgacgaaatcgcctaatagcacatcgttcaggatggattctcgtggttaagcaacacataactgtatatatataaatgcattttttccagtcatctgcaagctcatgattcttcacccccatatatttcagtatgtatttccttagaacaaaggacaatcttctacataactacaatataattatcatgatcaggaaacttaatgtcaatattaccatgtcatctataatttatatgtttctccagttgtcccaatactgtcttttagagtatttttttaacccaggttttaattaaggatctcatacaatatgtgtcacatatctagtctcctttaatgtgatactattcctattttagccattttttgtttttcaccacactgatgtttttaaagagttcaggtcagttgttctgtggaatgtacctccatgtggatttgtctcattgtttccttataattagattcaggccagatgttttcagcagaaattctacgcaagtgagattgtgttgtcgctgtagcaaggggagcgcatgacgtcagtctgtccctttattggtgatgggacaccattacttcataatttggtgaagtaatacccgcaagatttatccattgtaaaggtaccctttcctcttcatgagacttggagactatgtcaatattctctcatatatttacgtgttttaatatatgtaaacctttcactgaatggtgttagaatccactcattagtgacatttccaattagagaaaacacagtacatctataaagacctactgatggtgatctgcagtgggaagttgtgatacttaacctttcttaaatatgtagaggcaaactgaatagaaaactgtgtacaaaaatgaacactctatacatgagcatttttttttttttttttttttgagacggagtcttgctctgtcacccaggctggagtgcagtggcacgatctcggctcactgcaagctccgcctcccaggttcacaccattctcctgcctcagcctccccagcagctgggactacaggcgcccgccaccacgcccagctaatttttctgtatttttagtagagatgaggtttcaccgtgttagccaggatggtctcgatctcctgacctcgtgatccgcccacctcggcctcccaaagtgctgggattacaggcgtgagccacggcgcccggcctatacatgagcatttgtgaagcttgtctaagatttgtacatttgattgcgtggatattttgccttaaaaagaactgtaaatgaataatgtgtgctgatgtgttcatgggtgtagagtactaaggtctgcattaaaaagataagatggtttgatggaagaacaggtggatagcaatatagcaaaatgttaacaattgggtcgatatgtgtccactgtacaagtcttcccacttttctgtaagtttgtaagttttcataatacaaatttggatttaaaaacaccccaacattgcaagagtgtcaccaaagtgtttgaaaagcaggattctagggggggcattcgctgacgactcagagaaaccgtccatgccacccaccacccctacgcactcaaaagaagccctcgctaggcagcccggccctccgagccctggtatcgaggggctctccgcctctcccctgccgcggccgcctcctgcttgcccggcctcagtctgttctcagaacatactccatcacctggttcccagaactcagattgcgcagtggtctcgtcatcatcggccaggactcacagtgcccgcggagaggcctccctagacctccctcccgtccagcctcacccgctgcctactctcctcacgcccctgctccaggtcccctggccccatttcgctcgccacgttttcataatcctctcaggctccgggcaagcggcgccgcccgcaatgggacctgatcatataaggaaaatactgcgggctcatccgggggctgcaatggggacccgaaagcgccctagcctactacaatcaccgcaccccaactgccgcccacctctctgccctgcccccagtacagtacccaaaaccggtccgggtccagctcggcggcccaagcctctgcccagcggactgcgcacccgcccgccccagccaatcccgccgccgccgccgcgccccgcccacaggacgttcggtcccgcccccagctggcggccgcggccgcccgcgcgccaagttcctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggcgcgttgtggtctatccgagccccgtcccctgggctccctcgggctggggtgaggcgggcagcgctacgcgtggggtaggaccatcttacgctgggaccccgccaaggagccccaggaagtaggtgaaagggcaggggcgtggctctcggggcgccacccacgctcttgaaatctgggtgattgcgagcggccgctcagcgtcccccacaccacagacccgcgccgccgacgacccagcagccgccatggctctgctccgaggtgagcgcagccccctcctcctctcctcgcccctcggggtcctgccctccccaggccaggcctccgcttccggccgccgcggagagtcggggtcgtggggtgaagttcactcaacctcctcggttttggagcggacgtgataaaaacccagcccgaaaggcttgtttgggttaaggagaaaacccttacttgtaaggcgctagcgacagcgatttcggtgcaatttcctgtttagttgagaccaaagtttgcttgcatgtgaccttggaggtcattcctttcttcgcctaacagtgaccccactagttcgagtccaagtattagaaaaaatggggcggcgccataggccgcgggcgcctgctgcggggcagctgcgcacaggagcccgccgctcggcctcggtggtcagggctccccgggtgaatcgatggagaggcctgcagaaatggtagctggtgttctgctggaagacctgccctgctcccatttcccttctgttgctttagattagagcggtcactctatacctaagttctagggttatgaacttgtttaaaacaactgtgtaataaactcccttttcaaaacaagtgggcacagtcaatggaatcttactttaaggatgtacgagtcgaagaacattgaggtggaatacatatcgaggccctgagacaggaaaaagcttggcaggatctaagaaccaagcattttggtgctccagggccctgtgggctctgtaagaaggtggggttttgttccaaattcagtggaaggcaatacagggatttaaagcggggtaatgacaggatctgatttccactctgtccgaatttggggcggtctgtgtaatggcgaagagaccatttaaggatctattgtagaggtccagggagcagcaaatgatggctttgactcgtgtggggcagtgtaattggggagaaaaggggagggatgagttgagatagatttggaggtggatttgatagaaagtggattggatgtggtggagtaaatataagaaggaaatgtcgagaatgatgaaaagtgtctggtttgatgaaccgtgttcatgatgatgccacttacagagtgaggaaaattgggaaaggaatagatgtggaaagaaggattgagaattcagttttaggcagaaaactttttggtgcctgtgaagcagccaagtggagatgccagctaagcattggttagggggatctgaaagtgagaagaaccaaagtggcatgggaacaaatcaagggaaaaatccgtattctgggaccaaatgcagtgtttacagtttcctgcaacgtggatttcatttgccagtgcccttcctgactgaatttactacatttacttcataaagcagcgtggtgaattttttttagacgaggcatttacacttcatttaaaaggtgcattgtcatgagctatcttctaaaaaaggaaataatatttttactgatatcattttaatattttatcagtggttcttaccctttcttataatacagacctgtttgaaaatttcacaaatactataaacccaaaaaggaaaaaaatgcacattgacacctgtattaaggaagtataaagtttataaatttctggtacaatttactgtagtgttagagctagtgattgtatttttttccatttccttattgtagcaattaggaggacactcatgtcgagagaggtaaagtggttgtgtataataacacaggtagttagtggctgtgactagaacccaagctttgagcttgaaatagtgatgttacaggccagctagaatcattaaagataaacttctctcaagcagcataccaagtgtttgcaggatgggtgggaagaaagaagagcatgtgactgattatagggaaaaggacacatttgagttaaattttgttaaggattaacattaatttgtcagatttcagtcaacaagaagaaccggctcctaggtttttattagcacccatcccagtacttggcaggaggttttcgctcgacagatcatagctctcctactgctcctagctttgttgggaatgtttgtgtattttttcaaggcaagtagacagggctgctaaattaccttaatcttgaaacaactggatgccaccgcagctttccttaatttgccctcgttgctgcctgaagttgctctaagtgaatatttacctaacaatgtgatagaaaggtagtgctcctgtttctttcctagtggtgcttttcctgtattgtcaactcagcacatctttccagggcctttcttggagctacttggactcactacactctgggttaataggtctcttcactgtctttcagttttgggaaatttttagcctctgaattttcagggtgttcaaatgagatttcagtttggtgttaaagattgttaagttttagaccttttagtatccacgtaaaattgacatcaaatgaaaattgacatggtatacaatttatgaaattaaaaaaaaaaaactttaaacctttatagtctatctgcacatcccagattatttgttaaaatgaagatttaaaataataataacaaattattttttaaaatagagaaacccagtctctacaaaaaatacaaaaattagccaagcatggtggcactcgcctgtagtcccagctactcgggaggctgtggtggaggattgcttgagcccaggaggttgaggctgcagtgagccaagatcacactaccgcacttcagcctgggtgacagagtgaaaccctgcctccaaacaaacaaacaaaaaaaacccaaaccaaaaatatatgattgagaacattttctctgttcaaaataattgttttagttcagttaaggtcttacttgagctaacctttacagtctgggagcatcaaataagaagtaatataggtaaaggggaggtttttttttgtttttattttcccatgcacaccctttcctttgtagatattgcatatttcactactagcactgccctatcaaatgctttcttagaatatgagacataggggagaagttcataaaaggaactttgtagagagacaaatgaaattaggctctattgtttctgagaagtgaggggtcatttccatgtgtgcaatatgtcatttttatttctggatgctttatatatttttgttatctttggatttcaaaagtttgacaatgatgtgccaagctgcaggagaacggggtgtggagtgttacgtgtggtgtttattagagttgaggtttaccaagctttaatatacaaatttatgttttttatcaaatttggaaatttcttctttattatttctgcaaatgtttttttaaatccattctctgtcctctcctatgactgtaacttgttagtccttgaggttctgcccgtgtttttttactatccgactttaaagaaaaaatttacaaactttgtttttgagcagatttaggttttacaaaaaaattgagcagaaagtacggagtattaccatgtgctcccttgcccggtccgtttcccctattattaacattttgcattagtgtggtacatttgttacaattgatgagctaacattgatatattattattcactgaagttcatattttgcattcaagttcattcattgtattgtatagttctatgggttttgacaaatgtgcaaatgaccgatgtcagtattatagtgtcatgcagattaatttcaccaccctaaacatcatctgtgattcacttatttatccctgtctctgaacccctggcaagcactgatctttttactgtctccatagctttgccttttccagatatcatgtagttggaatcatacagtatatggcctttccagactggcttctttcacttagcgacatgcatttaagattccttccttttatggcttgatagctcacttctttttattgctgaataatattccattgtatggctgcaccacagtttgtttatccattcacctgttgaaggacattgttgtgggaagtcagggaccctgaatggagggaccggctagagctgtggcagaggaacataaattgtgaagatttcatggacatttatcacttccctaataatactcttaacgcctgtcttactttaatctcttaatcccgttatcttcgtaagctgaggatgtacgtcacctcaggtccactgtgatgattgtgttaactgtacaaattgattgtaaaacgtgtgtttgagcaatatgaaatcagtgcaccttgaacagaataacagcgatttttagggaacaagggaagataaccataaggtctttactgcctgcggggtcgggcagtaggagccatatttttcttcttgcagagagcctataaacggatatgcaagtaggagagatatcactaaattcttttcctagcaaggaatgttaagaccctaggaaaagaattgtattcctggggggaggtctataaatggccgctctgggagtgtctgtcttatgcggttgagataaggactgaaataccccctggtctcctgcagtaccctcaggcttattagggtggggaaaaaacgcttcttggtaaatttgaggtcagaccagttctctgctattgaacactgttttctgttgtttaagatgtttatcaagacaatatgtgcacagctgaacataggcccttatcaggagtttttgattttgccctttgccttgtgatctttgctttgtcctttgccttgtgatctttattggcctcagaagcatgtgatctttgttctcctttttgccctttgaagcatatgatctttgtgacctactccctgttcgtacacctgctccccttttgaaatccttaataaaaacctgctggttttgtggttcaggtgggcatcctggacctaccgatatgtgatgtcacccccggcggcccagctgtaaaattcctctctttgtactctttctgtttctcagaccggccgacacttaaggaaaatagaacctacactgaaatattggggggcgggttcccatgataggacatcgtggttgccttcaagttttaacaattaggaataaacatttgtttgcaggtttttgtttgaacataagttttcaaatcatttaggtaaatacaaggaacctgattgctgtatcatacatatggttaggtgtgtttagttttataagaaactgccaaagtgtcttccaagctggccataccatttgcattcccaccagcagtgaatgaatttctgttgttccacatcctcaccagtgtttggtgttgtcagtgtttgggattttagcctttctaaaatccaaaagactaatagttgtgtagtagtatctcattgttttaatttgcaattccctaatgacatacaatgttgagcatcttttcatatgcttatttgccatctgtatatcttctttagtaaggtatctgttcagatcttttgcccatttttaaattgggttgcatgggtttttttttttttttttaattgctgagctgtaagaacactttgtatgttttggataccagtcccttatcagttaggtgtttttataaatattttctcctagtctgtcgcttgtcttttcattctcttaacagcatcttttgcagagcagaggttatttattcatttgtttttagagggtcccgctctgtcacccaggctggagtacagtggtgtgaacacggccactgtagccttgacctcctgggctctagcagtccccttgcctcagcctcccaagtggctaggaccacaagcacacaccaccatgcttggctgatttcttaattttttatagagacagggtcccatcatgtctcccaggctggtctcaaactcctgggctcaagcagtcctcccaccttggccttccaaaatgctgggattataggcatgagccactgcacacagccagaagttttctattttaatgaagtccaacctaagttttcccttcatggatcctgcttttggtgttagatctaaaaaattatcaccaaacccaaagccatgtagatttttctcgtatgttctaagagttttgcattttatatttaagtctatgatctctttgtttttgtttctgtttttttagataagagatctcactctgtcacccaggctggagtgcagtgacttgattgtagcccacggtagccttgaactcagcctcctgaatagctgggactacaggcacatgccactatgcccaactaattttttacattttttagagatggggatctcgctatgttgcctaggctggtttcaaactcctatcctgacacagtcctcccacctcagcctcttgagtagctgagattataggcttgagccacagtgcccagcccactatcaaagttgacgcatttttgcctggattcattttgtttggtatatagatgttttgttgttccagcactgtttgttggaaagacgatcctttttccagtgaattgcctttcctcctttgtcagaccttgaggttctggctttgttttttaatcttttttttttcatctgttcttcagattggttaatttctatttatctatcttcaaagtcgctgaatttttctcctttcatttctattttgctgttaagcccatccagggaattttttatttcaggtattttccagttttggaatttccattttggatttttatagtatgtatttctttactgagatgtcctatgttttattaggagcatattttcctctacatccttgagcatagttgtaatagaatgctattttaaaatccttgtctgctaatttcagtgtctgggtcttcttgggattggtctctgttgattgtcatattttttgtttcctcatatgtggattaactttgaattgtattatgaatattgcagatggaacattgtggagactggattctgttataatcctgcagacagaactgacttattgattggttggctatttattttttgtagacagttactttgcctacaaaatcacccccatgcacccccgtgataaactatgtctccccttgtagtgggcagcagcttaaatctaagttcagttttttaaggcttggcttaggtgcttgtggtctgacctacacatgaatggctaaggagtcagccaaatatttgggcagagtttatatgtgaaatttggaatctcgctctatggtgctcctctttcccagattctcattcactttctagtggctgtgcttaccatgaattttattctctgattcttcaagccagtaagactgtttctgagttctagccattccatgcatcatggactgttagtcttcaagttagttgctataaataaattggacacttaccctgttctgttcccttcctctaagtatcaactcttctccttacctgtctagttttgttcatttccaagaccgtcaggtagtagttgttcttatatattgtctggagtttttcattgttatctgttggagggttggtcagataggagcatagtaggccatgaccagaagcagaactaatgaaattaggaagaaggcatggaaagaggaaagaagaatgaaataaagcaaccactgataggccaggtgcagtagctcatgcctataatcctagcagtttgggaggccaaggtgggaggattgcttgagcccaggagttcgagaccagcctgggaaacatagcaagaccccatctctacaaaaaaaaaaaagaaaaaaaggtaaaaattagccaggtgtggtggcacatgcctgtagtcctacctacttgggaggctgaggcagggggatcacttgagttgggaaagtcgaggctgcagaggtcgaggctgcagggagctgtgatcacatcactgcactctagcctgggcacagagcaagactgtctcaaaaaaaaaagaaaacactgatataaaaataggcagagactgttaaggaaggaggatgaaaggaaacttgaaaagattcaggaaggcatcatggtacagaataaccaatttaccagaacaaaacgtttgtaatgcactcgactagtatttatggccttttgtaactatctgaatttgtatctgtaaaaaactgagtggatctgttctaaattatagttatatatattgctcctaatattcctttaaactgcaaatttctcaaaataggaatgaaaagagaggttgaaatagaaatattttaggctaggcttggtttgtttgatgaaagagatcataaactggaagattatacttagataccagtagtggtataatgcttgaatagtctcatttgtagatcagtatcttatcacaaacccattgccgaaagtcccataatttcttgacaagatgtggaaatgtgagcttagattgtcttggagagaataaagttagtatatgcaaagtgctagcatgaagtctattccatagtaagtgtcccctctatgttagctataatatttaccttgcagagttgctgggaagattagcttttgtgtggaaagtgataaaatgtctagtatttagtagacacctaatgaatgtcaatatgatgaaatggctataactgatgctgcttactgatatgccggttttgcactgtacagctctaatgatgatgagtgggtaccactcacatcataatcatatatttgtatagtcacaagtttttttttggcagatggtagtaggtgattgggaaggggtgatttttatttatttgtacaaggacaccgatttaactaatagtgatgctgcaaatttatagtcttagtttgtattagtagatgtatagataattcctctattctttgtgattagataaaatgcatgctatttttgttatattcttatattctaagggacacattttaataggatgttggcaaactacagtgtctttagaggaaagcagtcagaattaatgtcaaataaaaaactattgaaagaatgcctttaatttacctgagatgagagtcactaggtttggggacttacaggttagctgacttcagatactggaggtgggggatacacatgtagaaggtaacctgttttgcccattttttttctaagagtaaaagataatagttcaggttatttatttgaagtctgtaacttgagtcatcctgtgactctagaaccggtagcagcatatattctagaaactacatctctatctgtgttggtgcttttggagagaactagaattggtggatggaagactttgtaagctgagttagttcaatataaagaaatatcattcgttggggccgggagtgggtgactcacgcctgtaattctagcactttgggaggctgaggtgggtggatcccctgaggtcaggagttcaagaccagcctggccaacatggtgaaaccccgtctctactaaaaatacaaaaattagccgggcctggtggtgggtgtctgtagtcccagctactcgggaggctgaggcaggagaatcacttgaacccgggaggcggaggttgcagtgagccgaaatcgcaccactgcgctccagcctgggcgacaagagcaaaactctgtctccaaaaaaaaaaaaaaaaagcaatatcattagtttatgttgtccatgaccagcacactgtttcatgcagtagagtatgccctcttactgaaagtttcctggcagaggtttagagagaaccttttgtcaggaatttttagaggtagttcttatagagtgagtggttgacctcagacaaccctaaggcaccttctagtttggagattcttttattctaatactaggcaatatactccagcacatagaagaaggattttagttctcaacatatgtttctagcattgtgaagcatcagagaacaagaaagttgtctaaccagaatggctttacatcacagtgtagcaggacgagccacagtcaaaactcctcagacactggattaaagaaggaagaggctttatttggcttggagcatccaccaacttgcgtcttaagagccgagctccctcaaaaagaaattcttggcccttttaagggcttacaactctaaggggtccacctgaaaggatggtgatagatcaagcaagtgtggggaacgtgactgggggctacatgcattagcttacagagcagaaagttttgcaatgctttttcatacaatgtctggaaattacagataacacaagtagtttaggtcagggattgatattattattattattattattattattattattattattattattattttaactaccagggccgggtggtggcaccaggccatctggctatttatcttacttctgtttctttttaactttttgcttttttcttttcctcctgttttataaactaggcaaggggggcggggtgcgcaggagaagtggtggtcttcttccttaacagcatgcagtgcagttcttggtacctgcatgtaggtaaagatcaaactgtcaaactggtagtccttaagactctgcttccatgggtatgacttgttctaggtattattgcctaacagaaatttccattatctaattttaaattgtgtaaggtttcacagtgagattattcgaagcatttagaggtatttactaacctgtgatggcttacaaatctcttcttgttgcaataggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcaggttagtagagtaaaggaaggtgttcactcctattgcttctttgatcagtttctaaaaataattcctttaacatatcataatggtaaacaagttaataatagttatagactttttttttttttttttgagatggagtctcgctctgccgccaggctggagtatggtggtgcgatcttggctcgctgcaacttccgcctcccgggttcaagcaattctcctgcctcagcctcccgagtagctgggattacaggcgtgtgccaccaagcccagctaatttttgtgtttttaatagagacagggttttaccacattggccaggatggtctcgatctcttgacctcgtgattctcctgtctcggccccccaaagtgctgggatgacaggcgtgagccaccactcccagccaatagttacagactttatacgtttgtaatttgagtaattctgtgactccagaatcaacagcatgcataattcaaagcatcatatgttctagaaactgtatgtctgacttgggatgcatttcagtgcttcctaaatagcagattgacttccttggcttacttgaagttaattgatcttctctatatgccaccttagtaaacccaagccattacagcacacctcccctaattttcttacacattgtaggagcttgatcagtgtttgttgtaagaaataagatgcttccttaccctctgtcttgctatgtgtgatgtacaaaatcaatcattcatatgcaggtaattgaaaattcagaattcctttaaagtatacaaacatttgttggatacctagttagaggctattataggtgctatggcacccaaggtggaccaaaaggaggtaataatctaatgaaaaagataagatatatatatatatatatatatatatatatgatcagtttctgtgatatatcttatgtatcatatatacacacacaaatatatatatgatacatatatttaaagatgtcaatgatgtgatcattgctaaaggaaagagaatgacaatggacacagaaatcactaggccttgcatttgaacttgatgctgttcatcttgccgttgtgtatcttcacatccagaaaaagcagtgacttttttcctttggcagttatgtctgttgaacctaaaatattttcataaagaattctcaatattgtcttttgttctttttattttattttgtaacttttacctctgacctaagaaggcattagaacagattgaatagaaattggatacttccgttttttgcgttttctagaattttgaaggaaaaatatttttttcccagcatgtattctctcaaactttataacacaaagtcactataaatagtatcagtttcattgtgtttgtgcctctgttcctaaagacagtttttcttgtgttaagttttctgtcaggccaagatagagttttcttgtaaggatgttaagtgcttaacataaatatttggggttaggcctttatggttaagagagaacagaatatgcttcgaataacatttgacaaataccacaaagctgcttttctaattgagttttatattattaaatatcacttggaataaatgagttttacttatttcataggaaacaatgaaatccaatgtggattctttttatttctttttcttccctaattgccctggctagaatctccaatgttgaatagaagttataagaaatggatatctttgtcttattcctgattatagggggaaagcatctggcctttcaactttacatatgatgatagctgtggatttttttttttttttttttattgatcattcttgggtgtttctcgcagagggggatttggcccacaggacaatagtggagggaaggtcagcagacaaacaagtgaacaaaggtctctggttttcctaggcagaggaccctgcggccttctgcagtgtttgtgtccctgggtacttgagattagggagtggtgatgactcttaacaagcatgctgcctttcaagca

SEQ ID NO: 14758 - DNA, 24395 bp, Human
  misc_feature (1)...(24395): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgttgaaatcctccctctccttcaatatccagaacaaacccccacaccctgccatgattggtcctggctggaaaccgtccctccttctttcttccttcctctgtgcatgtttcttgcaaaggcagtacagggcagtggtgaagagcaacgactttggaaccaccaatttgctatctctgtgaccttgggcaccttactcagtgccaattcgcagtgcctcagtgtcctcacctgtcagggggagaagtgcatacagcattgttatgaagagtgaattagttaaaggttgtaagaatagtgcctgatagcatctgatcagcactgaatatatgttagcaattattttgattcaccgcagagggcggtctacgagagcgcagagccccactcggccagcggggtctggcgggggacctgtcgcgctgaaagctccagggtagggccgacgcccatcaggctgggcatccgttcgggatgcgcaggttgcggtctgcaaccggcggcgccacgcccaggcgggcggagcgcggttcccggagtctcgcgcccgcggtcatgtgacacagcgaagatggcgtcgcccggctgcctgtggctcttggctgtggctctcctgccatggacctgcgcttctcgggcgctgcagcatctggacccgccggcgccgctgccgttggtgatctggcatgggatgggtgagtgagtgagaaatttaaaagggtttggcgattctctctcttcctagcctgggttcgcatctgcaaaatgcgggtgtagagggcgaggacgtggtcccacagcacgcggctgcctcgacattttaggatttgaaggatctgcattggaaagagagaaggggaaggagccgtccccttcactggaaagagagaaggggaaggaaagagagagccgcgcacggcgttgaagttttacatgctgtccttgattaatccttacagtagtggcgtcaggatagcagcatctctcacttggtcaggctaggtgagctgcggctggctatatgactggcgcatctacccttttatttattccttcacacattgaacagagatttgttaggcacctacagttcatttacaaattgagtaacccttatctgaaatgcttgggactgggaagcatttcggatttttttttttttaatatttgcatatatacaagagatctggggggtgggacccaagtgtaaacaggaaatttatttatttttcatatacaccttatacacatagctggaaggtaattttatgcaatattttaaataattttgtgcaacccatcacatgaggtcaggtgtggaattttccacttgtggcatcatgtctgcgctgaaaaactttcagattttgggtttcccattttcagattaggatgctcaacctatattcatttaacacagttattgagcacctactaggtgctgaggatacagtagggaactaaacagactaaattctttgttcttttggaacctactctccagtaggagaagcagattataaagaaattaacaagtaaaacataacatatcaaatggtgatatgtgcaacggagaaaaatatagtagggtgtaggataaaaactggaggtgggggcttgcacttttaataaagcaaagttgggaaagaattcattgaaaaagtgacatctgagtacaaaactgaggtagatgaggacagttgccatttggctgtctggtagaaggaacagtaaatgggaaagccctgatgtggaagtatgtctggtgtgttcaagggacagcattcagatcagcgtggctggaaatgagtaagcaaggggaagaagttaggagtttagtttggaagggaggggcaggtacagaagttattgggcctagtaagactaatgcagggactttggctagagtgtcatggggaactttttgagcagatgagtgacatgatctgacacatttttaaagaatcactttagttgctgtattaagaatagatcgtagggcgtcatggatagtcacagggagacaggttaggaaactattgcaataatttaaacaagagatgatgacttggaactgtagagtaacagtagaggtgttgagaagtggtcaaagtttggatagattttgaaggtggattgctaacagatcagacttggaataagagagaaagaaaggagccaaagatgactccacaggttttggcctgaacaattggaagggtgaagttttcattttaccaagatggggaagcctgtaggacaagctgacttagggtgggggaaagatcaagagtctgcttttgggcttactaaacttgagatcctcatgagacacccaggagatgttgtagaggcatttggagtgtggagtctaggacagagatacgggttggagatttaagtagggagtcttcggcatacagctagtagttaaaggctaggtgagaccacctaggaaatgagcgtacacagaggactaagccctgaggcactccattccatttggaggtggaggaaatgaggagaaactagcaaaggaggctgtaaccaaatagccggtgaagtggaggggtcaggaaagcgcagtgtccttgaagccaagtgaagaaaatgtttcaggaagaagggcatgatcaactgcatcaaatgttgataggtcatgatcaactgtatcaaatgttaatgggtcaaggaagataaaggctgacaactgattattggatttagcaatataaagatgattaatcttgacaaaagcagttttgggagagtcgtgatagtgagatctttattgggatgggttacagaaaaatattcagagtaattagagtcagcaaatacaaacacttgcaaggttctccaacaggccctggggctactacagtggggtcaaaagaggacacagggtaggagctttgtgttttcccagagctcacagtcagttacaggggaggcagaggcagttaagtaacctacaattacagctcagtgtggagaacgttgttttcagagaaataaaaggaatagacaattctctaggcagtagccttttcttgttctaaaattggtgcttaagctttctcacaggttgcaaatggaataagtaagttcaaaatgggaaatgatctcagtccacttctactcagtagccagtttgcttcccgttcctagttctagttccctgaaatagaagaaacaagtctggggctaggacaagatgaagaggctcctgaagtgcaaatttaacggggcactcactctcaaattcagggtcaacacttacataaacctgagaatgagtgcctccttaaattttgtgccctagagcgggggtcccaaactccctgggtctgtgacctgttaggaactaggccacacagcaggaggtgagtgagcctgcagccttaccaccatgagctctacctcctgtcagatcagcagtggcattagattctcaaagagctcaaatgctgttgtgaactgcgcatgtgagggatctggattgggtgctccttatgagaatctagcaaatgcctgatgatctgaggtggaacagttttgaaaaattgtcttccacaaacctggtccctggtgccaaaaaggttgaagaccgctgtcctagatgcttaatttgcctcaccctagtcctggccctgaagagaaaactttgcatctgttcaccccaaatatcccctgtgataggggaagggaatgtgtacctctgcttatttttcatttgtaaatttggtgtcttaattatcctatatgggctttttggtttttttgagacagggtctcgttatgttgcccaaactggtctcgaactcttggcctcaagcaatcctcctgcctcgtcttaccaaagcgctgggatgataggtatgagcccatgcttggcctatatggatttttttttttttttttttttgagatggagccttgttctgttgcccaggctggagtgcagtggcatgatcttggctcactgaaacctccacctttcaggttcaagcgattctcctgcctcagccccccaagtagctgggactacagacatgtgccaccacacccggctaatttttgtatatttagtagagatggggtttcaccatgttgcccaggctggtctcgagctcctgaccttgtgatccacccacctcggcctcccaaactgctgggattacagacgtgagccacgacacccagctcctgtatggacttttgaagcttgttattccttgataaacaggagctaagcaaaaaatgttctttcttctattttttaaaattgaggtaaaaattcatgtaaagttaaccatttaaaatggtacaattcagtggcatttagtgtatttgcaatgttgtgcaactaacacttctctctttttcaacaccccagaaaaacacacatagccattaagcaatcactctgccccctcctactacttcttgataatctccagcttagttttctgtatctcagtggatttgcctgttctttatttatcctatgaaaggaatcatgcattatgtggctttttgagtctggcttctttcacttagtataatgtttctgaggttcattcaagttgtaacatgtgtcagcactttgttccttttttataactcagtaatattccattgtgtgaatataccacattttattcattcattcattgatggactgctggattgtttctcccttttgactattacaaacactgctgctgttaacatctatatgcaagtttctgcatggacgtgtgtttttatttctttggggtgtataactaggagttgaattgctgagtcatttagtaatcgtatgtttaactttttgagaaaccaccaaactgtttttcacagtggctgcttattacattcccaccagcaatgtccaaggggtcccatttttctacatcgttgacaatacttgttattttctattaaaaaattattattaaagacatcccagtctgtgtgaaatggtatctcatcgtggttttggtttgcatttcacatgcttttcacatgccagtggttagccatttgtatatcttctttggaaaaatatctgtttaatttcttttcccatttttaaattaggttatctttttgttgagttgtaagtgagttatagattccttgtttattctggatattaagcccttatcagataactgttttgcaaatattttcttccattctatacattgttttcacatccttgataatgctctttgaggcctcagagtttttaaacaataaacaatatttggactcatgagtttccatcattgtgttttgttggctaggagacagctgttgcaatcccttaagcatgggtgctattaaaaaaatggtggagaagaaaatacctggaatttacgtcttatctttagagattgggaagaccctgatggaggtaaggcgcttcacagctgttcctttgaagggttgctgactgatttcatagcatatactgttaaaatgctttgccttgtgttttcagcagcagatcatacagtgatactttcacccttgagtggctcatgtgaggataccaacctaaatgagtttacctcttagagaagatgtcagtggttgttttcagtcccatcctctcacttctctctggcttcttttttaggacgtggagaacagcttcttcttgaatgtcaattcccaagtaacaacagtgtgtcaggcacttgctaaggatcctaaattgcagcaaggctacaatgctatgggattctcccagggaggccaatttctgtacgttcctttttgttatattgtaccacttatatggaattgatttttgtttcttttatttagataaatccactcctccaattcaagattgtcacctatcttggaagggaaatttcctaaaatgttcctgtgtaagaagctttatggaacttaatttcttttcttttttttttttttttgagacagaatttctctcttgttgcccaggctggagtgcagtggcgcgatctcagctcactgcaacctccacgtcccaggttcaagtgattctcctgcctcagcctcccgagtagctgggactataggtgctcaccaccacacctagctaattttttgtatttttagtagagatggggttttaccatgttgtctaggctggtctcgaactcctgacctcaggtagtccacccacctcagcctcccaaagtgctgagattacaggtgtgagccaccatgcctggctggagcttaatttattttctatgaaagttgaaagaaatatttgcatttgcccatatcaggaaaatcctgaaactctgcgggtttggggagtcacagaggatgactagcttaatctgtgatgctgattgtggatgatacatttccatctgacagtcggagctaaaactcccttttattccgtaggagggcagtggctcagagatgcccttcacctcccatgatcaatctgatctcggttgggggacaacatcaaggtaactttgcctctttgctttcttttttctgtattctaacccacatgaccacctgatttaaaaaaaaatctaggaactgtatttgcacaagacatcagccattcttgcaaaatcctgtttctctagcttttaacaaactagccagcattgctggagacataggaagagacttaggattccagaggcctggatcactaggttggcatctacttctctccaatttcattgacacgattgcatggaagtaagatggttatagccacgtggcaggtggtggttgaggagttaggaaaattgagtgaccttttctgttctctgatttggtggtatcctcttgaatttaggcttaggcaaagaatagtgtgtaagctcttgtgtctataaatttaaactctttgagaaacagcaggttttctattttgacggaattccatactattggggaaggatgtgtcattagaatggaatttcatctctgttgtgatgggtatagctattagctggtataatgtgggagcagaatgattctccgtgtaatcaggaaacctggactcacccaattaactattactcctaggcaagtaatttggtatcttaggttccactcacagatggaagaaaccaaaatatggccctgcctgtcctatgggaatttttcagaggataaagtgaaataataggtaggaaaatactttttaaaagtataaggattatacaaacgcaagttggtaaaaacagctttattattcattcatttaacaaatatttattgaaaacctattatatgccaggaacaagacagacaaggttcttgcattcatgaaatatatatatatacacacacacatgtgcacatatatgcacatacatacatagacatatatatatacacatatgcacctatatacacacatacatagacatatatagacatatatatacacacatatgcacttatatacacatatatacacacacacatatatatatatacacgataaaatggaggatagctgggcacatggtggtgtacacctgtagtccctgctacttgggaggctgaggctggaggatcatttgaagccaggagttcaagacactgtggtgtgctgtaattgtgcctgtgaatagccattgcactttagtctaggcaacatagcaagacccaatctcttggaaaaaaacaacaggatactgtttgaaggacacactagtggttgtagtgcttaaaggagtgggctctggggccaaactgcctgtgtctgaatcctggcttatcccttattgtctaaccttggacaaggtatttaacctcatttttacagttttctatctgtgatatagggcaaataatgaaatctactccacagggtggttgtgaggattaaattaattattgccaatattttgcttagaactatttgtgttactcaaaacaatgttattgatgaggatgctaaggatgaagtataactgggggaggggaaggaaatgggggtgggtactatttgagataaggtggtcagatgtgacttgtgtaggaccaagacctgagagctgaaaatgcgtccagccatgtgatgcaacacatcctccagggatgagcaggtaaaaagatccttaggcaggaaagagtgtagcagcaccaggaggaagctggtgatagtattagttctctgcactttattttcatgaggaataagtgaatgaaatcagagtttggtcctgttcattttgtttctcacagtgccttgtgcatagtgggtattcgatacatcattattgaaggagtggatatttgtcatctaccactgtaggtgtttttggactccctcgatgcccaggagagagctctcacatctgtgacttcatccgaaaaacactgaatgctggggcggtactccaaagttgttcaggaacggtatgtatggttagctgaaaagattacagacctgtcaccgtgtgaaaatatcatgctgactttcatgctcacagtgattccagcagtagttccttgtgatattcaaatgagatctttttttttttttttttttttttttgagatggagtttcgctcttgttgcccaggctggagggcagtggcgtgattttgtctcactgcaacctctgcctcccaggttcaagcgagtctcctgcctccgcctccgagtagctgggattacaggcatgcgccactacgcctggctaattttgtattttcagaagagactgggtttctccatgttgtttaggctggtctccaacttcccgagctcaggtgacccacccaccttggcctcccaaagtgctgggattacaggcgtgagccaccacacccggccttcaaatgagatctttttgtactatctgctcaatttcattgtaaacctaaacttgctccaaaaagtctattaactaaaaaacaaagaaagaaaaacaagggcatttttctatgtaagaagaatgtaattataacagaataaatttccatccttaaaaaacaaacagaaagcctttagaaagtactaagctcaaggaattattgttggtatttagaggacagattctttatgtcattagctactccctatatcactgtccctgactactcaaatgtatttgggtatttagcatggccagcctggcataatggctcacacttgtaatcccagctctttgagaggccaaggcaggaggattgcttgaagccagaagttcacaaccagtctgaacaacatagtgagacccctgtctctgttaaaatctattttttaaaaaaaaaagatgcagaattacttttgtagtatgtgcttgttcagttggttccaaacttaattgtatatcagaaccacagggaaattcattaaaaatggattcctgggctttatccttagaagttgtgggccgggcatggtggctcacgcctgtaatcccagcactttgggaggtggaggcaggtggatcatgaggtcaagagttcaagaccagcctaaccaacatggtgaaatcccgtctctattaaaaatgcaaaaattaactgggcgtggtggcgcacgcctgtaatctcagctagtcaggaggctgaggcaggagaatcacttaaaaaacccgggaggcggagcttgcagtgagccgagattgcgccactgcactctagcctaggcaacagagggagactccgtctcaaaaaaaaaaaaaaaaaagttttgatggtaggtctgacgtgctcttgatgatagctggagtttgggatcaactaatatcctgtgggttttccaagtgtctcattcttgtcaaataacaactttttattacagtatattcttgaagccattttccaagatacagccttgtgactgactcatgttgtaaccacctacagctaatagctgtcttttcttttcccactcgttggctacacaaatagccacaaagctgttttgggtcagcagtaccacctgatggttattatagaaaactaagatactctgtacctctagctccttttttttaccctcaggctacaccaagctttcccctttgcctggtttgattggctgtggctaattacaacttaattatttatattctacatattctctgttctcatggatttgcatggtatttaaacttcattcttcttcctttactctttattctcactcttgcccagttgcctccaaaacgcctatacttttctttctttgtgtgaaccaaaacaacccttggcgatcagaattctgttagtgatgctaagtgagcagtccgtcggggggtgacaagtgacacctaaatactgattaaggcggggcgcagtggctcatgcctgttatcccagcactttgggaggccttggtaggcagatcacttgaggcctggagttcaagaccagcctggccaacatggcaaaaccccatctctactaaaaatacaaaaattaggcaggcgtggtggtgcacacctgtagtctcagccactccggaggctgaggctagagaattgcttgcacccagaaggcggaggttgcagtgagctgagatcgcaccactgcaccccaacctagatgacagagtgagactctgtctcaaaaaataaaaataaaaaatactgattaaaagctatagattgatgtgtttatcttcacttcctccttaaactttaattaagtggtagcagaagaataaaaagtgataaacccacaagggcagagagaacagggagagaggaggtaagagatcataaaaaatggcaacatgtttttgaaagcaagcaagcagatgaatgagtgtgagaactgttttagcagagcagatggtgaaggcttaaagtaataaagagaaatcattttgtctttgtgatactgtcccaggttgcccctggtattagggaggattaattctggttgcaagaagaaacccatatcaagccaaagtaaattttaaaagaaagtaatactctgttggtgcctaaagcctcatagggcctagaatcaagaattgggagccatgaggagccagggtattctctctccagtgccattgttgcttctctctctgtgtcgctgcttctttctctccatgcagaccagcttcccctgccacccacatgatggaaggtggcctcgcacggcttccaaatgtttaattttctgttaggagattgtctcagtctgaggctagactctctttgtcccgattcagattcttcaggaagggaccatgccccagctcaggtcaggtctccacctctgctctcattagctgtggccagagaagtgggaccgtgcttactaaccataccccacctccctgtaaaccagtaggccgggcaggaagagtgcaagagaggcagagaccccaaaagatgtcttccacattcttcagataacttaaccttagcaaagcaaacgtgatatcctaatacgcacagtaactggtggggaagcccccggcttggcatggtgagggcaacgaggaatggtataatagttctctctctccttcctggatgtaaaactaccctctagttcccttttgcctttgcagatgctgtcagcccttcctagccttctccttcctccggtttgctccctgccatcccctgccccacgctctaccctcctacctctacactccctgccacaatgaatgcttcagtgttgccctggccttggcctccgtcttcccccgtaccagctcagaggaagctagagctttacatatcctgtttaattttcatagcaacttgccttccccaggtctgcttctgggccccgctcccagtttgcaccccannnnnnnnnnnnnnnnnnnnccccgctcccagtttgcaccccaccctcagtgggatctcagagtgcttttcctcaattgtccagttttcccatgtctttgccctcagccgatgaacttgcaacttggttttctggaaatattaaggcatctactcaggctctctcagagactttcagccattcaaaaaagttagagagtaatgtaacgaactacaggcatacctcagagaaactgaggatttggttctagaccaccacaataaagcaaatattgttaatacagcaagtcacacaaagttgttggtttcccagcgcatataaaagctatgtttacactatactgaagtctattaagtgtgcagtagcatcatgcctaaaaaaagtacatgccttaattagaaaatactttattgctaaaaaatgctaatcatttgagtcttcagcaagtcatctttttgctggtggagggtcttgcctcggtgttgatggctgctgactgatcagggtggtggttgctgaaggttgggatgtagggtccagccccacagggtcggtgggtttttctccctgtgtgcggagatgagagattgtagaaataaagacacaagacaaagagataaaagacagctgggcccgggggaccactaccaccaagacgtggagactggtagcggccccgaatgccaggctgcgctgatatttattggatacaagacaaggggggcagggtaaggagtgtgagccatctcccatgataggtaaagtcacatgggtcacgtgtccactggacagggggcccttccctgtttggcagccgaggtggggagagagagagagaaagacagcttaggccattatttctgcatatcagagacttttagtactttcactaattttgctactgctatctaaaaggcagagccaggtgtacaggatggaacatgaaagcaggctaggaacatgaccactgaagcacagcatcacagggagatggttaggcctccggataactgcaggcgggcctgactgatgtcacgccctccacaagaggtggaggagtagaggcttctctaaactcccccggggaaagggagactccctttcccagtctgctaagtagtgggtgtttttccttggcactgacgctaccactagaccacggtccgcttggcaacggacatcttcccagacgctggcattaccgctagaccaaggagccctctagtggccctgtccgggcatgacagagggctcacactattgtcttctggtcacttctcagcatgtcccttcagctcctatctctgtatggcctggcttttcctaggttatgattgtagggcaaggattattataatattggaataaagaataattgctacaaactaatgatgaatggtattcatatataatcatgtttatgatctaggtctaggataactcttgttgttttatatattttattataccggaacagctcatgccctcggtctcttgcctcggcacctgggtggcctgctgcccacattggggtggctgtgctaatttcttaaagtgagacaatgatgaactttgtatcagttgactcttcctttcatgaaagatttctttgtagcatgcgatgctatttggtagcattttggccacaatagaacatctttcagaactggagtcaatcctcaaaccctgccgctgcttttatgtaagcttatgtaatatttattctaaatcctttgttgtcgtttcatcagtgttcacagcatcttcaccaggagtagattccatctcaagaagccactgttttgctcatccgtaagaagcaattccttatctgttttttgagattgcaacaattcagtcacatcgtcaggttccacttctaattctagttctcctgctatttccacatctgcagttacttccttcattgaagtcttgaatccctcagccattcatgagggttggaatcaacttcttttaaattcctgataatactgatattttgacctcttcccgtgaatcatgaatttttgtttgtttgtttttgagacagagtctcactctgtcacccaagttggagtgcagtggtgccattacggcttactgcaacatagcctcaacctcccaggctcaagcaatcctcccacctcagcgtcctgagcagctgggactacaggtgtgagccactacaccccactaattttttactttttttgtagagataggatctcatttatgttgcccaggctagtctcacactcctgggctccactgattttccctcctcaccctcccaaagtgcatggtacccagcccgttaatgttcttaatggcatctagaatgataaatcctttccatcaggttttccgtttactttgcccagatgcatcaaagggatcactgtctatgcagctacaaccttgtaaatgtatttcttaaataataagacttgaaaattgaaattactacttgatccatgggctgtagaatggatgtgctgtggcaggcatgaagacaacattaatctctttgtacatctccatcagagcgcttgggtgaccaggtgctttttaatgagctgtaatatttgtttgttttttgagtttgtttttaaactttttttaattaaaaaaaatagtttttgagacagggttgtgctctcttgcccagactagagtgcagtggtgtgatcacagctcactgcagccttcacctcctggactcaagccatcctcccacttcagcctcctgagtagctaggactacaggcatgcaccgccatgctcggctacttttaaaaagaattttcttttctagaggtggggtcttgctatgttgcccaagctagtcttgaactcctggcctcaaatggtcctcctaccttggcctcccaaagtgctggcattgtaggtatgagccaccatgcccagctgcgtggtaatgttttgaaaggaatctttttttctgagcaataggtctcaacagtgggcttaaaatagtcagcaaaccacactgtaaacagatctgctgtcatccaggctttgtgttccatttgtagagcacaggcagagtaatttagcgtagttcttaagggccctaggatttaaaaaatggtaacccagcattggcttcagcttcaagtcatcagctccatgaggcactcacaagagagtcagcctgtcctttgaagttttgaagccaggcattgacttctcctctatagctgtgaaagtcctagatggcatcttcttccaatttaagactgtttcacctacactgaaaatttgttgtttatggtcgccaccttcattaagtatcttagctagatctcctggataacttactgcagcttctacatcagcacttgctgccccatcttgcactcctgtgttatggagatggtttctttccttgaaccttacaaaccaacctctgctagcttcacgctttttttctgcagcttcctcacctctctcagccttcattgaattgaagagagttaggacgttgctctgaattaggctttggcttaagggaatgttgtggctggtttggtcttctatctagaccactcagattttctccatagcagcaataagactgttttgcttccttattatttgtgtgttcactgaaatagcacttctaattttcctcaggaactttttttttttttgcattctataaatgttcagagttctaaacctttaaaaggtttcaaatacatgtataaacacattctagaatgtcactctgactgttgcttcctttaacttcagtctcatctgctcctgggagggagagctccatctctgacgtaactggctctgttgggctttagcgccagcctgctccactgagtggcgttttcaggaccactgcctctgggcagctcttccactctggctacggagcgtatgttgtagaaattttgatttctctccctgccaacctgggatagagtttgttcgaatttccccatgtgaggccttggggtaaccgtgcccattttgaggaggtgggggctggaagggaagaggaagtggagagagattggaaagaaagtataaagagtcccctttgctccagttcccagcaagttcctcatctccatctgagactacctcagcctggaccttattgtctatatcactatcaggcttttggtcaaagccattcaacaagtctctagaaagttccaagctttcccacattttcctgtcttcttctgaggcctccaaactgtgccagcctctgcctgttacccagttccaaagtcacttccacattttgggtaacttttcagcagcaccccactctactggtacttatttactgtattagtctgttttcatgctaccgataaagacatacccgagactgggcaaatagaggtttataatggacttacagttccatgtggctggggaagcctcacaatcatggcggaaggcgaaaggcacatctcacatgacggtagacagaagaagagagcttgggcagggaaactcccctcttaattttattttttatttatttatttatttatttattttttgagatggattctcgctctgtctcccaggctggagtgcaatggcgtgatcttggctcactgcaacctcagcttcccaggttcaagcgattctccctccctctgcctcccaagtagctgggattacaggcacatgccaccgtgcctggctaatttttgtatttttagtagagacggggtttcctcatgttggccaggttggtttcgaactcctgacctcaggcgatctgcccgccttggcctcccaaagtgctgggattataagcatgagccacagaatctggcccaactcccctctttgaaaccatcagatctcatgagacttattcactgtcacgagaacagcacaggaaagacccacccctgtaattcagtcacctcccatgacatatgggaattgtgggagttacaattcaagatgagatttgggtgaggacacagccaaaccatatcagcatgataagtatgataaaccccagtgtcacaggagaagcaaatattgatgagtcctttgcctgaatcttttataatttctgtactatgctgaacagtctgtctcaacaaggtgtcttgttgacagactgtttcctaggtgcaagtcttgtcttctgtattaaagggtaaggcctgggacttgagggctttggccttttgtccttgttttttgagacagagtctcactctgtcgcacaggctgaagtgcagtgctgcgatctcagctcactgcaacctctgccgccggggttctagcagttctcctgcctcagcctcccaagtagctaggattacaggcgcctgccgccgcgcctggctaatttttgtagttttagtagagacggggtttcaccatcttggctaggctggtcttgaactcctgacctcgtgatccacctgcctcagcctcccaaagtgctgggattacaggtgtgagccactgtgcctggctggccttttgtccttttaaagtctcttggtggcctttgcactgagcatgccctgggcgtactgactgacctgtagcttgatcacctcattctttttttttcctacagcctcgtgcaagccgaatactggcatgaccccataaaggaggatgtgtatcgcaaccacagcatcttcttggcagatataaatcaggagcgggtaagcacccaaaccgggctcccatagatgtgcgttctttttcctgtttaggtcttcataaacaaatcagcagtgactgtttacccaaactgtcctgggcagacactaggaaagagaagttctgttttttttgggaggcagggcctttgagattcagttccctttagggaggttgaaattcatttgcctttcttcccttaagttctttccctctcctagtgttgaaacacacaggataagctcggcaggttgctgactgggcgaggtggaaattcacagctgctgtcttaatgagggaagctttcctgatggatcagtctgggggtggatttttctctagagatttacctaaaagagagatacagtaggcactgagtatgtcccagacacaaacatggtttggtaggttctggtaaactagatggctcagtttatatttgactcatctggagagtcttttggttttttgttttgaaacagtttgaagggaaaaacaaaccaaacaaaaaacaacacagaatannnnnnnnnnnnnnnnnnnnttgtacctgtatgcctgctcagtggcatgtcagtcagataggatggtaagaaaagcctatagaaggccgggcgtggtggctcacgcctgtaatcccagcactttgggaggccgaggtgggcagatcacttgaggtcaggagttcgagaccagcctggccagcatagtgaaaccctgtctctactaaaaatacaaaattagctggatgtggtggcgatcacctgtaatcccagctactctggaggctgaggcaggagaatcgcttgaacctgggaggcagaggttacagtgagctgagatggtgccactgcactctggcctcggtgacagagcgagactccatctcaaaaaaaaaaaaaaaaaaaaaaaggaaaagaaaaggctgtgtaagcaatcccgtgactgggtatatacccaaaggaaaacaaattgtcctgccaaaaagacacttgcactcgtgtttattgcagcactgttcaccatagcaaagacatgaaatcaacctaggtgcccatcagcggtagactggatagagaaaatgtggtacatatacaccatggaatattacacagtcataaaaaagaatgaaatcctgttctttgcagcaacatggatgcagctggaggccgttatcctaagcaaatgaacacagaaacagaagaccaaatatcacatgttctcacttataagtgggagctaaacattgggtacacgtgaatataaagatgggaacaatagacactggagactccaaaagctgggagggagaggctagggctgaaaaacttcctgttgggcactgtgttcactatctgggtgaaaggatcaacagaaccccaaacctcagcatcacacaatatacccttataacaaaactacacatgtacccccctgaatctaaaataaaatattttgttttttagaaaaaaagaaaaaaaaaagctgtacaggtatatcctggtcaggaagctggaaaacagcccatacccatggggaagaaacacagtggcacagggtcagggagaccagaaaacaggaaggctttactccctctgctggtgtctgatggtaatgaccttaggtgttgctggcctttctttcagggtatcaatgagtcctacaagaaaaacctgatggccctgaagaagtttgtgatggtgaaattcctcaatgattccattgtggaccctgtagattcggaggtgagacactacttaggccacatgccaggagagtaaatggcattaaaatagggctgctggccgggcacggtggctcatgcctgtaatcccagcactctgggaggccaaggcgggtggatcacctgaggtcaggagttcaagaccagcctggccaacttggtgaaaccccatcgctactcaaaatacaaaaagaaattagccgggtatggtgacagccatctgtaatcccagctgcttgggaagctgaggcaggagaattacttgaacccaggaggcagagcttgcagtgagccaagatcgtgccactgcaccccagcctgggtgacagagcgagactctgtctcaaaaagaacataaaatgaaattgaaatgaaatgaaaaaatacagctgcctgctggggaaaaaaccttcagtcccttccaccaacttttgtataaaacagttcttcacctgaggtccataaatgggacactgaagattgtaatcaatcccccaaccccaaaattctatgcaaaattatgtaattacattctctggggaaggatctataattttaatccattttccagagatcagagacccaaaaaatgttcagaatcactagcccaaaatatataaattcctaagcttggcctccaaggtctgccttgatctggcttcaccccattttccagcctaatctgccttgtctgcacgcttcatacactcttgatcaagccatattgtactacttgtgctttttctctcgtatgccttggttcatatatttctgtctctagaatgcccttccttggcttctccacctaacaatttctattcgtctgtcaaggcaaggatgccatccccattccaagcagaatgtgatcgcttttttagaatcatcagcctctgttaaaacactcatcacgttatgtcacaccaccagggattggccgattgtggcccacaggcccagtccatcctgctacccgttttggtgctacccacgagtaacaccaaacactaacataaaagaatgtttttaacattttttaatggttgggggaaagaattggacatataaagattatgtaaaatttatttagacatatcaagtatttggacatataaagattatgtaaaatttaaatttcagtgtccttattggaacagttttagttactttttacatactgtctgtggctgcatttgttacagtggcagcaatgagtagttacaaccatatggcccttaaagcctaaaatattttgtatctggcctttacaaaaacgtttgctgacctctgtactcaagagtgaattgtttccgtgccttgcaagactgggagctctttggaaacagattatgtattcatccttgaatgtctagagctcagcacaggaatttttcacatttattgcttaataattttaggaagcagaaattctggggaagtggaaagcggcctctcagaaagattaactcatccctcgggctccacccttaagaagagatgactcagacgcaccctatccatttttccttcttcctacagctttatgatgttcactttgttggcagttttagcttctaaccagtctcaaattattttggcagtatgtgctgtgtgtcatatctgagcttctttcctttgcttcttctgcagtggtttggattttacagaagtggccaagccaaggaaaccattcccttacaggagacctccctgtacacacaggtaactggcagggagtctatcttgggaggttggtgttttttcagctcccagttcctgaagctgctatgttctttggtgctggagccctttcctttacacctcagagcactaggtactcctgaaacacctgactcatgtccaatatgggtgaagcttgttaggctcttgattatgtgctctagcttattaggcactgggttacaaaaatccactacatcctgaaaccttatggtttccaaacaacaagagaaacctcatgtctgattcccttcttttgataaaaaggttttaaaactagctgccttggctgaggtacagtctgctacaaatccaggaagcctccatgcatgatgaggggcattcctttttttttctttgagacggggtctcgctctgtcacccaggctggagtgcagtggagcaatcttggctcactgcaacccctgcctcccagattcaagcaattctcctgcctcagcccccttagtagctgggattacaggtgtgtgccatcacacctggctaatttttgtatttttaggagagatggagtttcaccatgttggccaggctggtcttgaactcctgacctcaggtgatccacccacctcagcctcccaaagtgctgggattacaggcgtgagccagtgcgcctggccaagggacattacttttaaacattaatagatgtgaaatcctgtttctaaattacgcactgacaagggaggctcctgcaggaggttgagtgggactagagttttgaattttgtttagcagtaggtcctgtatcttaagcagaagttgcagtaatttgccacctccagttctggggccttctacactttaaggatttttttttttttttttttttttttttttgagacagtcttgctttgtcacccaggctggagtgcaatggtgtgatctcagctcactgcagcctccacctcctgggttcaagcgattatcctgcctcagcctcactagtagctgggattacaggcacacgccaccatgcctaatactttgttttgttagtagagacggggtttcaccatgttggccaggctggtcttcaactcctgacctcaggtgatccacctgcctcagccttcaagagtgctgggattacaggtgtgagccaccacgcccagccctaaggattttatattggagacagactctccaaaatgctaagtactacatctgaaccaatcaccgtctactagaattcctccatgttatttcagaggtcatttgtctcctcttggcttggcttttcttttgcactgggtgcctcaacttgggtggtgaggtaaaaagggaagctagaatctgatttgagaaaaaaaaaaaaaaaaggcttcagaaattacagctaagaacttccttactgtgaaaactcaaaatgatgttggccacggcagaagcaccattctggcactgtcgtaactgcttatcttcccaaccagaggttgttctccagcatctaggctatgggtaatgacattttcaactccagaatatgaaagtgtccagggtttgttacctaacggttggatatggtttttctgttttgttcttttgagacagttttgctcattgcccaggctggagtgcaatggcatgatctcagctcactgcaacctccgcctcccgggttcaagcgaattctcctgtctcagcctcccaagtagctaggattacaggtgcccgccaccatgcccagctaatttttgtatttttagtagagacaaagtgtcatcatattggtcaggctggtcttgaactcctgaccacaggtgatccgcctgccttggccatccaaagtgctgggattataggcgtgagccaccgcgcctgtcctgggttggatgttttttaagttacctagctaatgttctgtctttggctcagtcccacttacctatggcattctgaggcagtgtcgtctatggcttgcccacctataggtagtcctctgactctgagcttttcaaa

SEQ ID NO: 14759 - DNA, 31618 bp, Human
cccccttgtccgccctttctctgcaggccaccaccgttccccctaccctatcccagccagcagctggtctttcctaattggtaatctgtcttaatagccacaggtcctcaggcagctgtcgccgggaatacgagctggcagcatagatccacgtcactaacttaactggctggtcctattagagcttaagaaagaattaagttaataatgatactaatgagacagaacgttgcataggagaaaataagagaaagaaggagaggagtagaaggaggagaagggagaagagggcaaggggggaggggaattattgctattaattattattattattaattattcctggcacaggttttgcaatcacaacccaaggttgtgataaaatcttgctcaaaattcaaaaaggatttcaacttttcactctcagtcttattcacttttccatatgatgagatttctaagtaagccacccgacttcagtccttggtgcccaatagctaggggctcacgccgcgttcagggtgtgatgagcgcctgagaacggaggtggctgcccccgcaactcctcctggagtgaggccatcccatcccatcaggggagggagcaccggccccaagttcagagaaaggcatcccaagctcctgacattctgcggtcggaaaatggtgatggatcctgctcatttctaattatacctttcccttggcaacgacaaagatacgtgtggaagaagctggttctcggcttgggggggccactcatcctcttgccaaatatagagaaggaatgagccgcgggggttaccaatggcctataaaagccccggggagcagccagccctctgtggctcgcttgtgggcggaggtaagtcacaggctcctcttctaggtctcagctgcttggagcacacccacccggtgagcacatccacaccccgtgcgtggttccctggccctgcctggctctgctgaggtggcgcctcatgcctttctgagttttcttaggataagcaaggtgtagagagcgaggttccctgggcccaaacacccagcaccctctggctccagcacctcccccaagcaggagccctgcaggttctctctcctccacacactctcccctgtcctcctctccaagtgtcctcttgggcaggatccttttggatgccccgtgagcccagctgccatggcttgaccttctcccattgcctctgtgacccatgaagggtcaacaggactgggggcctcactctgccctcaccttccccacctgggctgtacatctgccaggtgtcttgtcctctcaagaccacactggctgtgggcattgcgtgtaaattaatctcagagatattgcctgttcacagacaaggagacctgcccctgccctcgaactgttgactttaagcagggatgcggtccctgctgtccgattctaaatgggagtgaggaagactgaagaaggtgccagtgcaggctgagagaaaccagatttctgcacagctgagggtttttcctccctgcctggcttcctgtgggtcacgtcccatctgctcttccatcttccagcctgcctctttaaagtattagtctttttttttttttttttttttgagacagaattttgctcttgtcgcccaggctggagtgcaatggcacaatctcggctcactgcaacctctgtctcccaggttcaaatgattctcctgcctaagcctccagagtagctgggatcacaggcatctgccgccacgcccagcaattttttaaatttattttttatttttagtagagaaggggtttcactatgttggccagactggtctcaaactcctgacctcaggccatctttccgcctcggcttcccaaagtgctgggattacaggcgtgagccatggcgcctggcccctttatcctttttagttaactcgtcagaagccgattctacatggacgcagccaccccaagtgccgctaagttgtgtatgtgcatattcttccaggtctgggatctcctggctgttgctgtcttctgctctcatcctgcaggtgggactctcaggtgagaagttgggccctgtccctcggctgttggagatctccaggcaatccaagcttgccagttcctttctccctcctcccaccggccataagggcacagagggacaggggaactagcacatttagacaaggacaggtcgtggccgggtgcaatggctcacacctgtaatcccagcactttgagaggccgaggtgggcagatcatgaggtcaggagttcaagaccagcctgaccaacatggtgaaaccccgtctctactaaaaatagaaaaattagcaggacgtggtggcaagtgcctgtaatcccagctactcaagagactgaggcaggagtatcgcttgaacctgggaggcagaagttgcagttagtggagatcgtgccactgcactccagtctgtgacagagtgagactccatctcaaaaaaaaaaggcaaggacaggtcaggcgggagaggaggtggcatttgggggactgtcaaacagatgctgatgtcagatgcttgattttgttcttagcaacccaaggaagcaaaaggcaggttcccgcatacgagcgtgtagccaccttgattgaaatggttcaaaaatatctttgctgtttgccattagcacactctctttgaagatggcgtttattttttaagggtgtttatttttaaacgttccctcagcaacacctggttgtcacagaagcggaaaaggcggtcccaagagtggtgctcacttccaaaccccttatcgccagttcaagcctcagatgcttgaggagcttgggttaaataggctgtaagactgtcgcacaagaagcccctcaataaatatgcacccgtgtgatttcccagcactgaagccctttgggtggagcttctcaaggcatgaggacagcctggttcctggggccctgactctgagggctcctgcggctgaaggagggcagggtggaggctgaaacaggcctggagctgctgggtgcctggcaagggggctgctgagctcaccgggtgggtttgccttccagctgacaccatgagtagtgacactgaaatggaagtgttcggcatagctgctcctttcctccggaagtcagaaaaggagaggatcgaggctcagaaccagccctttgatgccaagacgtattgcttcgtggtggactcaaaggaagaatatgccaaggggaaaatcaagagttctcaggatgggaaggtcactgtggaaactgaggacaacagggtaaggctctgtaccctccacaggctgctggccctccacctggtccttgtgcttgcctggggtatgcatctgcccaaccccagccacttccagatgtggttccagcactggaatgccgcatacaatgtagcctggggcttcccaggtatcctcagagaaagcagagtgaatactggcctcaggttccagggtgggaatagagtctggctgtggctgattaaaacaattagttttcaggtatttttgtccacgttcactgtaggccagaggggcccagctccacgtgtcccaagggtgtggagttgggagttcaacatgaatgagcgctgtttcagaacactctcctttggtagcctagatttgtcccaaattattctatcaatggccatctaaccaaggaagtaaggaaaatgtgttagggatcctaggggaccacaagctcagtgaaatagcagcctccttgtatcatgaaggggatgagcactgcagcccattacattctggcccaagccactgtgggggtgctgcgaggaattctggagctcactagtttctaaaatccacatcaggagaatctggaaaagtcccaagaaaagtaaaaagcaaaaaaaggaaaaaagaaagaaagagtgaaagagagatggagggaaggaaggaaggaaagaaagaaggaagaaagaaagcaaggaaggaaggaaagaaagaaagagaaagaaagaaagaaaataaaagagacaagtaaaggaaatactatcattgggttgggcatgaaggaaaaaaggcattaaaaaccgccctgcacgtgaacccgggaggtggagcttgcagtgagcctagatcacgccactgcactccagcctgggagacagagcaagactcggtccccccaaaaaataagaaccgccctgcagtgctaccaagcattggagctccgaaaaggtggctctctgtgtatttccaataaggagctaagaatgggctgctaacacgtcagggaaggaggaagctagatacagtgaatgataatctaagatgaacctaagagaccatcatagacagccagggcccattggccgggatggtttgaatgaatccctgcttgaaggcagggaaaaggcaggtttcccatccacactgcccagagacagaaccaggaaaactgaccatttcagaggaggtcacagagaaaaaggaggtgaggacagggcaggggagaggaagacaagttccccaccccctgtgcctgaggtcctccagcttcccgagggtgtgggggtttgtcctgctgagagaagtgcaggtgctcagaaccactgctctgcctcatggtgccgtttgcctggcttataacactctgaccccagaaagggcaggaaaggggtggggagggcaactgaggggccctttcctgagcatgctggggctgggtggtgaagggggaagaggtgggccgggggctggacagctgctttcagagagctcagaatgttggcaatccatgggcaccagcctggcaatccaatgccccttcctcattctcttcggtccctgcctcacgactgcaggggacatatgcgtcattttctctcagtagacaggaaagagccagctgctggagctggattttggtccaggcagtgttactgactgagctgaaaggttcctgctggccccgttcccagccaccatcacccatatccacccacacagatcctcttttctcatttccgacatccgtctctcacctcaggcccaatggggaggaagaagacaccctgaataacagaaacaaaccccatttcatcagcaccaccacaagccgccccatagcctttcctcctctcgctgtgagctgggcttgttctagggtttggcccttccatctcggctcaagagtctcttggtcttttggtgggggcagcagacaagacgtgcagacaggccaggcacggtgcctcacacctgtaatcccagcactttgggaggctgaggcgggtggatcacgaggtcaggagatcgagaccatcctggctaacacggtgaaaccccgtctctactaaaaataaaaaaaattagccgggtgtggtggcgggcgcctgtaatcccagctacttgggaggctgaggcagaagaatggtgtgaacccgggaggtggagcttgcagtgagccgagatcgcatcactgcactccagcctgggcgacaaagcaagactccgtctcaaaaaaaaaaaaaaaaaaaaaaaaaaaaaagacgtgcagaccatcttagtgaagcactgtgcctcttcctttttagaccctggtggtcaaaccagaggatgtgtacgccatgaacccccccaagttcgacaggatcgaagacatggccatgctgacgcacctgaatgagccagccgtgctgtacaacctgaaggaccgttacacatcttggatgatctatgtcagcgagggctttcgacgtggtttccctggggcattagatatgcgggcaggggagggaggcagaggtatgtgtgtgggccgtgggattctggaagatgagtgcttgcctagctgatgaacaaaacacaaagacggaggagaaagaaggcaagaaagcaagaggtggatggggcaggaagaaggaaggtgggaaggaggaccaggagccggagagcggggaagctggggccaggcttggtcacggggtgctgtgacttaccaactgtgggagggtcgccactcccctttttgagtctcagtgcctcactataaataggaatggtagcctcccccctttataagtttatcccaaagaaacatgagataataataaaggcagctgggtgtggtggctcacgcccgtaatcccagcactttgggagggtaaggcgggtggatcatgaggtcaagagatcgagaccattctggccaacatggtgaagccccatctctactaaaatacaaaaattagccgggcgtgatggcatgtacctgtagtcccagctactcgggaggctgaggcaggagaattgcttgaacccgggaggtggaggttgcagtgagccaagatcgtgccactgcactccagcctggtgacagagtgagactccgtctcaaaaaaaaaaaaaaacaataataataataaaggcaaggggttttccatatgcacatacatacatatacgcacgtatatgtttttcctcccacagacctactcaggcctcttctgtgtcactgtcaacccctacaagtggctgccggtgtacaaccccgaggtggtggaaggctaccgaggcaaaaagcgccaggaggccccaccccacatcttctccatctctgacaacgcctatcagttcatgctgactggtgagtttcccaggaggaagcatgggatgctggagcaggcactgcatgaggcgagcggcagttgccccttactcccaggctggaccccatctggtgtttagcacagggaaaggaggaagaaggagccaaaagaggcagaaaggggctgcatcatgtagggccccgcatgccaaggtgacgagttttggatttaatgcaagttagaatatgcaaaacggatatggatgttttcatggatcaaaaccaaaaactgatcattttatatagttcagcctaatacagcaagaacgatgagaagccactggctggttttttttttttttttttgagatggagtcttgctatgttgcccaggctggagtgcagtggtgtgatctcggctcaccacaacctctgcctcccgggttcaagcgattctcctgcctcagcctcccgagtagctgcgactacaggtatgcaccaccatgtccggctatttttatatttttaatagagacaggggtcactttgttggccaggctggtctcaaactcctgacctcgtgatctgcctgccacagcctcccaaagtgctgggattacaggcatgagccactgcacccggctgccactggctgattctgagtggagacttgccctctctgagtctcagtctcaagaaggaggctttcgatattgaccaaaggatacagctggaaaggagaaatcggtgctggtgatctgtcccatagaatggtgactccgataagtaataatgcattgtatatttcaaaatccctaaaatagtatattttaaatgttttctccacaaaaaaataagtatgtgaggtgacggatttgttaattagcttgatttaatcattctgccatataaacatatatcaaatcatcatgttgtaccctacaaatatatacaaatattgtttgtcaattaaaaataaaataaaataaaaagcagatggaggctcttcagattcccacctaaaggctaaacaaaaaatgtaaaggaagaggaattgtgcaatttaactctggctacttgagagttgggtagaatcgggaagctctttttctattgccatcaactctattttattttttcctctggcagatcgtgaaaaccagtccattctgatcacgtaagtatccatggcatagagtggtttcatagctgtgccactggctctattctgttcattagaaagtgtttggagcagagtctataataaaaagatcaggctgggcgcggtggctgacacctgtaatcccagcactttggtaggctgagatgggcggatcacgaggtccaggagatcgagaccatcctggctaacacggtgaaaccctgcctctactaaaaaaaatacaaaaaaattagctgggtgtggtggcgggcacctgtagtcacagctactcaggaggctgaggcaggagaatggcgtgaacccaggagccggagcttgcagtgagccgagatcgcgccactgcactccagcctgggcagcagagtgagattctgtctcaaaaaataaaaaataaaagagaaaaataaataaataaaaaataaaaagatcgatttggggatggggaggaaggtctgcataaggcctcagaaaaatggaattacccatccttgggtcagctgagcaagtgcctgtggcacctgtgccctgggcgtctgccttctcaagtggtctgtcacattagtgtggtgagtgtgtgtcagagatggctcagaccatgcccaggcctcagtatgacatcctgaaaagcctgtttataccaacagacttgtttctttctctctcttttgatcactctgtacagcggagaatccggggcaggaaagactgtgaacaccaaacgggtcatccagtactttgcaacaattgcagctactggggacctggccaagaagaaggactccaaaatgaaggtatagatgggagaggaaggcttgctttgcttccacttttaactgtggtcttaacctcagaatgagggggccaaatgtcctcacattcccccctcttcagagaatggagaacaggctaggatttactatcttgaaggacagccagtcaccttagacaacgcagtgtcaagttggtcttgtaggactagatcccgggatttcttagaagacaaggctctagggctaaacttcagaggtcaatctgcagacggctcagagagcttgttcttttgtggaagaatcacatataccaatgtgagtgactcacagcatatcctgggcttttgaaacaaatgtattacagcagcatgaaatgaatacggacaactgactggagaatcaagggattgaagtgttaaaggaatgctcagtcaagagatccccaactgtagtgccaaatataacaaaatggcaaaagtgttttgagtaagacatgctgctgatttggttggtcctaggattggaaagtcaaggagggtggggctttatcagggcaagccagagtcacagagtgggtgagcattttttactgtcattctgtggcttaaaaacatgtttcctcaggctgggctcggtggctcacgcctgtaatcccagcactttgggaggccgaggcgggtggatcacctgaggttaggagttcgagaccaacctgaccaatatggagaaaccccatctctactaaaaatacaaaattagccgggcatggtagtgcatgcctgtagtcccaggtactcgggaggctgaggcaggagaatcacatgaacccgggaggtggaggttgcagtaagccaagatcgtgccattgcactgcagcctgggcaacaagagtgtaactccatctcaaaaaaaaatgtttcctcttcttccctcaatttcttgcattaggggactctggaagatcaaatcatcagtgccaatcccctgctggaggcctttgggaacgccaagactgtgaggaatgacaactcctcccgttttgtgagtctgagtttggttaagatggaatttgctttgtgcctcacaaaataggcaagagccctgtcctcaaagagtgtagagaccagaggcaacagatgatgaaaaacaaaacaacccaacaagaccatttcagataaagataaattcagaccaagttcaatgaacagcgtgtgtaagagaggaactgggggccaggcttgctttaggcagggtgggcagggaagacctctctgtggggctggcacgggagctgagagccgcagtatgagaaagagcccaacttgaaatgacaggaaggagggggaacgaaggaagggccagggcagtccctgacatgggggagggcctggtgcagtcagggcacctacagagggtctgtgtggttgtagggaggagggcaggggggccagttccatgagatgaggtggaagagagagagacctggtcatgtgggagccacaggccatgagaaggagtttggattccttttgaagtgtaacaggaagctactgagggattctataagccagggagtgatatggtttgatttacaccttgaaacaatcactgtagttgctttgttgactagatacgttgaagtgggggatgagcatagaataaaagggataaataaaaggaaataaggaaaaccccaaactggaagaagaagaagggagaagaggaaggacatatctaatttcaaactgtagggggtgctgggcacggtggctcacgcctgtaatcccagcactttgggaggccgaggcgggcggatcacgaggtcaagagatcgagaccatcctggccaacatggtgaaaccccgtctctattaaaaatacagaaattagccaggtgtggtggcacgtgattgtagtcccagctactcaggaggctgaggcaggagaatcacttgaacccgggaggcagaggttgcagtgagccgagatcacgccactgcactccagcctggtgacagagcgagactccgtctcaaaaacataacaaaacaaaacaaaacaaaacaaaaattttagggggactaggctcctactcaaattacccataagatgaataggaactattgggccatggtagaatctggtctccccctgaatcccgccccatacagggcaagttcatccgaatccattttggaaccactgggaagctggcctctgcagatattgaaacttgtaagtagatccatggggattcgatggcgtctcagagttaactgggaacagtttgaaagagagtcctgtgtttgtgttccagatcttctggaaaaatcaagagtcactttccagctgaaggctgaaagaagctaccacatcttctaccagattctttctaacaagaagcctgagctcataggtgaggaagtcaccagtggggctggtcttttaggtagtttgactctgatcactagaccaaggagagttgtatctacgtagagtgactctacagtcaacagggaaagtttattttattttatttatttattttgagatagggtctcactctgatgcccaggctggggtgcagtggcacaagcacagctcacttgtagtcttgacctttctgggttcaagtaatcctccagccccagcctcccgagtggctgcgactacaggtgcatgcccccacaccaggctaccttttgtgttttttgtagagatgaggtttcaccatgttgcccaggttggtcttgaactcctgggctcaagcaatttgcccgactcggcctcccacagtgctgggattataggtgtgagccactgcactttgccaggaaaagcttattttagaaatgggatgtggctatctgggcagtgacatgccaatttgaaaacctaatcaaatggagggcaacaagattagaccactcctgaccagctctggtttataaaaaccttctgagcaactgaacacctaactgtcctttggcgcccccttgtgttctggcacagaaacaacctatggccaaatgcgacgccaaagcaaacagaataatcaagcccacggaggcactgcacactgccccttgtctgcccctcacagaggtctccatgcacactgcttctttgctctttggctgtatttgctcagccttctggtctccagcttggaaacaggctgctgcttttcaacagattttagaaaaggctatgattataccaaaccacctgggttggctctcgtcctgacccgcactcagccagttttccctattaacttctcccagccgacactgatatgcaccattagcgtgcaaggcaagggaatttaaaggttctctctagggtccttcatctccattttgtgggagactgaaaagtcttccctggactatattttccatgacagcctgagtattgtggaactgtctaaaagatttttaattctaagttcaatttaggatccagcggtaaaagttccagcccagggtgcaggagctcaagtccactgggtgggttttttctttgcatctgcataacctcctggaactatttgtcatttcagagctgctgcttattacgaccaacccttacgactacccgttcattagccagggggagatcctggtggccagcatagatgatgcagaggagctgctggctacagacgtaagtggaaccaacagaaggggtgggtgttcctcctccatcactggggccaactgactgacgtgctgccctttccatgccagagcgccattgacatcctgggcttcaccccagaagagaaatctgggctctacaagctgacgggagccgtgatgcactacgggaacatgaagttcaagcagaagcagcgagaggagcaggccgagccggatggcacagaaggtacaaaatcagtgtgacagcaaaccagagcgggtggctgatctgctgaggtcacttggtactgcttttgaaagcaattaatccagccaggcacagtggctcacacctgtaatcccagcactttgggaggctgagggggccagatcacctgaggtcaggagttcgagaccagcatggccaacatggtgaaaccccatctctactaaaaaaaattagctgggcatggtggagcatgcctataatcccagctactcaggaggctgaggcacgagagtcagacagagttttgctctgtcatccaggctagagtgcagtggcatgatctcagctcactgcaacctctgctgcctgggttcaagtgattctcctgcctcagcctcccgagtagctgggattacaggcacacaccaccgcgcctggctaacttttttgtatttttagtagaaacggggtttcaccatgttggccaggctcaaactcctgacctcaaatgattcgcctgccttggcatcccaaagtgctgtgattacgggtgtgagccactgtgccctgccggcatgagagtttcttgaacccaggaggcagaggttgcagtgcactgagatcgtgccactgcactccagcctgggcaacacagtaagactgtctcaaaaaaaaaaaaatggatggaagcgattaatccttccatctggagaagtgaatgaccctttctgggcctccgatgcccatagctattgttaccactcgcttttcctgaatcactcgaatagtcttgtttcagatgcagtgagggatgaccagggctttctgagacccagccctggcttttcataaagtccgttatattctctgagtgacttagcttccattggccatgtatatgcagtttagccacagggaatgcacaatgtaccaagatgaacttaaccaacctttgaaacttctggatgattttcaaagcagctcttctacttttctaagcactgtccttgttttcttgccagtggctgacaaaacagcctatctgatgggcctgaactcttcggacctcctaaaagctttgtgctttcctagagtgaaagttgggaatgagtacgttaccaaaggtcaaactgtggatcaggtaacagcttcaaggccgggaaagggtgcaggaccctgctggccacttccttcatatccagtagctgatctttcccctgataggttcaccatgctgtgaatgctctttcaaaatcagtttatgaaaagttgttcttgtggatggtcactcgcattaaccagcaactggatacgaagcttccaagacaacacttcattggtgttttggacattgcaggctttgaaatctttgaggtttgtgttacttatattcatattttcatatggcttcatatgagggaaattggtttcatgatcctaaagggaagatagcaagatggcggctgtcttagtttcctgtaagaaactagatggagagtggatggaatagaggagcggtacttattggaagggtttgtattagggttttttgtttgttttttttttttgagactgagtttcaccctgtcactcaggccagaatgcagtggcgccatctcggctcactgcaacctcttcctgagttcaagtgaacctcctgcctcagcctcctgaatagctgggattacaggcgtgtgccaccatgcctggctaatttttgtatttttagtagagatggggtttcaccatgttggctaggctggtctcgaactcctgacctcaagtgatccatccgcctcggcctccgaaagtgttgggattacaggcatgagccaccgcacctggctgggtttgtattattttaaaagaggagaagatgtctatcaagtggaattttaaaggacattttcaaatggataaaagaaaaaaaattaaatgcaatcactgatttagggactgccatcaaatagatacagagaatttgataagttaatcacgcactattttctataaatatcccactggttctgtgttagaccgtgcatagccgcggctgggcatggtgcctcatgcctgtaatcccagcactttgggaggctgaggcaggcagatcgcaaggtcaagagatcaagaccatcctggccaacatggtgaaaccccgtctctactaaaaatacaaaaattagatgggtgtggtggcgtgcgcctgtagttccagccactctggaggctgaggcaggagaatcatttgaacctgggaggcggaggttgcagtgagccgagatggtgccattgcactccagcctggtgacagagcaagactccgtctcaaaaaaaaaagaaaaaaaaaagtgcatagccactcatcaaagtgtatatttaggtttcccaggtacaagacatacaggtgaaaaaaacagatgagcttgtagtctagtagagaagaaatagaagtctatatggcacattgaagagtaactacaaaataaagtacacaagagatgcccagaccttgggaactcaggaaagggagaaacaccttctaattggaagtttacagaagacgccaaggaggagatgcggtctgaggcaggccttgaagattgtgattgtatttgaaagcattaatgtgtttgacaggaacctggggcaatgaggaggaatgttgacagtctttgattctgaaagaagtctaacttttcacatgaatgttgtatttttttattagtataacagcctggagcagctgtgcatcaacttcaccaatgagaaactgcaacagtttttcaaccaccacatgttcgtgctggagcaggaggagtacaagaaggaaggcatcgagtggacgttcattgacttcgggatggacctggctgcctgcatcgagctcatcgagaaggtatccagttccatccccaccgtaagctcttctcatagactcttctgctcattactgcagctcatatttacctctctgcactttgccttgccttcaatccagcctatgggcatcttctccatcctggaagaggagtgcatgttccccaaggcaacagacacctccttcaagaacaagctgtatgaccagcatcttggaaagtccaacaacttccagaagcccaaggtggtcaaaggcagggccgaggctcacttctcactgatccactatgcgggcaccgtggactacagtgtctcaggttggctggagaagaacaaggaccctctgaacgagactgtggttgggctgtaccagaagtcttccaacaggctcctggcacacctctatgccacgtttgccacggcggatggtaagaggagtgctttgtgtccatgtgatttccctccatttgttccacagtaacaaaaaaccttttagattcacctacagcacgtgccctcccttattgctttcagctgacagtggaaagaagaaagttgccaagaagaagggttcttccttccaaactgtctctgcccttttcagggtaagaaaaatacaagtttatttgcttataattgatttaagtgacatctaaatgagcaatgctgagattctaagcttgatttatttgagagtagtagtgttgtcttaatctgattactgtcactgaggtgaagtgacagatgataaaatataataaatacggtctaaccaatgtgcgatgagagtatcactattatcttataccaaagatagctgagttggcttgtccgagtttccagcataaactctccaattttcctaaaggacaccagcaatagacctcacgctcccagtggatccatcacctgagttgattttagaaagcattttgtacttggcgagcctctggctcactgggagacaaaagacaattgtatcagttactagcctacacctccagccataggaccattgaaagcctgagttaggccgggcacagtggctcactcctgtaatcccagcactttgggaggccgaggtgggcagatcacaaggtcagaagatcgagaccatcctggctaacacagtaaaaccccgtctccattaaacatatgaaaaattagccaggtgtggtggcatatgcctgtagtcccagctactcaggaggctgaggcaggagaattgcttgaacctaggaggaggaggttgcagtgagccaagattgagccactgcattccagcatgggtgacagagcgagactccgtctcaaaaaaaaaaaaaaaaaaaaaaaagacagagttaaatcatttcactatactttagaacttatgataaattttaaacatagatcttatttcattacaatggatctctgtcttcataaaaacctacagtaggatggcaaatgtcattttttttttctcttaggaaaacctgaacaagctgatgtcaaatttaagaactactcaccctcattttgtgcgttgtataattcccaatgaaaccaaaactccaggtgagacacctgctggctcgctaggtggtgctcagtttttaagaaattctgtgtaaggctgatatctcgcttctgttcccaggggctatggaacacagccttgttctgcaccagctgcggtgtaacggtgtcctggagggcatccgcatctgcaggaaagggttcccaaacaggattctctatggcgattttaaacaaaggtgtgtaataaacatgttctatatgcttggggatgagatgtacgaacactggaatttgagagggagaaagattcgtatgaaaagacctatttcgaaagaacagatatggacctccatgtaaactgaacaatctaccatttggccaagttatatatatttgtttcttccatgtttttctctggaatttatctgatatacaaaatggcaggaaaagctctgactgaagagtcaagagatctagattctagactgctctctagcaatgtgactccgagctagttccctcatctcctgggaccttggccttctgcctataggaagagaggcctgaactacatgttctccaaggtttgtgtctttgccaacagtctgtgatgatttccatgtctacaatgcagataccgagtgctgaatgccagtgcaatccctgagggacaattcattgacagcaagaaagcctgtgaaaagcttctggcatccattgatattgaccacactcagtacaaatttggacataccaaggtaatgcatcagttctgacagatgctggccttttcgtcctcttgacacagcttctctaggaaactgactcatgtcacccttctgccccataaggtgttcttcaaggctggcttgctgggaaccctggaagagatgcgggatgaccgcctggccaaactaatcacccggacacaagctgtgtgcagagggttcctcatgcgtgtggaattccagaagatggtgcagaggaggtccagcagggtctttgttcagacatgagctctttggggaaggggagtctctctcagaaataagcaatgtcttgtttttagggagtccatcttctgcatccagtacaacattcgctcattcatgaacgtcaagcactggccctggatgaaactcttcttcaagatcaagcccctcctcaagagtgcagagactgagaaagagatggccaccatgaaggaagaattccagaaaaccaaagatgaactcgccaagtcggaggcaaaaaggaaggagctagaggaaaaactggtgactctggtccaagagaagaatgacctgcagctccaagtacaagctgtacgtgtttagcaatcttttttttttttttaactcttctagatttgattatttatttagaaaaattgagttattggtggggatttttgctttttagttgaaatgcttcataaagaacttcatatatagtgaaatactggaatgtcgcaaaccttatatcattcaacgaagttattattcttttttttttaaggaaagcgaaaatttgttggatgctgaggaaagatgcgatcagctgatcaaagccaaattccagctcgaggccaagatcaaggaggtgacagagagagctgaagatgaggaggagatcaatgctgagctgacggccaagaagaggaaactggaggatgaatgctcagagctcaagaaagacattgatgaccttgagttgaccctggccaaggttgagaaggagaagcatgccacagagaacaaggtattcttattgtaggtgtgtctagcttgatatagtcattgcaaactaaactttaagcttataattgcttgcgaattcttcttaggttaaaaaccttactgaggaactctctgggttagatgaaacaattgcaaagttaaccagagagaagaaggccctccaagaggcgcaccagcaggccttggatgacctccaagctgaagaagacaaagtcaattctttgaacaaaaccaagagcaaactggaacagcaagtggaagacgtaagtaaataatgctcatcgggagtcccagaactccagggttggaagagccctcaagggtcctcttgcaaagcatttgttcccaaaaggaaatggtgcctttttcagctggaaagctccctagaacaagaaaagaagctccgagtagacctggaaaggaacaaaaggaaattggaaggagacttgaagcttgctcaagagtccatattagatctggagaatgacaagcaacagctggacgaaaggctcaagaagtatgcccttcaaccactggcttccattttgcaagttactgtgtattttgtcttcatgcattctacatttctcttcacaggaaagattttgaatattgtcaacttcaaagcaaagtggaagatgagcagacactgggcctccagtttcagaagaaaatcaaagagttgcaggtaggagccctctgcatttctctcttccatgtgaggccacttacagtgagctgggtgctgtctgctataagccatttagagaaagtgggcaagactgtggggccacctgcctcatggttccctttctgctaggctggcctggccatgatgaaccatttccccaaaacatctgattaaatactttaatccataattaaagtatttaagttaacaactaaaagttaacatttagttggtggaaaatgttcaggtttggtcactgcaggagtaattaccatgttggggcagaaaaaattcctgtgaaaggaaatttgcagtattcattggaggggagtctaagactcagtttgtctaatgggaagggaaaccagcctgttcttggcaatcagagtccccgcggtgaacccactgcccacggggtgaacggctgccctccacaggctcgaattgaggagctggaagaggagatagaggcggagagggccacccgcgcgaagacagagaaacagcgcagcgactatgcccgggagctggaggagctgagcgagcggctggaggaggcgggaggcgtcacctccacgcagatagagctcaacaagaagcgggaggcggagttcctgaagctgcgcagggacctggaggaggccacactgcagcacgaagccatggtggccacgctgaggaagaagcatgcggatagtgtggccgagcttggggagcagattgacaacctgcagcgggtcaagcagaagctggagaaggagaagagcgagttcaagctggagatcgatgacctctccagcagcatggagagtgtgtcgaaatctaaggtgctgcgcggggtgggggtggctcaaggctttccatcagacacactccgtggtcattgaaacctgactttgctgactgactttgctcccctttctgaatccttcaggcaaatctggaaaaaatctgccgaaccctggaggatcagttaagtgaggccaggggcaagaatgaggaaattcagaggagcctgagcgagctgaccacacagaagtctcgtttgcagaccgaggctggtaagccacgtgcagaaaacccgtggggccaaaacctcctggcacccaatgggcgtagctggccaaaaccaagggcagggtgtgtttgagggagaatctctagggaagcatcttttcaggagagaagaaattgaaataactcatagaaagagccatttgaaatagcctgaagggagagaacattgagagttcagtaagaataagagagaaagaggagtagaccagaatgagaaggggctcaaaatatcatctcattcaaactctttcaaaattaatataaacttgcatcagacagactctgatgggcagaaatgagactagaaactaagagccagggccttgatacttcttaactcagatattcattgtctgcgtccaagtttttgagactaaagagagaaacatggccagtgtttaaaggtcctggtgtataataaaaacataagggaggccgggtgtggtagctcatgcctgtcaacccagcactttgggaggccgaggcgggcggatcacctgaggtcaggagttcaagaccagcctggccgacatggtgaaaccccgtctctattaaaaatacaaaaattagcgaggcatggtggtgggtgcctgtaatcccagctacttgggaggctgaggcaggagaatcgcttgaacccaggaggcggaggttgcagtgagccgagattatgccattgcactccagcctgggcaacaagaatgaaactctgtctcaaaaaaaaaaaaagtttaagggaatgttatttggagttttcgcctagaaaatgtggcttcacccagccctggtgcatcctcacaggtgaatccatcctcggctggcagtcacagccaagacaatgaagaaaagaagtttggtagccacatttttttttttttagacagagtctcactctctgtcacccaggctggagtgcaattgtgtgatctcggctcactgcaaactccgcctcccgggttcaagcgattctcttgcctcagcctcctgagtagctgggactacagacgcatgccaacacacacggctaatttttgtatttttagtagagacagggtttcactgtgttggccaggctggtcttgaactcctgacctcgtgatccgcctgcgtcggcctcccaaagtgctgggattacaggcgtgagccaccgcacccggcctatggtggccacttttaccatgttgggggattcacgtctggagccataaagccccattctatgtttttctcttacctctatgtaagcatataaacttgaacttaccctattcccccaagagtctaactagagatataaagctctaagtatttccctatgtatttgtcgataacaaatcaataaacagctggaaacacctgccactggggaggtctgatgggagttattaggtgctcctggtaacgtttacatttacagttcttctcaatggattttttttttgacagacatcagtcccaccttccagtagtttacaacaatatctttttttttttttttttttttgagattgaggcatgatcttggctcactgcaacctccacctcctgggttccagtgattctcctgcctcagcctcccaagtagctgggactacaggtgcccatgaccacgcccggctaatttttgtttttagtagagatggggtttcaccatattggccaggctggtctcaaactcctgaccttgtgatctgcctgcctcagcctcccaaagtgctgggattacaggcgtgagccactgcacctggcctacaacaataccttatcagttctgctttcagtttccttttcatgaaccatataccttctccctgaagaagaaaccatatcttatcattttctgtctccccagatcttagcacagtgccctacacataatagaaagttggtgagtgaatgagtgaataaatgaaatgaaactatttccttctggacacaggtgagctgagtcgtcagctggaagaaaaagaaagcatagtatcccaactttccaggagcaagcaagcctttacccagcaaacagaagagctcaagaggcagctggaggaagagaacaaggtacaccattgaaggaagacttctttgcccttatttttaaatatcacctgtaggaggaaaaaataaaaggcaacttcattcagaaggtggtgatagaagggacacacttggattgtatcatgcacctggcactaaatatatcaggtgctcttctctttttaacttctgcaggccaagaacgccctggcgcacgccctgcagtcctcccgccacgactgtgacctgctgcgggaacagtatgaggaggagcaggaaggcaaagctgagctgcagagggcgctgtccaaggccaatagtgaggttgcccagtggagaaccaaatacgagacggacgccatccagcgcacagaagagctggaggaggccaagtgcgcagctctgtttgcttttagaagaactacttaggaatgaattcgatgaatttatttttattactaggcgtttccccatctcatgtgtctttaaatgcggtgctgggccattagagggacctggcgttagcacattttattaaaacaaacagctttgatcttggtcagacacaaggcaagttattgatcccagattttgagtagacaggaaattctcctgggcgtataaaaacacatgggtgtctgaatcacatagattagtgattccaacttgatgaatagtgatgttcaagtggatggaaactgaaataacagctgcttctctttcatattctttaaggaaaaaacttgctcagcgccttcaagattccgaggaacaggttgaggcagtgaatgctaaatgtgcttcactggagaagaccaagcagaggctgcaaggagaggtggaggatctgatggttgatgttgaaagagccaattccttggccgccgctctggacaagaagcagaggaactttgacaaggtgtggggtccgctgtgtgctgggtgaatgccatgatgtaagggattcctagcagccgtggaaggaggagaatgcatcccggacctgactctgccctcaccagcagtgtggccttgggcaagtccctgaacttcaccgggctgtagtttcctcatctgcaaaacagaatgggaatgggctgggggtagaggtccctttcaaatgttgtccgtggaaacaaaccaatttctacaatgtccgtgcagtcctaagcatttttcctttccgtactactggtctgtctaagctgagatcctattgggaggctttctggaagcccttctttcaagatggcagataaagttgattggaaccaatgctttaatgaaatatttagaagtacagggccctttttatattaggaaaaggacaattatgcccagctaattccttctcaaaggatctatttgctttttcaagatggcaattgttcctgactcattaccttgagtacatttatggaacagaatcttgattagcccaataatcgacaacaaggagccaggcaagtgatgccaagtgtagccctaactctgcatttaatttagttatttagtattttgttagaaacctagaggagagctcagaaacggagagaacttccgtccggtgtttcaggtgttggcagagtggaagacaaagtgtgaggagagccaagcagagctggaggcatccctgaaggagtcccgctccttgagcactgagctcttcaaactgaaaaatgcctacgaggaagccttagatcaacttgaaactgtgaaacgggaaaataagaacttagagcgtaagctattcgaaaccctctgaaacctcctcctttcatgctctattgctcgagagcatgctggcgtgggtgtggcttcatcactcagtttcctgcacacatgtgtgttaatgcacatgcagaaagtgttcaccatctgacgggttacgttttagcctctctctgtacaatatcttatctctaggaagcaggaaaccttaggattataataaaccaggtaaaaagcattgagtcaatgctttgcatgtctggaaacccacgcagaggcgctcatatgcaactgaaacttacttctttacagaggagatagcagatctcacagaacaaattgctgaaaatggcaaaaccatccatgaactggagaaatcaagaaagcagattgagctggaaaaggctgatatccagctggctctcgaggaagcagaggtgagtgctgggaggcaggctcaggcgcagatgcagccatggtgagccacggccagggaggctggctgctccatgctgtgtctccatttttgcctttgtcaaatcacagtcctaatgcctgctgctttcccgtcacacagcaaaactgtgaggctgaataatacctgtgaattatcttaaatttattggagaagactgtcatattaaataggcctaaagatgagattttacaaaatattacatgaattaaaaatatctagaaagtgctttatgctcctaagaaatatgatttaaacattattattggttgatagtataatcaaaaccaaaaagcaatgaaacgtgcttttatttctgcactgaagataaatttgggactttttttttcttgagacagagttttgctcttgttgcccatgctggcaatctaggcccactgcaacctctgtctcctgggttcaaatgattctcctgcctcagcctcccgagtagctgggattacaggcgggcaccaccatgcctggctaatttttgtatttttagtagagacagggtttcactacattggtcaggctggtctcaaactcgtgacctcaggtgatctgcccccctcggcctcccaaagtgctgggattacaggtgtgaaccactgcacccggccaatttggggacatttaaaaagtgaattgtgactattgtaggattagatttaggactattccattgaagttttgttatcctgcagggtagtggagctggctccataccatcacagacactatttgatttgcttttgtttcttaaaggctgctcttgagcatgaagaagccaagatcctccgaatccagcttgaattgacacaagtgaaatcagaaattgatagaaagatcgccgagaaggatgaagagatcgagcagctgaagaggaactaccagagaacagtggaaaccatgcagagcgccctggacgccgaggtgcggagcaggaatgaagccatccggctcaagaagaagatggagggggacctgaatgaaatcgagatccagctgagccacgccaaccgccaggcggcggagaccctcaaacacctcaggagtgtccagggacagctgaaggtttgagagaacccatcggggaaaaacctctctcctcctcacatactcagaaatgtaggctgggcacagtggtgcacgcctgtagtcccagcgctctgggagactgaggcaagaggctcacttgagcccaggagtttgataccagcctgggcaatatagcaaaaccttatctctacaaaaaaaataaaaattagctaggcatggtggcacaagcctgtggtctcagctacttgggaggctgagatgggaggattgctttccaggaggcagaggttacagtgagctgagatcacgcaactgcacaccagcttgggtgacagaacaagaccctgtctcaaaacaaacaaaacaaaacaaaacaaaaacaaacaaacaaacaaacaaaactcagagatgcagatgaggctcgtggtcctaacgcctcaacttcaaatagaatgttcgtttttctctggctaggatacgcagctccacctggatgatgccctccggggccaggaggacctgaaggagcagctggcgattgtggagcgcagagccaacctgctgcaggccgaggtggaggagctgcgggctactctggagcagacggagagggcccggaaactggcggaacaggagctcctggactccaacgagagggtgcagctgctgcatacccaggtgaggggagggagaggaagagaggcgaggttccagcctcatacgcacctggttaacagccctcctcttgccctagaacaccagcctcatccacaccaagaagaagctggagacagacctcatgcagctccagagtgaggtagaagatgccagcagggatgcaaggaacgctgaggagaaggccaagaaggccatcacggacgtaaggcgtctccttcctgctgccctcgggctgccgggattgcattgcattaaagccctcacatagttagacaggtgcggtctcccccagccacacctggtgcacattctgctccccgagggctcccatctccgctcaaactcccctgttccctcctgcactttagaagaagggcataagaaaaaaaggcaggaagggattatatcctagtagttctgcctgtggagaggtgtgcatgtctttccttcaacatctgacttattccaaatatgaaaacaagaacctgaggtgttaatatcccacacatttttcccttcctgggtctccgaggctttctcccggcggcccaccgcgctaatggcgccacctgctgcctggcgggagaactttacctcgaagcgattttgctgttcctgtacagccttaattctccagaggccttcccttaatctcactatccccaaatctatgaggctgagtatcaagtcagactactctaagtctcaagctcctttgaaaatatatattggtggtaatgaaaaaagaatttccctggggcaggggagagtttcaaaggaggccagcttaagaaagggaagaaactgtttcccagcctgtcgctaaagttctcattgcctcattgattaggttattttatctactgggtgtagctctggccctcttccagggtggcagagtgtgcttcatcacagtctcacccgttgtcctttttctttctttctttcttcccccacccccgagatggagtttcactcttattgaccaggctggagtgcaatggcgagatctcggctcactgcaacctcctcctcctgggttcaagcaactctcctgcctcagcctccggagtagctgggaatacgggcatctgccaccacgcccagctaattttttgtatttttagtagagatgggctttcaccatgttgagcaggctggtcttgaactcctgacctcaggtgatccacccgccttggcctcccaaagtgctgggattacagacgtgagccaccgcgcctggcctgtcctttttctttagcatggtctctggtcctccgaggtccccaggttttgacagttccaaggcactggagcttcctctgcatcctagcaagtcccatgtgcttttcaggctgccatgatggcggaggagctgaagaaggagcaggacaccagcgcccaccttgagcggatgaagaagaacctggaacagacggtgaaggacctgcagcatcgtctagatgaggccgagcagctggcgctgaagggcgggaagaagcagatccagaaactggagaccagggtgtgtgcaggaggaaccccgcctgcgctgagctttccagcctcccaatcacgctgcagccccagactaatttccccaccctctcccccagatccgagagctggagtttgaacttgagggagagcagaagaagaacacagagtctgttaagggcctgaggaagtatgagcggagggtcaaggagctgacgtaccaggtaagtggaacgcaaacgccatgatcgtgtcctctgtgacgtgcagattctccatcaaaccacaggaagaaacactttggcccagaaagctgcccatgccgtgtgcaaatctgccccctcctctccagtgacattcccactttctcattcttagagtgaagaggacaggaagaatgtgctgagattgcaggatctggtggataaactgcaagtgaaagtcaagtcctacaagaggcaggcggaggaggctgtaagtgagataggtgctgactgcggcaggcagaccgtgctgtttcccgtggtgagttctgagagaggcgcgtgctgatataacctgcctgggctctttggttttaggatgaacaagccaatgctcatctcaccaaattccgaaaggctcagcatgagctggaggaggccgaggaacgtgcggatatcgcagaatctcaagtcaacaagctccgcgctaagactcgagacttcacctccagcagggtgagtcgctgagctgggaggagcccccccccagggactgtagaaacttcttagctggaaggaacctcagagaaccctttactttagagctggggagtctcaggctcaggaagagaaagtgcttaaagtcacttagctgactggaccctcgctagaatcctggtctgtgagtcacaataaaaaccgccatcctgcacatgtacaccatggaatactatgcagccataaaaaagaatgatatcatgtcctttgcagggacatggatgaagctggaagccatcattctcagcaaactaacacagaaacagaaaaccaaacaccacatgttctcactcattagtgggagttgaacagtgagaacacgtggacacagggaggggaacatcacacaccggggcctttccgggggtgggggcggcaaggggagggagagcattaggacaaacagctaatgcacgtggggcctaaaacctagatgacaggttgataggtgcagcaaaccaccatggcacatgtatacctatgtaacaaacctgcacgttctgcacatgtatcccaacaaaacaaaacaaaccgccatcctgaaaaggagcgagcgggtcccactgagctctttcatgcgccccctgctggtaacaaaaggctgctgcaggagccccctccagagcccgctgaacacacagcatccgacagtaggtcgctgggtctccagcgtttggggcttgctctttcggagggccagtttctcaggctatggggtgacttcatgtgtgcaatcgtgcgttttcccaaggtccaaaaaatatcctgtgtcccactgaagtaggcaagcaactctgatgccagccggcagaagtggtgggtgggaatgtgtctctgccacccgacttgactccaggtgcctactttcttcctagatggtggtccacgagagtgaagagtgagccagcccttctggagcaggacagaagatatgcaaaatgtatattttcttgattcctgaccattgatacttaatgtccatgtgactctttttcacatgcaataaactttgctttgtttcaatctggggccgctttgctgtatttgttttcctcttccccatgcagaaatggttcctagtttgatggtttgtatgctcggaggtgaaagctttgtaagcagatggctcggtaaattcaattggtgtgtgcatgtgcggagggagagatggcttttggcttaaatcaaaaaggaaaaaaaaaaacttccgggttaacctttgctttggtggggaatgggagggagagcttttcaaaagagtcatctcttaatatgacatgaaggaaacacaaaggtaggctcatgaaaagcccttgtcttgagttgaataaggttataaagcaaaggcccacattctccttctttacattctagtggggaaatacatctgaaatctagtaaatatttgttgggcagctgttcatgtaagcactgtgctatcaaaaatacataaatgaataaaaaagaggctggccccttcaagcgctcagtctaaatctactactgttatcttagatcagtgtgcactatttcaaagctgcacaacagaaaatcccacccctgacccaagataaccttgtctttaccttaagagggaaggaaggcaggaagtcaaataactatctggttgacttgctactagaaagagcatcttctagcctgggatcctttgtttattgtcatcagtaaatttattagcaatagctgccaagttcccttctttgtctgattccagaagattaggggacctagtttgactcaggtgagaatgaaaggccaaggggtgttctctccagatgtgggggaactcaacaaatcatttagctttttcaataaataaattgcaaagaaaaaatataaaacaaatacaagggagacctgtagattaaaagatacttagtggacctatccgccaattgcactgtgtggaccttgttaggatactgctttgtacaaacacgctgttaaaaaatagacacacacacacacacacacacacacacacacggtccaattggtaaatttgactattgactggatattgatggtgacatgagattattgttcatttcacggtataatgtgattttgtgattatgctttctaagatagtccttatcttttaaaaatacatggtaaaggctggacgcagtgactcacgcctgtaatcccggcactttgggaggccgaggcgggcagatcacgaggtcaagagatcaagaccatcctggccaacatggtgaaaccccgtctctactaaaaatacaaaaattagctgggtgtggtggtgccctcctgtagttccagctactcgggaggctgaggcaggagaatcgcttgaacccaggaggcggaggttgcagtgagccaagatcacaccactgcactccggcctggagacagagcaagactctgtctcaaaaagaaaaaaaaaaggtggtaaaatatgtacataccagaaaggaagagtaagcgagagatcgttgaagtaaacttattttacagaacttatgacttaaagaattaataaaagaggcccctgatgcattttatgcagaactggagtgcctctgcacttgaaaatacctggggccgtggaaccccctgtgtccacttattggcaaagtgtgacatttcccacaaaggagaaggtgcggagtttggtgctggaagtgacctgtgactatttctattaggctctgattttgtgaaggatataaatgaaaagattcattttctaagagtgaatattatgaccaaagtcacccatgttcatttattccataaaaaaaggatgcccacgactatagaaaatgtaagctgtgttattaagaagcaaaaaatgaaagcaccaattccattccaaatcaggagctgccgtgccacacgagccagagagggggtctcctccgaccatggagaggaggaggatgagatcagccactatttactgaactccacccatgtgcacttggcatgcactctctcgtgccctcagcatacagacttggcgatgaggaga

SEQ ID NO: 14760 - DNA, 67643 bp, Human
  misc_feature (1)...(67643): n = A,T,C or G
aaatttcggttacttagttcttcttgttcagcctttatttccctattttatgacaacagaaggaaaaaatgagtataaaatttaaagcaaaacaaaacaacaaccaaacccaagttaacttttccctactttgaaattcgaaacaaatgaagtgtaacttgtcttaattcagatcatgatctgaaagatgacatttatctgtgacaagggggagggagaaaaagaagcagtgaattgaggagcttctcctttgtgttttgacaagcaaaaatacttttttttttttttgagacagaatcttgctctgttttccaggatggagtgcagtggcacgatcttggctcactgcaacctctgcctcctgggttcaagcaattttcatgcctcagcctcccgagtagctgagattacaggtgcatgccaccacgcccagcttatttttgtatttttagtaaagacagggttttgccatgttgcccaggctggtcttgaactcctgacctcaggtgagctcgtcgtctcggccccccaaagtgctggggttacagatgtgaaccacagcacccggcccaaaaataccgtgaatttctagaatgttacgcaccatatttaattattcaaaatgttcccaaaatattttttaaaaacttctggtacatttattattttatatcattgttaaatatcctatttaattagtgtgaatgattacaaattgactgacaaattctttaaaaatattactgcagttggccgggcgtggtcgctcacgcctgtaatcccagcactttgggaggccgaggcaggtggatcacgaggtcaggagattgagaacatcctggctaacacggtgaaaccctgtctctactaaaaatacaaaaaattagccggacgtggtggcgggtacctgtagtcccagctactcaggagactgaggcaggagaatggcgtgaacccgggaggtggagcttgcagtgagccgagactgcgccactgcactccagcctgggcgacagagcgagactccgtctcaaaaaaaaaaaaaaaaaattactgcagtaattgctgtagaacctagagttcaaatgagacctttgtcagagaacatgaccccaaagtagttctgtggaactttgcgtaggttacttggtattttgcatagattattgggccattattcttgtgggtggacctgcccacaagatagttggacaacatgtaaatagttattaaatctgtttgagtgcatttccactcggtttttcatgtgcgtgttcaaacatcaaggtaaagtccttttaaggccatccatacagaaaaggcttcagggttctaaaggaccttaaaaattgtttaatcatgcatgcagcaatttttttgaatctcttccgtatgtccctgcagtttcctcttgtacacactgtcttttgaggtgactgaaaatgttctttattataaattcttacttgaattgatggcaagataggactttactaattggtttattacctcaattcatgatattacttgtaatatagttttctaaattagtcttaagcttatttaaagctaacagctgtttgataaggatatttgtatagctctggtcttattatatcattgtttcttaggaaatatgaaatatttaaagaattttaataattctttcatagagttcttcatatgtatagtcttttcatcagaaacacactaaagcactatttgcatttcctagaaactcatgtgtcacagttactttgtgtttttaactaggtggttaattgaatttattgttaagtctattatttaatgagtctaaccaaaccttaatatctattattaagtttaatagtttaaaataatttaaaaatactttgagtttatggaatgaaaacactgtttcaagtttgtgtgttggttagaaatattttgaattactagatgtgtcattttaaaaatgtggtatgtactagtaaattttgtaaaatattttatcttttaggcgaggattaaatccaccacacagggtgaaatctatctccatgacaacattcacacaacaggaaattgaattcttacaaaaacatggaaatgaagtaagtggttttttttttttttgcaatttttgacttttttgttggcagtcattttaatgagatttaataagttatttaaaacgttgaatttcacggtctaaataagttatttttgtattttatatttagatattttaaaatgtactcatttaataatgtatttggaattaatgtttactacataaacactttaccgtaaatctgaggtgaaatgtgtgtatttaaaagtcatcagtcttgaatataaaaggcgtttcggaggacacccattattacagttattgttagtcttcgcttcaaaagtcaaaaaagaggaagagaattcattttgtgatgttgtgttaaacttgttagagtgttgtgtgatcagctttcacttgaagtcctctatttttcgtaaatttttaactttggacgtgtaggtgatgtgtaatgtttagcaggtgctcagtagggaggaggttagtagttctcagtggcagctaagtgtcatggggagccagatggtataaagatttggatggaagctttttttcttcttgcctttaatgggcttccagtaattctattctgtttgcttgtttgcttttagctctgtgttttgctattagtaaaagtttttaaaatttttctaatatttttaaaattaataaaattaacaaagagagtgggcatttttttataatcctgcaataaggatgagccagttaacccaagctgattaataatagctattattatttgacagaaaagtctcattttctagaaaggataagtagtactttagtggtactcttctggttgcatctttgatatccttaataaacataaagtaagttaaatattaaaattttattagttttaatcttctccttggacccttagaaaatatatgcaagcattttacactctgcctttcttcctaatactctgaaagtaataccttaaaattgtttgcctacttgtgatgtccacttgcttttggttctaaaatagtgaggaaatataaattcacagctatgaaatatttttaaatatttcatattaaattatttaaagaagagagcacattttgaagtctccagattttgccgatgacaaattattttgagtattcagattccagactaatgtgagtacattataagaacatgtaaagctggatgaaaaggtaggaggcttttaatgaagagtaagcatagaataatatatatattgattaaaatacaatttgaactacttgtgtaaagtttacaagtaggattaacttaacattgcacacttgaagttactttcttagaatgttggcttagtgtgcaaaattttggaaattagaatggaatcagaaataaagaatattattctatctttagattaaaaatatgacagtaggtaaaaacagagtagcaaaactgtgataacagcagtcaattgaagaagtgaaaatataacaatatgtgagataaggttaggtggagactggtccaaaacaataccaagattgaaggagtatatatttttttaattgtggtgggaacattgatctaccctcttaacaaatttttagatgtgcagtattctatggttaattatagacatagtgctgtatagcagatctctagaaattaatcatcttgtataactgaaactttataccagttgaattacagctcctcattttatcttctgcccctgttgccccgattctactctctgcttctatgggtttgactattttagatacctcatataaatggaattacacaatatttgtacttctgtgattggcatatttagtgtaatgtcctcaagattcatccttattgtcatgtatggcaggatttctgaaggaatattttttaaggctatagcattatggtaaatttagagtatataaaaagaattagttaatttttaggaactcactgtatcaaaaagtagaagcaaaatgtaaatgttataagtgactgaaatgtatttatgaatcttaagtcctacaaagaggtttgcaagttgatagaccactcaaagcacttaccatgacaatcactgtcactgtgctgggtattagggatgtggttatagatgtgttacaccggcttagtggacaaagggctcacagttggtgtgacagatacataacagataattgcaacatggtattagataaataatgataagaataagaagtatcagcagtagtatggaaaaagggaatcagtattttggtggaaaggagaggattgggaagacccgacagaacagataacacatttgttggtttttgagggtaactagaacctaagctggtagtggaagtcactgaagatggagcaaacagtacaaaaagaaaaagggaaacttgcaataggttgctaggaaatatactaaccttgtaaatgcttgttaaggaagacaaacataccttcttatagtataccaaagaacatcttagaaccaaaataatggacaggtatgtttggttctttacagtattaacagtatctgtgttcttaaaattttgagaggtgtgtagagggtgatgaagatacgaagtgtgggacagttggtacagctttataaccaaatctttatggatttcacgtgcaagtgttctattatcagtttatcttttttaaacctttaaatggtaaatatcacttgcatagggaatagtaccagaacgtaagtttacatttcaaaataagttgccatattctctcgtcaccttttaatagtttggaaagggccatattcagtcacataagttttggattaaaaaggctctatcatacatcttgtgcatgaatgagttcatgcctgaagatgagtatttccaaaattaaaagatcagaaagtatattggctttggcagcagccttggatctttgatccccaccagggagttttagtgagctgtggggcatgtttggttgttgtcactattggaagatgttgctggcttaagcaggcaagcaccatgaatgatgaatgacttgtaatgtgttgaacagaattaacctgcatgccatatgctatgaatgttcctccagacatttatatgtgggaaacatctgtgtatggtcttctgcatatataatttaattctgtcttaatacttgcattgtagttgaacatcctattgccaaagaaagtcatgctccaagcccagaatcagagtgagaggggctaccaagttacagggcaaagggcatggatacaatcacacaactgatggcaatacgaattgtattttagtcatcaataaagtatatctgtattggtagctgtggtaagcaaataatgttattactatttatagatatgcatagagaccatacttacagagtagatcattagtttctacagatgtggtttacaaatttcttgactattactttagtgtttatagacttctacagtgtgtttggtggaggagatatgtatatcattaagttacagcacataatatgccagatgctagtaaaatatttcgcattggagcactttgtatttatttgctgaagtaatttttgtcatttttttcagaaccagaatatttcacaaaaagtttccatgtatttcttttgtatcatacagttactttaaaaaaaaacctgtagtgatcttggcactgtagctcccctgtaatcccagcactttgggaggtggaggtgggaggatcccttgaggccaggaattcgagatcaacctaggcaacaaagcgagatcccatctctccaaaaatttaaaaattagccaggcgtggtggtacacatctgtagtcccggctacccaggaggctgaggtgggagcattgcttgagccctggagttcaaggctgcagtaagtcatgatcatgcaactgcacaccagcctcggtgaccaagcgagatactgtctcaaaaaaaaaaaaaaaaaaatctatagtgattttctgtatgtcctcatttgtgatgtcatgggcaaattatggttttctagttaaaggaagttggattaacttctgattataaagttaacggaaggtggactggtgaacactgctgtaagtagataattcaatggagaagaaaatttagaaataattttattttgaaatatgtatagtttatgttttctagttgtaagttaaccttcctaatatgtttgaagactaaaagtaaaagcattactactggccaagtgcagtggctcatgcttgtaatcccagctgtttgggaggctgaggcgaatggaacagttgaggccaggagttcaagaccagcctggccaacgtggcgaaactctgtctctactaaaaatatatatatattaaaaaaaaaaattagccaggcatggtggtgtgtgcctgtaatcccaggtacttgggagactgaggtgggagaatcacttgaacctgggaggtggaggttacagtgagattgtgccactgcacttcagcctgggcaacagagtgagactgtctcaaaaaaaaaaaaaagaaaaaaaaagaagacattactattaatgctccacaggcatggtctatgtgtaggagtaaaatcaggcattgcatgccagtatttgattatctctatactggattaaaaacaaaacaaaatgattgctttgaaaacccatgcaataacgtacacttttcccttgttaacattcatgattgattcatttttgaagcagagatttattaataaattacctactgtgggagaatggcgtgaacctgggtggtggagcttgcagtgagccgagattgcgccactgcactccagcttgggcgatagagcgagactccgtctcaaaaaaaaaaaaaaaaataaaatagcctgctgtgtgccaggaactgtccttaggtcctagggatacaaaaagggagatgattcctgtcctccccttgcagtcttctacatgcaggagacataataaaagtacagtggtcttgtgctgaaagctcagatttggactatgcaggttgtgaaccttgggcaagaagctttttagccttaatttctattggtagtaactataatacctgtgtataaaaatgctaggattttttgaattaggccaacttgtgaaaattcccagcgtatttcttgtcagatagtatttatttattgaatctgaatctaaagtggtagaagttataagaagaattatcaatttttattttcattcctggtttggatggtttctgtagggggatttttcagttttcatagcatactgtcatgtcatttacattaatattcgggttatgtatttaaactcttggagcattttaacttcgattttctgctgagtttaataataatgaaaattgatagttattttagtaacaacatattgccatgtagagtggcagagttaagttatatactcattaattcaggatttacagctattctgttgcctatggcaggggttggcaaactgcttgtagtggccagatagtaaatattgtaggctttgtgggccacctgtattctctgttgcatatccttgtttgaaattcaccccctcttccccccccaccccacacacacaattctttagtgtaaaaaccatctttagattaaggcagtataaaaacaggctagtgatgacccagtttggtctgcagattgaagatgtatagaactcttaacgtttcagcttgcaatgtaaatctttttatgacctgacttcttaatgtaatgacgttattgccagcagaaatgttttaactacaatgatctttgttttgttttccacatgtgctatctgtattctaattttcttgccattttaccaatgctggcttttatttttgcttgacttttctcttctaatcccatcagtctttcaggagtttttatacctcagatactaacacccccatatgtattttaaactgtttaaaaaataacattcactgtaagatttacaaaaaaaaattttttttgttattgctcttagtttcttctgtattggtcttactgccctcaagacattatagacatctctgtggcataatcttgcatacgtcttaattatacctaaagcagtgaaaatgcacaagcatatatagccaaatgagtttctttcttgtttttgttttttttttttttttttttttggggacggagtcttactctgtcgcctaggctggagtgcagtggtgcaatcttggctcactgcaacctccacctcccagattcaagtgattctcctgcctcagcctcccaagtagctgggattacaggcatgtaccaccatgcctggctaatttgctaggactcaaaaaaatccgtggtttagtttgattaccactaatttatgaaccttgttaccttggggaaaccacttttccctgaccttcattttcctttgtaatctgtgggaaatatctgttttgcctatttcatgaggttgatttgaaggtagtatataggaaaacattttgaaaattgatgtattatatagatgtaagatcatggttttattttattttttaaaattaaaaaaaaatttttttccccaggtttggtaacttgcccaagatcgtgcttttatgggcaaagatacttttccagttgattcctaaacacagaaaataagtatcacataggaacatggcatgctttgaattgaatttagggtggagataaatttttgcagaatttcagtcagtatgatggtattaataaatgaaaacattcactaataatacattgaaaaacattttaaactacaaaattaattatttgagggaatagcttcctagagggatatctcaggtttaaaaccatccaattaaaatattaaagcacactattgttattatttaagggatatttatttagtgtctgcatatttatgcacgtctggccttttaagcattttgaaaggaaggtatggtgctatggctcttctaaatattagctgaatctagtcagtagtaacttagtaaagttgaaaatatttagagtatattatttgatgttaactgttggctttcagagaaatacactaacaaaaatgtagaaaatgtagacatgtctttgtgttgaacatatcataatccgtgggtctttttgaatgacagaaaacccagagatttatagaagaagctagatgttgtttgtaactactctgagagtttacttaactttttttacattacatattccaggttacagtgtatttctttctagctgtttgccttaccattctagcttcctgtaatctcttagcttgtttttttcttgccattgtgtgttatcttctaaaaaatcttacttgactcgaattaaaacaatataaatcattagatgcttttgtttcttttttaaagagtttttttgtggagttattcatgcctttagacaagtagataatgccatcaacacatggctgtctttttattatttttaagcaaatgcgagacataaaatttcatctgtaaactcaactctcatgttatctgtaaatttcaaggactttaaaatatatatggcaacagtgctatttttgtccctatgacaattaacagtaatctagtcatctggtcagtgttttaagttttctgttgttcatcagtatcttacttttcttttttttttcttaatggtttgtttgaatgaggatccaggtaatatccacacatcgagtggttaaaatgggctttaaaactttgtattgcttataaaggattggaggctttggctgggcaccatgcctcatgtttgtaatcccagcactttgggaggctgaggcaggcagatcacttgaggccaggagttcgagtctagcttgggcaacatggcaaaaccccatctctactaaaaatacaaaaatttgctgggcgtggtggcgtgtgcctgtaatcccaactactctggaggccaaggcacaagaatcacttgaacccagcaggcagaggttgtagtgagccaagatggcaccactgtactccagcctgggtgacagagtgagactctgtctcaaaaaaaaaaaaaaaggaagaaaaaaagggattggaggctagatggatcacagtgacacctacaaagattggactggaatggacctgtattagtagtatgtggcatagattcaggcagaggtttgtgttaggggcctcaggccaggtagttattctggagctggataatctataacctggggcccctgccggcttaaagtccctgggaaacatagcagctcaggtgacttcagtgccttatgggacacggacgcagcccgagtgctacctggtacacatctgagttgtagtccttttcctgtgtctttttcattgctctggcatcagctgctactcagtctccttaaaattgatgttgggttcttactgcaggacaagaagcctgtttgtctgtcaggacggcagctgacattcattttggcaacagagtatgccatgtggttatggggtacgttatgagctggtaagaagaaaacaaacaggccctccagcctcataggtttttgaggaattggtaatgatgtttaaggtttgggtagtagtagccaaaggccatgcctgcaagaacttcttgttgatttgggtgatattttttggtcagtctcttactggaccatgactcccactacttccccaaggacaatctcatactggcctgtgatcctaggttctttccaaggatggagtgtctgtgagcagttatcttttgataggagaacttgtcctgctttgtgccatctaatggcagcatagtgtcataggtcttatggcaggtgagcagtggttcaccagcttgtctgcctgcagggagcctggtttggctatctgctacattgtctctcagaacctgctgtcctaggtagctacagcaagactctggacttgggtagagaatgctcagagccatagcacaatggccagatctgcctgttttcgtcccctcctccaacattattatggaaaattccaaatacataaaagttgaaaaattatacaggtacaataaacattgtgctatatttgcctcagcagatatctgtatccattcatcagtccatctgatatttcaaagtaagctcaaaacattagttcacattacttgtataaactgcaatatatctatcttttttatttttaaattaaattaaattaaaaaaaaaattttttttttgagacagagtttcgctcttgttgcccaggctggagtgcagtggcatgatcttggctcactgcaaccactgcctcccaggttcaagtgattctcctgccttagcctcctgagtagctgggattacaggcgctcgccaccacgcccagctaattttttgtgtttttagtagagacgagggttcatcatattggccaggctggtcttgaactcctgatctcaggtgatccacctacctcagcctctcaaagtgctgggattacaggcgtgagccaccgtgcccagcctaattttttttgacagagtcttggtcttgtcgctcaggctggagtagtgtgatcttggctaactgcaacttccacctcctggattcaagagattctcctgcttcagcctccagagtagctggggctacaggcacccaccaccttgctgggctagtttttgtatttttagtagagatggggttttgccatgttggccaggatggtcttgaactcctgacctcaggtgatctgtccaccttggcctcctaaagtgttgggattataggcatgagccattgggcctaacccagtatatctatcattaattagaattcagtattcgttcaattttttgaggtataatttacatacagtgaaacttaagaatcttaagtgtacttttggatgagttttgatcattgcttccaatttggtaatccaaagccctatacaaatatacacataaacatcattacagacagtcactggacacttcttcctattcagtccttccctgaattttttgagacagggtctcaacttctgtcactcccaggctggagtgcagtggctggatcacggcttactgcagccttgacttcctgggctcaggtgattcttccacctcagcctcctgagcagctgggaccataggcatacaccaccacgcgtggcccatttttttatttttagtagagacggagtctacttctgaggcactgttttgtttttttattcacattcatataaagtaagttaaaatgtgatttttaaaataaccctccttccttttttattttttttgaggtagggtcttactctgttgtccaggctggagtgcagtggtgcgattacagctcactgcagccttgaccacctgtgcttaagcagttctcccaccttaacctcccaagtagctgggactacaggtgcgtgccaccatgcctggctaatactgtttatttttgtagagacgagatctcactgtgttgcccaagttggtctcaaactcctgactaaagcgatccacctgtcttggcctcccaaagtgcgaggattacaggcctgagccacagtgcccaaccaaagtaaaccttcttttgagagttatgcacgtggatgcttgtactttttcctgtttattaccaagtattggcttctattctatgaataaattataatttgttcattcttctttgtcagatatatccttagtaaatattttctcccagtctgtggttttttgttttttgtttttaattttttgagacagagtctcactctgttgcccagactggagtacagtgacgcgatcttggctcactgcaacctccgccttctgggttcagttggttcttgtgccccagcctcccgagtagctaggaccacaagcgcacaccaccagtcccagctaattttttgtaatttagtagagatgaggttttgccatgtaggccaggcagatctggaactcctgacctcaggtgatccacctgcctcggcctcccaaagtgctgggattacaggcatgagccaccatgcctggccctcatttattttctttttgatatcttttggcaagcggaagttttgtcattttgatgaaatacaatttattagttttttgttttatagtgaatggttcctcttctctgtcttaaaaaatctgcttcctctcaaatcatgaggataatcttatttattttagaagctttacatttacatctgtgatccatctcaaattaattttagtgtatggtgtgatagggattgagtttcatatttttacatgaatatatacacttctagctctattgttgaaaacacttttctttcctcggtgttgctttggagtctttgtcaaaaatgaaatgaccaggcagggcatggtggttcacgtctgtaatcctagcactttgggaggcagaggtgggcagatggcttgagcccaggagttcaagaccaacctgggcaacatggtgagaccctgtctctacaaaaaatacaaaagttagccaggcatggtggtgtgcacctgtattcccagctagttgggaggctgaggtggggggatcacctgagctttggggaggttttaggctgcagtgagctgtgattgcaccactgcattctagcctgggcaacaaagtgagaagttgtctcaattaaaaaaaaaaaaaaaagaaatgaccgtataattacgggttatatgctctctattatatagtgtcatttgtgtatttgttaacccttatgccatacaacactgtcttttggttactctgctttcctagtaaatcttgaagtcaggtagtacaaatccttcagttttctgtttttaaagattgcgttagatattctgggtcaggggttgaccaactaaagcctgtgggccaaatttggcctgttgcctgtttttatatggtctacctgattgagctaccattgtgagacatggagaccaagctggattttctctcccttccttcctcatttctccctccactgttggcagctttgggcaccaagtggtggaatctgggagttgatgactcagtcacctttgaccagctgcccaaattgagatgactgggctctttgggaagttggaaaggcacaccaggatctgagtgtcactgtggtggagagtgaaaatgaccacagtgcagattatctgtttgtcatattggttttgataaattgtacttttcagggaatttgctcatttcatctaagttgtcatatttattgacataaagttattcataatagtcttgttctcttaatgtgtatgggatctataattactttgctcttttattatttccttctgtttactctgggttatttcctcatttttagcttactaaaggtgggacctgaggtcattgattctacagcttgctctttgaatacagagttagaggaaagataatgttattaagacattaataaagaagggaaaatgtatttactgtttattaagtggaagtagattgtgttcagtaggctgaggaggaggaagaggaggagggagggactggtcttgctgtcttggagataacagactggagaggtggaggggaggcggaagaggcagggacacttggtgtaaattttttttttttttttttgagatagggtctcaacttccgtcactcccgggctggagtgcggtggctggatcatggcttactgcagccttgacttcctgggctcaggtgactctcccacctcagcctcccaagcacctgggaccacaggcatacaccaccacgcctggctcatttttgtattttgagtagagatagagcttcactatgttgcccaggctggtctctaacttttgggcccaaatgatccgcctgccttggcctcccagagtgctggggttatgggcttgagccactgtgcccagccaacttggtgtaacttttattgaaaaaatttgtgtttaagcggacatgcacagttcaaactcatattgtcaactattaacattttaaagtgatcattttccctctaagctctacttaactgtgctatacgaatgttgatgtattttatcatttggttcaaaatgttttctaattgcccttgtgggccttctttgacccattgatttatttagaagtagtggtttaatttttacatatttgaggttttcctaggtccttttctgtaattgattgctgagttaattctgtatcatcagtgaacatttttgatatattttcactgctttcctttttattgagatctctttatggtccagcacgtgttctgtcttggtgagtgtacagtgtgtacttgaaaggagtgtgttttctgaagttgttgggtgtagtgttctataaatgacaattatagctctgtgattgatggtgtttagatgttgtggatccacgttactgatttcgtctagttaagcaactgcagatagaattggacagctggtgtggatttacatatttttttctgtaataaatacatcattttttgctgcatgtattttgaaactttattattggtgctgttatataattattatgtcttcttgattatgccaccattatgtaatatcttttttatgtttgataatactcttttttgaaatttactttatctcatacttatattgttttttctttgtagtgatgggtagttgtgaaacactttatttttgttttcagaatgtgactgtgatgcacctggatatgctttgtgtatgtgtatgtatttatcctacttgtggttgatgatgatcttgaatctgtacatttttcatttaccaaattgggaaaattttatcattttccttccaaatattttttctgcctcattctctctcagctctccttctgagattccaattgcatggatgttaggcattttgatactgttctgcagtttccagaggctcttaatttttttccctccatctttttactttccagattggacaatttctctcttatcctaagctcactcttctgttatctctaagctctaatttttaactttagatattgtcttttccatctctagcatttgtattttttctgttatttctagagtttccatttctctgctcagattttgttcatttttatttattgcaaggatgttttcttatatgatatggtctttttattttgttttttttgtttgtttgtttgtttttgagacggagtcttattctgtcgtccaggctggagtgcagtggcacaatcttggctcagtgcaacctccgcctcccaggttcaagtgattctctgcctcagcctcccgagtagctgggattacaggcacccgccaccatgcctggctaatttttgtatttttagtagagacagggtttcagtttcactgtcttggccaggctggtcttgaactcctaatctcgtgatccacctgccttggccttccaaaatgctgggattacaggcatgagccactgcacccagcctgtaatatgtttttgaatataagtatactagctattttaagtcattgcctgcttattctaaaatctttatcattgcagaatctgtcgctgtttgatttttcttttgattatgggtcataatttcctgtttctttgtatatgtagtgcctctggattctgttttgttccttcataaactattggttttaattgttttgttttttactttagcaaattctgctgctcccatgatgagtgccagctgaaatctgctcagttctttaattgaactgtttgaagtcagccccatgcacacataggtcaggagtgagccagagacttgggaaaagtggatatgcaagttttgtggtacctattttctttctctggccatctctcttctgggatttagccctcactttccagttgctatggctgtggtgaacctcttgtcttcttgtactttaagctttaaggcttgtgtatttctgtttgagttttagcagccctgcatgactgctttcaagtgatgttccttaaaaaaaaaaaaaaaaaaaaagcacataggcacatacctagtgctgtttctttcctcttcagcttgtttgtggttgctctgtagtgtcttaatagactttgtccagagtttatagttgttatctgctggagagttggggttttaacctgaggctttttgccactactggtggaaatctacactgctcgcccttttaagtctttttttatcctctaagtttcctctccagtcactcattcttattctctgccctcctgctaaccaagtcatttattccaccttctggattttgctaatgccatccacgtagtgtcaacgttcctctgttctcccagttacctataaaccggtggttggctgtagtagtttcttaagattcaggcttaatttcaggaatgggaaagatccactatttcataggttgtgtggtgtttttttaatcgaaaaccactttaaaagttttaatttttggtcatgttagcagctaatgctcagtgcctacatccactaattagcagttgtaaaatggtgatagtctaactcagtagttttccaagtacagtttgggacttgtaagggatccttgagaccttttcagaggttctttaaagttaaaaaaaaaaatttaataatactgagactcagtttgctgtttttttactcctgttttcatgggtatacagagttttccagaagctacataacataaaaatgcggaagcagatgagaaatcagctggctcctacctaacaaggcattaatgaagtttacaaaaattacaacagtaatcccagcacttttgggaggccgaggcaggtggatccacgaggtcaggagatcgagaccatcttggctaacatggtgaaatcctgtctctactaaaaatactaacaaattagctgggcgtggtggcacatgcctgtagtcccagctgcttgggaggctgaggcaggagaatggcatgaacccgggaggcggagcttgcagtgagccgagatggcgccactgcactgcagcctggacgacagagcgagactctgtctcaaaaaaaaaaaaaaaaaaaaaaaaaaaaaagcgccttttcactaattttttttgttttggaaaaagctgtttttataaataaaagttatttacattaagatgcaatagttttattcttcttttaagaacattaaaactatttataaatatcagtagatatggtgcaccaccatttgtggtcttcaatattgaactcttcaaaatagtttcataacatttccaacagcaagcaattaggttttttttaaattactatgaatttatttatttgatatgtttcactcagttattcttgctgatgcccaaattttcccctctttgttcaatgaggtaatctgtttttgaaacctatttaaaacttctgcaaatcttgtttttacctagaagagctttgcctgaatgttcctttttttttttttaattaacctgtgagccacccgtgtattcagaaatgttgaaagaaaactgtttcttccccacctcttggtttatttacatagaatattgtacaaatgtggtttacttcaggggcttgttttgaatttgtgctaattctctctgttccttggccaatgactacattctaaacctcggtcagctgcctcacaaatgcatgccttcagtcaccaggacaacaagacaatagagtatcagtacaaatagatcactatgattgagtcctagattgaactaaataatggatgagtgtatttgttttaagaggtggctggtattgatgatatccttaaaccatagataatccacaaacaattcttacttcatatcaagacaaaatataaagttcttaatcatttctgaaggttatatgaccaaacaagctagccctcttctgctactcccttgctcaactccttgtttgttccaggtgtattctggaaaatgtaaaaaatgtaaagctttttctgtgtgtacatctatatgtgaggtagggaggcaagaacacacctttggttaatttttccttgaaaccttgcatatcagattcataatatctttgggagtgagaatgctttgctttaagaggcgtcacaaagtaagtttagaacaattggaatggaaacactgttgggattttttttttttttctttttaggaaataattctaaagctcatccaaaagaacagaaaagtaaaactagttgggaataatttgtaaaattatttactgtttgtaaatagtcaataattaaagcaacctgaaactagtgcaaggataggcacggatctgtagattagatcctgagatatactgtaaccttcatatattataaatgtggatgatcttgtaaaacaaaagaatttcagcattcagtgtggaagttggttattcaatgaatggaaaattaactagaatgttacctgacatgatacaccaaaatttcagaaaaattttagcattaaaatgtaagtcataaaggaagccataaacatgtagaaaacagtctcaaaagatctacctgcaaaatgtttattaatcccaagggggacaaacagtgactttaaatggataaagatacattttaaccaaataatccaagtatacaccagtactgggacaaattgatgttgtgtatctttcttcataatgatacactgggaaggacacgtcacttacatagtatcttccccaaaatacgtaactttaatttaatcatgaggaagcccagaggaagagacataccaccaaacagctggcctgtactcttcaaagatatcatagtcatgaaagacagaaagagtaaagaatgttccacattaaaagagacaagacagttaatggattctggacaaggaaaaccttttctttttgctataaaggccattattaagattactgactaatctttagatcagataatataaaatattaatgtcttgattttgataattgtgctatggttatgtaaaagaacgtacttatttttaggaaatatacatttaggggtaaaaggcttgttatgtcaccaatttaaatggttcattaaaaaaattatttttctcaagagaatgataaagcaaatgttaccgttggagacttggtaaagggtatgtgggatgtgtttccactatcaacttttctgtaaaataaattattttgtaattaaaaaaccaagcagaactaaattgtaatgtttaaggatgtatacatggtgggggtgggtaacagtaaaacacaaagagtgattactatagaaaatacagccaaatagccaactacatatttagcatttgaatgcagaagaactttatagactgaaagcaatggaagaagtcacaaagtaaaaactgatatatttaactagataaaacaaggaaactcgtgaaaggcagagtaaataaaattaaaaggcagagcccttgttctgtgccaggcaccataccatacagggtaatttacttatgttatcttagtttgagatagttgggcagatgataatcttccttgaaactactgtgacttcactaataataagtcttaaatttataaagctctttgtaatttacaaagttcattcataaataacctgtgtgttgaggggggtagggaggggtgcttactgtactcatgctccttactgaaagaagagaaggcttattgccctgggaaaaccacgaaacacagcaccacacatacacacacacacatgcacacgcacacacatccacacccctgattgtaccaggaatggacacctaaccctggggctagtgacttatcaggtcctgtttcttcagaaattgaattaaggttcacagaggctgtattcaaaacaacgagtcatctgaactgaaaaattgtatgtagtgggctctgtgcaggctgacaagtaaacaaacaaaaagtagtactttagagaagcaagagtggagacaagacatagtatgagaagcaaaatgataaactatgtcttggtggaggggtgagttgagagggggcttaggagataggcactcagactgcccaggtcccagatagtttcctgtttgcattcctggttcccatgaagtatttgttttattttggtggagtgctttggtgtatgctgtctgcaaatctgtttttctccaagctaatatagctgggtttcgattcttttcatcctatctagaacacagttctgatgttagagaccttaagtgaaataaggtatgggtatgtgagctgtgtgtgctgccctttactaagtccttatggtagatgtctgaattagagttgttgctctccttcacaacgcagatacttgcaagtaagttttcttactatccattgcattttatttctctctagtattctaaatatttgcttcttttttttcctttgtgagatttcctaatcccttttcaaatgttttatcatttctgtttctttgtacttagtagttacttagaaaacaagtgttaaatacctattaatctttcaccaaaacttattctggtactttttctcctatattatcaagtgaatcagtatgtataataaattggctctcagatagtccttgctgttgggaagttcttcctccaggggaaagtttttgcccatctctctatgttattccctgtgcacattctaatatgtttttgtttgtgcaggcatcattcagtttatgtattgtttagatatgcctctaaaacaggtttttattatcctatttaaattgttactagtcttggatgctgggatggtagcatagtccatggttgtaggtatgttaggggttggcacactttttctgtgagagtcagatagtaaatattttaggctttatgggtgccataaggtctttgttgcagttaatgctgatgttgtagctgaaagtagtcatagacaatacgtaagcaagtgggtgtgactgtgttctaagaaaactttatctacacacataggccccagatttagcccagtttgctgatccctggctgtatatgacgtgagaatttggatcagtgaatttattatttctacctaaataagttggggaactaaatgttctaggtcagtgtgtatattttagatggaacaaaagaaaaaagagaatttctattgtgcatacatttgagggctgttaaggaagttgctttcactcatacaccaggtattaagtgcttactgtgtgtcaggtaccaagcatacaaatagtgttgaatcagagaggaggttcctgcctcatgacatagcatttaaaaattatgagataaaggtagtgaaaataatgtgagagtgcgtatctgcgatttggtagaggggttattgtccctttggattgggtggttagggaagactttctgaggaggccagtaggctggaaagagtttagaaattagtttggagggctaatcaggggtcacattctgttaagcctaataggctgtgatgaagaatttgatttttacgttaaggaagctgttataaggtagtttgtgcttaaataaattacttttaaagaaaccctaggacaaaataaacaagtcggatttcatatcgcctaagtctgatactaccttacctgtccatttatgtggctggttcacaaaggcactatgcctcagagatctcacatacagcttgtgtgtgcctatttttagttactcagttgcataagttctaattcttgctagcacattttataaaaccaaatgttaagatagagtatactgtaaagttcctaaaaaagatgtatgtaaatgcaaaaccatcagtttctcttgtataaagcacatgtggatagtgtttttgtttgtgcaggcatcattcagtttatgtattgtttagatatgtgtcagtgagaaatactaatcagctggtggtctagcaatacagtcaaagtaatgtaggctggatccgtgtaggaaatgttaataatgtacttaataatgtacttgtttttccagtattttacttgagtcatggcatatatttgagattatttctctgagtatggactttttctccctcgtttattccttttagggcaaaataatatgttggtaatagaattttgtataggtccacggtacctgtttagagagcttctaatggtatttactgtttgttaatatttatttttgttcagtttttctacttccaaaaagtggatattgattacttgttcatcaaattttcagtttttaaactattctgttatttgttcctgtgttttatgggcagaattattaagtgctgtgattatatcttacatacaaaaggaggcaggattacctagaggattactccatctctactaatagagaaaggacaaaaaagaaagtatgaaatctagttggatgtatgtagattggcttagtgaaaaaagattctctaaattccagatcctctgtcctttccttattcttttatctttctatatagaggttataagcagagtcatgccatgtggtttattctttttatcctttttatgaaaataaggttttctccaaataaaggtgaatatccatttcaacaagtttccactccaatttgctgtccccctcaaggattactgatataatactgattcttacctttccttttatatatgagtaattgggaatgagtatggaggtttcctatttttgttattcataactgagtttgttaaattgctagccctgtatatatttattatcatgagttggctgctgtgctggatagctgctatctgcacttctcactccagtcttttccctgctctggctccaagcagctggtctgtctggatatacaaatgggcttcttgtccctgctttctagttgggttcagctggtggggaacattttcagctgattgaaggaaaggaggagagagaggttaggatttttacttttcatgacttcttcctgtgggatttctgtagcctggccgcatccttccattgaagtttccagttcctatcaggcagctgacatttttctttcttcccctgctttactgccaatgggtagtgatatgccctgctgttactaaccctgggatataacactctcacttgtgatttccttacaacccacctatgcttcgtaacagtctccttattaaacttccttcaaattatccaaattgactgtgccatccatttctatagtaactgactgataaaatatgctttaacatgttttagattctgtcagtgtctgttatgattccaattatagagtggattaggactaagggaaaaaattatcaattttatgaatttattctgttgtctggtgtgattttatttttagttcttccataatatctggctttgagtattgccagtttattgaacacttaatatggcacagcccattatttgaagcattatggggaatccaaaagtaaatgagacacatgctccgtgattctactactaggcagtttggaatgagtttcctgtgagagctacaaaatgctagaagttcagaggagggagagtgctctgtcaagaccactatgattgtgtctgcagcaggaatgaagggagatctacagcttcctgtattttcctggtaagaccacccttcccagtcattgcttattttatcactccatagcccatcactgcaaaccacttaagagaccaggcccaaaagtaatataactaatacaattttttttgttgttttttgagacagtcttgctctgtcacccaggctggagtacagtggcacgatctcagctcactgcaccttctgcctcccgggctcaagcaattctcctgcctcagccttctgagtagctggaattacaggtgcatgccaccatgcccggcttatttttttgtgtgtgttcttagtagagacggggtttcaccatttcgtccaggctggtctttacctcctgaccccgcaaagtgctgggattatagacgtgagccactgcacctggccaaactaatactatttaaagtttatatacctgttcccagtacaaaacatatattaatttacttaactctaaacctccctatgaaataggttatattattatttgcattttacagataaatgttaacttgctcaagtcaaatagcagcatacagagttggaattcaaactcatgcagtctgattcccttgtccaagctcattaactaccataaccatcacattattctacaattagaattgattattcacctcccccaaaagagaccatcaaaaccaattccattgttgcatataattccttgttttaggtgtcattcttgctcctcagtgctgtttttagcccctcacccccacttttaatgtcaatagattttatcacttgctgcatcttcttgttgcagtcataccagtcggtctccctcattcagtatttatttatttatttagagacagggtctcactgtatgacacccaggatggagtagagtggtatgatcaagggtgactgcaacctctacttgccaggctcaggtgattctctcacctcagcctcccgagtagctgggactacacatgcaccaccatgctcagtgaatttttatattttttgtagagactgtattttgccatgttgcccaggctggtcttgaattcctgggctcaagcaatccatccgtttgggcctcgcaaagtgctgggattacaggagtgagccatcgtattcagccccctcattcattttaggtactgtttttattctcactagtgttaatcattttggcaattccagtatccacgtagatatctgcatggccctctgaattccttgacctccagtgatccttcatactactttagaccttttattgattgataactgtatcacctcccagatttcagtttcaagcatccagctctctgaccaccactgattctctcttcctggcttactctaatactggagccaacaattttgggacaatcatcagcatctctattccttcatttcactaaatccctttgttatccgtcttcctcctgatgtctttatttttcttagcttagattccatggtctgttaatataatcacctttttccaacttctgtcatattctgcttgattaaaccaatattctacctacttttacctaaatagccagataaagctggagaaaaaaagccttcggactagtttcactttatatattgatggccacaagtcttcagtgcttcctagtcagttcattctctcccttttttcccaaccttgaaacccccttttttcagttgatggtgtttattttagtaaaaaaccaaaacaagcagaaaagagactttatactctatcagcaaatctagatgcctgaaatagcaatgttagtagaatgttgggagcagaatgcaacctttcagggactaaactgtgagtaggtcataaggaattagagattgatgttttcccaggtgtgtcactgaaacactgtctgtgttaaatgaatcttaccccgtaataggcttactggctaaatttgggagatgctgaaagctgtgtatagtttgaatctctctttccctctctctctggtgttctgatacagaggcaaggaaagatgaataaaattacaggtagaaagtaagtttccatctggtggcctagatgttactaaagcattggttttcaaactttagcccacttcagaataacctggaggacttgataaaacagattgctgggttctacctagagggactgatttcacatgtcttgggttgctcctgaaaatttgcatttccaacaagttcttagttgacactgatgttgcttgctgatttacggaactgggaatcacatattgagagttacttcacttgagtaagaattcaactgtcaagagtgtcaagattggttaggattttgatctataaatataggaaatagctgctgtggggcaatataataggaaattagagccgattaataactttgagggactttgacagtgagacagtttgaatttgtagaggactcaagcagctatttttaatgacttttttctctagcagtgtgaccttccagagagcaggaacagaaccacagcagttagtaaacaattttgagggaatcctgcaggctgcttatgtcaaatagtttatcatcaagcactccatctttgctttgcgttacgagtgccaagatggcagctctatgatctgtctgcccttagcccatctgcttcattttatttatttatttgtatgcttattatttattcatttattgattttagttttaaaagtggtatgtggcagaggttttggaatatagtaaagtgtccatcaaatacagtcaatagtttcatggctttgggtaaataactaccctgtctcttgttttctcatttgggaagttttaaaatagaagaatgaaaaacttccaggcctccctttatgaatgtaactgataaatctttaaaaatcttaaagaattacattttgggagaatcattagttaggtttctgcctgaggagagtcccatgtagttctttgtaagtggctaaatattggacaagctgggtctcttaaaggtctgtagtatttctggcagtaagttgtactaatgttcctggatgtctgtacttctcaggcgttgccagtgaaatgttttcataatggattgtgccttactctagttctcactcgttttaactgtcacttcctaaatgactttatagtatctgtactgagcctggaataggaaggaaccacaagaaatatatatatagacagacagacacggagtctcactctgtcgtcaggctggagtgcagtggcgcaatctcggctcactgcaacctctgactcccgggttcaagcgattctcctgcttcagcttctggagtagctggggttacaggcatgcgccaccatgcccagctatttgttttttctgtatttttagtagaggtggggtttcaccatgttggccatgatggtctcgatctcctgacctcatgatccgcctgccttggcctcccatagtgctgggattacaggcgtgagccaccacgcccgacccacaagaaatgttttgaaacagatttggggacatgataggaaaggagaagggcaagtcctttctcctaacctttctcttatttctcccatacccagttcagtgagcaggtaagattgagaagtacgcttttccttccctgatttcttaaatacttgtcagggtttttgaaaccagatactatgctcttttcatagtgtcgtaattgcttattctttagaataatgtattttggaaactcgtggacttgtttttgataattttgctgaggaatagttgataacttggatatttaaactgataacgtgtacatacttaaagtgtacaatttgatgagttttgacatttgtatgtatcatgaaaccactaccacaataacaagatagcatatattttcattgtgcaaccctttgtaatgaatccactgatctgcttttcatcgctgtagactggtttacattaaaaatttaaatgaatggaaatatgcagtatatacgttttggtgggggggtgcacatgtttctttcagcataatcttgaggtttattcatgtttcttgtattaatggttttctccttttaattgctgaataatgttcttctttggatattctcccatttgtttattcacttgtttatgaacaattgggtgatttccagtttggggttattatcagtaaagctgctacaaatatttatgtacagtctgagtgtggaaaagtgcttttatttttcttgaataaatacctagaagtagaatggctacatcatatgctaggtctatgtttaactcttgagaaactgccaaatgttttccaaagtgcttacaccattttacattctaaagaattccggttgttccacattgttaccaacacatgatgcagtcacactttgttttcagcttttctagtagtatatgcatgtctgtcttgtggagtctcagtgtcttttttttttttttttttttttaaagacagagttttgctcttgtcgcccaggctggagtgcaatgacatgatcttggctcactgcaacctccccttcctgggttcaagccattcttctgactcagcctcctgagtagctgggattacaggcatgcaccactacgcctggctaatttttttgtatttttagtagagatggggtttcaccattttggccagtctagtcccgaactcctgacctcaggtgatccgcctgcacccggcctcagtgtcattttaatttgcattttatgcatgactaatgatagtgggctgctgatatctttggtgaagtgtttgttcagaccttttgcccctgctttaaacaagtgttggctgggcatggtggctcgcgcctgtaatcccagcactttgggaggctgaggcgggcagatcgcttgagctcatgagttcgagaccagcctgggcaacatggtgaaacaccatctctacaaaaaatacaaaaaattagccacctgtggtgctgcactcctgtagtcccagcttactcaggaggctgaagtgggaggatggcttgagcctgggaggcaataagctgagattgcaccactgcactccatcctgggtgatagagacagaccttttctcaaacaaacaaaaaccaaaacaagtgttgggttatctgtcttttataattgagttgtaggaattctttatatattccagtttcaagttcttatacattttacaaatacttttgatcagttggtgtcttgatttttgtactttttaagtttttttgaagaatagttttttattttgatgaagtctgctttatcagtttttctctttatagttctttttgtgctattttatttcatttctcttttggtttttctgaaagttaaatatctcagattctcattttttagctattggaccaaaaatgcataggagacagctataaagctaatagtgtgtttgccttatatttgtgtttattgttacaattttaaagtgtttatgattctagtatttttgtttgttctttttggttttttagacttgctaaagggcctgtgaaatagccattggttcagttcctttgttttgtaagggaactgagcaggttacatgactttgctaatggtgaagtttatgattatgccaagactgaaaagaccccaggtcctctgaaatcccacttcactcttcatttcccctttttaatgattttgttgctaaaattttactgcatactgcaacatattaaaaataaatttagttcctgtttattagtatcctcattgaaagcatattattaaaattattatgtagattagcttcctgaaagaatcatagtatccccttaaaatttcattaagtgaagatgttgaatttaacatatatttttttaattctttccaaaggtctgtaaacagatttggctaggattatttgatgatagatcttcagcaattccagacttcagggatccacaaaaagtgaaagagtttctacaagaaaagtatgaaaagaaaagatggtgagtgaagagtttgtatgtagaataaagcctccccaaatcacatattaactatgggtaaggttagtctgacacaatgaaggataaaagacagacagtgagaactagataggtatataattcattatcccttggctttttgttggtttggtttctgaaaacctttacttctactttatcttaactcatctgttcctggcagcaggctttttgttgtaataattaccaggaaagttagggattcttccttctaatcattccctatctctgttagcttctttaaatatgttttgccctacaaagcctccgttcttaaaaatcattaatttagcaagtatttactgagtcatatctttttttaatttattgagtttcatcttctgtatactaggcactatgctaaagctctggtgtagtaatccatctacttaattgtctgttgtagcctttgctcaaaatattttttcttttgacctaagaaatcagtttactttctggttaagaagggagcatttacttttccctaactaaatctatcagatgttaatttttaaaaattaattccaacaggttgtacatatagctagtaagccccttgctatggaatagggactatatctataaagctagtgttcagctactgagggttcttcatttttagctatatgagcacaatttaagttactaagactcattaactatgaacttttggttatttctttaatagtattgcatagtggatactttcatcttgggaggttaacaagatggggcagagagtcaaaatagagggaataaataatggggaagtaacgagcttcttgtttgcttgaggaactctgtttcaacccaagagaatctgttcagagcctgttttggtcctgagggaacatttgttgtggtttacagcagaggtctttaccttcattcaggagcacattagctctgacttgcatgctctatcaaaatttgtattcttactactttccaaaatagactacatttttctttttttttggagactgagttttgcttttgtcacctaggctggagtgcaatggtgcgatctcggctcactgcaacccccgcctcctgggttcaagcaattctcatgcctcagcctcccaagtagctgggattacaggcacccaccaccacgcctggctaattttttgcatttttagtagagacagggtttcgccatgttggccaggctggtcttgaactcctgacctcaggtgatccacctgcctcagcctcccaaagtgctgggattacagttgtgagccactgtgcccggcctaaaatagactactttttgcaaggcaagattagtcagggctatattcagctgtactagaagacatcaagtatgaaaatagattaaaatacaccagtaaaatttaagttcaggaaagaagaaaatactagaaggtgggttggtagtaaaaatatggtagcataaatgattcttttaaaatgaaaggtataattatccttttatcattttggttctgaatttcctagacattctaccctgtaggaaagactgttctccttacatagccctaacctagttttgttttctcagccgtgttacttttaccaattcagaaagtgagtttggttagggattagtttatggtcagctctagctatcaacagaaaagtgagtgtgagtaacagttggtagaattaaaatcatagatccttacccccacatttataacagtaatgtattattcattcaaactataacgcaaatacctagaaacctcaaataattacagtttatgttattttttttctttcctgagaaacaggataataagagttatacaaatagagacttcaagtggtgggacaggtgaccatcattaagagggccaggacctgtatgtttttaatccagactgctgcacacctgtaacatacagctagcaagcagtgaaattggtttctaacatggaataagcactatccagatgcagcatctctaaaaatactcactgtaactatacttaaaacagtgatgatggtgttacccaaagggattttgaaactgttcttttgaccagttctcaaaatcactttctgtgttatactagaagacatcaggtatgaaaatagattaaaatacaccagtaaaatttaagttcgggaaagaagaaaatcctagaaggtgggttgatagtaaaaatatggtagcatattactttgccaggtgagtcttttgaaccaataactatcatttgattttatcctttgataagacttggctatactgaagaatttgtattagtagtatgctaaattatgggaaaatataacttcttgtattcattctcatacatcttttatctctcccatttacttgaaagcagttgtttgtgattattatgtagtttagtgacagtgaacacttagttaacacgtataccaggaattgttctcagtgctttacaaatgttaacttgtttaaacctaggcaactctgcctctccattttataaatgaaaaaaatggaagcacaaagagttgaagtattaatagtttgcccaaggtttcacagccatttagtggtagagctgggatttgaactcttgtctctggaacaggtgctcttaagcatggttttccttctttcctcacctacttcatatggggaataagaaggagggtaggacaaaacccagaattacaaagagcaaaagctctcacataatcccacacctagaggtcaggattgcctatgtttggacattattatatccttgctacctctcctttcttgactcgcctcctcacataaatcatgtgtttatatgactggaatcaaatctgaaagacctgtgaagtttcctctttccatgtcaaagcagagtagctatgagtattgtattatcgtaaattttttttccttgatagatgttgggtttgtttcccagtttttgtgaaattataaagagaggactgtggttaacatccatgtgtacatgcatctgtatacgcttaccaattcttaaggatgtttctggaagtggcacttctggtgcacaaagcacacctatttatatattttagtaggtagcaataaaaaattgtaaagttcacacttagctcataggtgaataaaaccttaatttgcatttttgtcaggttaaaagtgttttcatttttgtgtctcctgtcttctgtgaattgcttcttttgttcatttaaaatgggatgatcttattcttacagatgtaataagcctttatattttaggctgttaactgtaatattacaaatgttttcctacctcatctttcttcaaatgttatttagatcttaagataattttaaaaattatagtatgaactattcatggtgatgactaattgtaggtcctctgtttaaaaaaagcagttatttcttatattgtacttaatatcttagaaaaaccataaataagtaattgaaacaagttttgtggttagtcttctcttttctctgagtatttcaaatatttaatgggtgtagtcttaagctgtcgttccttttttaaaaaatatgcaaagttattctgtgtgagagggttttcagataagattaatggtgaaacaatcttgtacaaagttagaattaagcttatcattttttgatatagaattacctacatttttttttagttaactgttttttacatgttttaggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcaggtgagtagtctttgaatctttgtagggaattcgacttaaagagggcttgagtatcaagaatttgagaattgtttaagacagcagcataatcttgtatgccagtagcattatgttccaatggtttgttatacattaagaaattgttggttaagtggttgaaatgtatatatacttgttctttttgctattgctaatatgagtttctttgacttctctgcaactttgtaaaggtgagttatacaggaatgttgctatagctatatatatgtgtgtgtgtgtatacatgtatatatcatgtgttatacaatttgtaaaacatgaatctatggtgaccatcagagttagaatgtatagtctctttgatacacttttctaggaagggatttctttagtagtagagttttcccacatgtgtgattgtgaagcatgttgatcattgaaacacaagggactttgcattataccttattcttaaaaatgaacaaaatggaatattttcataagttgctacctaaagtttgtcttctacactttattatagttgatggggctgtgacagatctgttactgtgtggcattgcagcctctatcctatacaagaatggttcagaggcgtagtactgtggattaaatcctgccctttttgatgacacatactaagacatttagataaatttctctgttttcacaaaagattgagtgaaaaatgagaaaggttaactcagcatactgtaactcttcgtatgtataagtgtgttttaagtttgcagatagttttgtataaagattttgcagatccgactggaatatctttatagttaatatgtggtttgtagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcaggtaagtgttttttcccaacagcttttgctggggatgcatataaaacaccaagaaacatcaattctttatcacactttgaggatcagtaaacattttttgttgaaaatgttttgtcacttgtaactgttgagctgtaatatgtaaccatataattgtgttgctttttaatcacagaagagattatatttaatgtcggttggcatgacctctttccgtggaaaaatggggaaaggatgtaatgtctattttttattctttatgaaattgaaaatattcaaaagtaattggatactctaacgtttatgtgctaatcactcatggctaatcttgtttcatttgtcattccactcactgtcatattattttgaagcaaattttagacatagtattagtttatccttaaatattgtgtatatcaatctataaaacatactttttttgttaaatataaccacattagtagcatcattccctaaataatagtagtaataataattcattaggattcaaatgttcattatagttcagatttttccatacacatacatacgtacatatgtacatacatgcatatatacatacatacagtttgtttgaatcagattttcaacaaggtccacagactgcaattgtgagacatgtctcttaggtctcttagttcataagatttttcctgtattccttctttttcctcctctgtaattagtgaagaaatttgcttatttgtcctatacagttttcagtagtctgaattagttgattgcaccactatggtgccctgtaacaagttcctatgttctatttcttgttattaggttgttggatccagagacttaatcagttacaggttcttcctattaggaggatgggtggctggggatattcttactacttgggatttaagaggcatgtaattttggattgtgtttttataatgttagctcttggtgctcagtacccgagtccattgcataaaaataatgatgttctgaatttattccttcacttattagctgaaatactatttaaaaatctttatctggtggcatgatttgtttaggaaagtcagaatacatgattcttttccatcagatatcagaataatgagttgatttcctagcattttataatggtgacttttttctttagtatcattatgacttcatagattaaaacatttgctacatctcagtttgctgtcattattatccttagtagtactcaaattagcccaccttaggagtaggaacattgtgaggttggttcctatagatacaactcattcattcattcatttatttgaggtggagtctcgctctctcgccgaggctggagtgcagtggtacaatcttactgcgacctccgccacctgggtttaagctattctctcacctcagcctcccaggtagctgggattacaagcgtgtgccacagcacccgaaattatatacaaatgtaaaattttgtattttagtaatacaaaatactaattttttatttttaatggagatggggtttcaccatgttggccaggctggtctcgaactcctgaccttaagtgatctacccaccttggcctcccaaagtgctgggattacaggcatgagccactgtgcccagcctctttttttttttttttttttttgagatggagtctcactcccttgttcacactggtgtgcagtggcacaatcttggcttaccgcaacctctgcctcccgggttcagccaattctcctgcctcagcctcctgagtaactgggatcacaggcgcccgccaccactcccggctgttttttgtgttttttagtaaagatggggtttcaccatgttgaccaggctggtctcgaactcctgacctcaggtgttccacctgccttggcctcccaaagtactgggattacaggtgtgagccactctgcccggccctaaagatacttttttgatagaactcttgtggtctttgaatggccttttctcccttccttattctcagatttaacatatttgttacaaacatgtttaatgcatgtcaccagaaattgggatttatggagttttattttgttaacaagcatgcaaaccttgcagaggtacttaggttaggtaatatttaaaaattgattattgaagtatagatttggtcacttgtatctctccttaattgtaatagcaatagtctgatagggaagtggcataatgtagtgaaaagaacctgggctttggagttgggacaacctgggttcagatgctggctttcttgcttattatctgtgtaactttgggcaaattacctaacatttctaagttttctattctataaattgtctttgataagtggcaaggttcaagtgagatgatgcatttaagtggtttaccatctaaaaggtacaataaacattgtttgtcttctctcttttatacacacttcatatatatgtacatacgtatacacatatacacttatgtatgtatgtttgtatgtttacatgcatttaagaaaaaggatcatactttatgacaagtttttatgctgttttaatgtttcagtcttagttaagattccacaaatggtttagattcatttcctaacagcttggtgatttcttgagtctttacagttgcttctttatgcttaaacagtgtaaaagcatacatagtatttgtgttggaaatgcgtatggaatctattttggatgccagtaagctgtgatgtttatatcatggaaagtttaccagtctgcattttgagtgattaaataagtatcaaaccaaatgtagaacattaatttaggaatttagtcattttatagctttattttgataatttaaaactttgctttatattattttggcacatgtgtatgaggtattggctaaagcttactcttttatttgtcatagattatgtaagttaaattatggacaagaaaaattcaagactgtatctttgtaaaagatgtatttcacaattttatgagcataacagaatccagtgctgatagaatggacttcctgtttgtattttagaacttactttgccttattttacttacctgtgagattgtgatggtttttcgttttctttcaatttgatgacctggcttctttttggataatgataatatgaagtatattatacataatcacactccaaaatatgctgtttgggatagtttgaaaaattgtagaaaaacttctctccagccacatttctttctagcaagcaataagggaaccttttgttttaaatattaataaaaacattttctaaggacatgctttagaaggaaactggcgtaatttttatatgtctcatttgtgtatttgctttaaaaaggagtcctaggatgacatggatctcttttttcaggaaaggttgtactgagaaggataagaaattttgggtttcttttgcttaagttgttggagttgtggtagatttcccttctcctgtgttacctgagctgcaaaatcccagaaaacatggagaacctctttccccgtaaccctccagataagaagcgatttcccccctgaccagataaggaccccaactctcttttttcacctcttgcgtttgagtgctggtaaaaagagttggtgggagagccaataaatagagtaaaacttgtgtaatttatgaatatattctggttttatctccattttaggattattgaaatgtaatgcaaaattactgataaccaccaaattcttttgtaaatttgcaacttatttcttgttccctttgtttttctctctttaaatgcagtttgtgagtcttcacaggtaatgttggacttttctttgtagccctattggccaaaaatggttagacaagtcactgcaactctacagactaatttgtaccatggttgcactaatactttcaacagctcccttaaaatgcactttgaaaacaatagccatcatttaattgtaggatatgcagtaaaggaaaagaatcttatattttgatcagattgatagaaagtggttaatcttaactgttttgttccttgtctgaagaaagaatgaaatagctacatgtaggctgtgagtcaggctgcctgagaggagttgttttttagtctgaagttcttaattacaaatgactgctcagattaccttttttttctttactttatttgacttttggtttcattacaggagaataaaatgtatatgtctgttacaagaagaaactactgaattactcatttatttttccttctactatggttgataccatcttttgacgttttgccttggagtagtttttagttaaatactaggtcatggtttaactgaaatgtctttttccagagcctttccaagcattcagaatccttagttttccatatatagttcagaaagtcattgattgccaatttcttctcatcctgatattcttgttaattttaaaaaaaattaggtgaaaattttatcctgaacagtttgatacgactgatggaaccattaatggcaaatgataattattcacatatgccagtctggttcattagcattgttttgtagggaaactttttcttttgtagataatttagtgtgacttaaaagccagaagcctttagtcttcatgtgagcattcaggctgaggtatagtatttgtggatgtgtgttgctgggtggggtcattattgggttcagaaaaagtcatcttctacagaaagacgcatgaagctagaaataaaattcacctactgaatttggttattttgcctgatgataaacatcatatcccaaaacctgtgcactgtaaactgtaattgatttttgtcacattctatactgtaggatctaaacccaactgccttgcaactcaggtaacacaaatgagtagtataatgttgtgtttaaagaactatggtgccctttttaaaggggatgttctaatctgttaccacatggaaataggggtttaggatactagatatattgattttttttttttaataagagaagctagaagtctttttgtttattgtgaagtgccctctttttaaatgttgggaattcatgggaaataatgttaaatactatacagatgaaacaaagcatatctgtcagatgaatttgctgagggctgctagtttgcgtcctatgatctatcttcctgtctcatgaatatgtgtttttctttgaagaggaatgacaactattagcaagactcaggctcattaatttggggtcttaagttccacactaagttgactcctttgtactttttgaaatacgattattcaagaaacagctttaccattgtgttacattctgcttagcttggatttctttgtacagagattgcctgagtgtccagacagtaatttttgtattactgaatttattagtgttgaatttgcaaagttgtgttttccaaagtttcattctgcagcacttataatcgattgttgaagatagtgaatagatcagtacctagaagtaaaaatggatacaagtactacaaagtcctgtcttgcctatttaataggtattctattaatgtttggggctctgaattatatgctataatttctatgctagcattcattgtttcttaaattttaatgagtttaaaattgcaggcttctaatagaatatgaatatcttcaatttatttggtgatcttgtcctttttttaaatttttatatatgaccatggtgagacatttgtaaacttaaaaaaagctctattaattaaaccatttttgtattattattttaagtatttcagttattattcagattcacatagttgattaccatttttaatcagtgaatttttccaggatgttttctacatctttgtctgctttcctataactcagtactgtaactcagtactctgaaatagtttcctttgttaatagagtcacttttatagtactgtgcttgaggtcatatacagagtattgtgtccaaatttatcattgcacaaagtgtttttggaaattcttggttactccttagtaaattacctgtaattgggttaaatgctggtagggtttaaaatctgattgctaagtgaattctctataaagtgagttttgatacatagaaacttttcatataattcttaaactcatgtgtcatgtattttcatttatagttttcatattcattaacatatgttgttccttaccatttacagctcagaattctgcaaatgcagattttgcaaactttgatgcatttggacagtctagtggttcgagtaattttggaggtttccccacagcaagtcactctccttttcagccccaaactacaggtagagcttctccagcattgtgcttaaatgtttactttacaaaacaaaactctctaaatgtagttttgaaaaattagtctaaacttaaattctgtaattatctgactttaaaatggttctatcttcaaaagctctggggaaacctgaactctttatttttttctatgttcatttgtttttctgcattatttggtatattgtctgtttgacaacatccattctcctccttttcctgcgcatgaatcttccttatatctaccatgcacacaggacagaggcatgacactactataagtatttctctctctctgtctcttttttttttttttttggcaatcctcctgcctcaggatggaatacaggcacatgccaccactcccagctaaattttttttttttttttggtagcagctgggtctcactatgttgcccaggctggtcttgaactcctggcctcaagttatcctcctgccttgacctcccacagtgctgggattacaggtgtgagccactgtgcccagccagtactataagttttttaaggttcatagaatccattgatttaggctgacattatacctcttaataaaggaagctggttgcttctgtagagctaaaaatgtaagtaattttcggggcaacaagcctgagaaaaatttttatatgtttattagacaagagtagattaatgatcacttcagtcaaacttggaaatagttttctgtgcaggaattggtgtttaaacattgaatactctttccataaattgtgctgttttcgtaaactcatggaacccttatttagatttttggctgattacttttctttcaacttttaactctgtgtattgtcttaaagccttttctttcaattttcttttttgttttttctttaactttcatcatttacataatttctggctgtccagcatttagaatgctttcatctagctgcagttttggtgaatttacttcagcttttcctcttcaggctacccacagtaagttctgttgtcaagtaggcatcttatactaatttgtatatttttgctatacttcaagggtttttccagttatagattgttaataattctttagtgataatccttcataaaaatctcttccaactctatttattaaactcagagttagagaacacaatagtagacaatcaaagagttacttggtttaataataatttgaaataatattctttatataaattttgaaagtttagtatgtactttgtttgccagctccttgtaacaggtcacaatattttacatacaaacatatattacttacctttaattgaaaccaccatgatttaactcttgaaagaaatttgatcagtgtatattttttttagaatgtataaaaacctgcttgatagaaagtgttcgtgtttttttaatagaagttcatgcattctgttttaaaattatctgtagttgtcttttctatcactttaatatataactgtgtatatatactgttttgatttctgaaactaaagtttagaaataaagaactaatatcccaaaaatgtaggatcaaaagcatagaatgaaatatactggttttagtcttttgatagtactttaaggaggtctctataatagagaacagattttaaagatggaacaggatatatataatagtggccattaggtgaattgtggtttataaagtcaaaaattgctataatgtattatgtactgtaattttaatgccttgaactatatggtacggcatgattttacagtggacatcttgatattgtatacacattaaactattatgtggaattaaatagtagctcttcaagtgaagtaagtataaatgtcaacgaccatcttttaaggaattttggatcaccgtaacacattttacacattgttaatcgctacccctgggattgtttaaactgtttcgtcatggagccacaaaagtttgaaatcctcctagtaagatactttgcatcttgtttgcagtctgttcagggagaactagtgaaaggctgtagtatatttggactagaaagtaactgaatctcaaaccaggtagtgtggagataccccctccatgaattacattcttcattccagggtaggtaatacacagaaacatgttactttacctgttgccaaggcctttgaaaaatctacttttacaaaattggaaaacgtcacttgtagtcaaaagccattgccagtcattgattttaatgttgtaagattgcttataggacatttaatttaggaagaaatgatcatacagtctatgagagggtactaggaaaagcttagaaatttcaagtgctctgtttattctgttacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcggacaaatatgcagcacttgctaatttagacaatatcttcagtgccgggcaaggtatcaagctttaagcaaaacaaatacaaatttgtgttaaacagtgctcttaatttggttgtatttattaaaatctgaacatgctacacttttctcagttgttgtatagaaattttgtctgcactgtcattttgagtaaaatgttcacttgacacattttagacctgaaatatcaactacaaaactgaagacatagggactgatttgtaaactttcagtcttactagttgagaaaaattttattttgtcctagaaggcgtgctttacttttctttggctataaagagccaagaaaccccattggcagagctgaatggaggattatttggtggtttctgtaatatatttacttcgaacaattttccgttaacatcttggtgggttttttatatttaaaaaaaaaaattcatgaattttacagtatagtcttgtatccagttttatcttaaggctagtagcctctacaaatgcatgtggcactggtgaatagcaggtgtgtgttgctaaatggaattctccattctgatctctgggcctgttttcctcctctccaaaatgaggataattctaagcattaaactcatggagttgtgttctaagtattattgcatgttaaggcatatagaacagtgcctagcacatagtaagtcctcaataaatgtttcccgttattaccatctctaatttttttgtggagaatgctggggaaatgatgctattgatagactgttcacattaggtctagcattatatgaatttatatgttcatgtgaacaagatccacccgtcttggagatgttaacgtaagagcacttgagagtttctttcttatgcataatccagacaaatttttttggtacagagtgttaatttttgttaagagacatattctgtctttatcacagtggtatgtataacaactaatcctgtccagtatggtccaggttatttattagattaatgatttggaatcctgcttaactctaaatccattttaagtttacccgtgtttcatggcaaatgtggttgataagttgaaagtgtaactttaaatttttggtgtaacttgattttgttcgttcccaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcaggtaccttgtcttagctagccctcctgctttgtgttttatcttttttttccaactttgaataatcaattaaaaaatgactgtttcaaggtataattttaaaattcttggatatttttgtaaatttgaggaatttgaatttaaatgctaattaaaatataatccttgaataattgccataattttatcttttcattgaatcagacgttttgttatgttctgtccttgaacactaaaccgtatttgagagcatgtacacatctcaaaatggacagttccttacagattgtactcagcagagaatccatttagtagtcaaataatatactttaaaaatagtttttagtcatgatgattaaacagtgaaagtcccatattataggcttagttgtaaatacagatttttagaagtgtttgcaccaaagcccaaaatcaattctgtatctcttcagtgtcatcctcatatttacaaataagcacatctgctgttatgttcatatatatctgttagaattcttggcagtaggaagtctaacacattttaggacattacacttgtaaaaaacttttctagtctttattttagagttgcggaaatagtctcagaaatacaagagatttacctataacaatgttttattcatctctgttttccaatcctgtggattgtatttactaatttctttagttatcctggtagcttattttcctttagcatcttttctagaaagaaatgttaggattgtaacacttccggaaacataaagtctggaaacatactttatatataatacatgatttattgatattacattacagtacatcaggggttcacaaactgtggtccatggaatgtttggggtacctgagaccctttcatggggtctgtgaggttaaaactttctttataataattctgagagattgtttaccttttcattaattgatatttgcattgatggtgtgaaaacaatggcaagtaaaacttgctggtgtctttttatttttttttaatactttaagttctagggtacatgtgcacaacgtgcaggtttgttacataggtatacatgtgccatgttggtttgctgcacccatcaactcatcatttacattaggtatttctcctaatgctatccctcccccagccccccacccccgacaggcccccaagtgtgatgtttcccaccctgtgtccatgtgttgttcttgttgttcaactcacacctatgagtgaaaacatgcagtgtttggttttctgtccttgtgatatagtttgcttagaataatggtttttgctggtgttttaacatgaatattaagatagtggcaccaaactgtactagtcgttacaatagtcatattccttcccactacacattcagttttacttgtattttttatttttttatgatgattcttaatgaagcagtaacaattgtttattttattacatctttacacttaaatgtcttaattttctttgtgttgatactgatgctgtgatacacgatatgttcattattttatggctaccctgtaaatcgttactttcttttttttttaagaaaaaaaatgaactctttcaatatttgttctcagcaatgtttttggaacagtgccagtggttgcttctgcacagacacagcctgcttcatcaagtgtgcctgctccatttggaggtatgtgcttctggtatatacactggtttttacaaagaacccaaatatatattgtgtagcattttcttaggagtcaaagcaatgatttgttatcagaatccttgagttttctgtcttgataaatatagtgaaataatttaaatcttaaatacaaaatgtattaggattttatagtgtattttataattttttaaagctacgccttccacaaatccatttgttgctgctgctggtccttctgtggcatcttctacaaacccatttcagaccaatgccagaggagcaacaggtaagaaaaagagacagtggaacagtaagttttggggaagacatttatcaacaaagacaccatgtgaagaacaccagaaaatggggcctctttcttagtgaagtgaatggcaatggatagaagagtttgtccataaagacaaattctagctgaaagttcataaaatcctggaatttaacagttgagagggaccttagaaattatctagtgtctgccctttccagttaaagctttcatttttcaggtagggaagcccagacatggagatgagactccacagaacgtttatgacagagataggacttgaacagagcaatttagatgtatttggtggtctggtttcagaattactggttgtcactcatgcagtcttaatggaaccattttatgagaagtttttattttccctatgagattgcatcagatgactttactacatgaattcttaattattaggtctttttctagtgaatatctctttcaggtgttaacattttttaagttgtggaaacttgattcagtcgtgggtataatactgaatattttctcttttgataattttttcccttaattctctttgttgtctccattttattttttgattcatactgtaagccattcacatctttctcatgttatacctctgatttttgtcgtattaccttaaacaccagagatatttgccagtatcttggaatgtcagcaggtgcatttggtatggctgggtatccattaaatctagagtttgtatgctttgtttttgtgtatatgtcacaataatttagaactaaagcctaaactccagttatagcaaatgttgatatgaactcttgagagattaggtacttgtaacattttaatcaaaccattaagaattactagtttttagtaaatctctttgtcattgacaagattaagaatcacagtattaggagtttgagctgtaactattttcttttcacataaatgtcttcacttatactctgttggtaagtagcataatagatgtttgataagtattggaatttcacacaaaatttaactttaaaaaaagtttaattcaagtgtacctaatgaatgattgttttaaatttccatttgtacaatttatcaggtgtgtgatatgtgcagtgtttctgtttcttagcatactgttttgattttgtggactgagtttgtaaaatgtctcatgatacaatgggtttttgtacattgcctcatttaatccactcagctgtcatcaaataaatattttaattgtgtgacagctgagggaacaggcccagaaaagttaattgaacatattttgagtacagccagccaaacttgtgttcgaattctgatttatagttacttgcaggttgaccataagaaagccttttgaattttgttcttttaatgaatggggtaagaatgatagggggatgttcaaacatttattgtgataaagttgttcacaagatgctattgagatatttatagatattataacttcacttaagaactgatgaatggaaactcaaattatgttttgactgagcctaatcatgttgacctgacttctctgagccttcatgttgtccctctctatagaatgtgaacaatattctcttgctggcaggtttgttgtaaaattagatgatgcacatttaccctgtatggtctttgcgttacagcatatgctcagtaaatcagacctattattttcctttcatgattgtacctctgagttggttctatcattagagttaagggcctttttttgcttattttatttagagtatgcaagttttgtaaaagttgaagttctacataggatataaaataatataaaatgtacaacgtatgtgcagatgatataagataattctagtattaagtaacaaaaatttattagaaaggtaaaacgacagtgtccacaaatgtttatttcaaggtaatacattttttccattataagtcattttgaatttatcacgttggtcacctttattagattattattgaattgaccaaatcacaagcattaactgcatatgtttctattgaagctgaaatataaacaatacttcgacagatgcactacgcttaagaatttccagtgttttataccatcaaagttaatattatttaagaattttttgttgccttcaaatacattaacactggccaggcacagtggctcatgcctgtaatcccagcactttgggaggccaaggcgggtggatcacctgaggccaagagtttgagaccagcctggccaacatggtaagaccctgtctctactaaaaatgcaaaaattagccaggtgcggtggtacgtgcctgtagtcccagctacttgggaggctgaggcaggagaatcgcttgaaccagggaaatggagtttgcagtgagctgagatcatgccactggactccagcctgggcgacagagcaagactttgtttcaaaaaaaacaaaaaacacatgttaacactgtgaaattatattttgaggtaccctttgatcctagcactttgggatgccgaggtaggtgggttgcttgaagcccaggagttttgagagcagcctgggcaacatggcgaaccccgtttctacaaaaaataaatggtggcagacacctggagtccttcctagctactcaggaggctgaggtgggaggattacctgagcctaggaggtcgaaattacagtgaactgtgattgcgccaccacacttcagcctagctgacagagtgagacttctagctcacaaaaaaaaaaaaaaaaaaaaggaggtacccttattgcataatagttctatgtgaaattcggaaagttttatcagtatatttctctttttgtttgttggtttgttttagacagattctcactctgtcacccagactggagtgcagtggcttaatctttgctcactgcagcctctacctcccggattcaagcgattctcatgactcagcctcctgagtagctgggattacaggtgcgtgccaccatacccggctaatttttgtatttttagtagagatggggttttgccatgttgaccagactggtcttgaactcctggcctcaaatgatctgcctgcctcggcctcccaaagtgctgggattacaggtgtgagcgactgcacttggatcattcttaaaatgatgtttaaataatcattttttctggatttataaaactttggggctttagttttttttttttttactttaagttctagagtacatgtgcataacatgcaggtttgttacatatgtatacatgtaccatgttggtgtgctgcacccattaactcgtcatttacattaggtatgtctcctaatggtatccctcccccactctacccgaccccaagacaggcgccggtgtgtgatgttccccaccttgtgtccaagtgttctcattgttcagttcccacctatgagttagaacatgtggtgtttggttttctgtccttgcgatagtttgctcagaatgatggtttccagcttcatccgtgtgcctacaaaggacatgaactcatccttttttatggctgcatagtattccatggtgtatatgtaccacattttcttaatccagtctgtcattgatggacatttgggttggttccacgtctttgctatcgtgaatagtgccgcagtaaacgtacgtgtgcatgtgtctttatagcagcatgatttataatcctttgggtatatacccagtaatgggatggttgggtcaaatggtatttctagttctagatccctggggaatcgccacactgtcttccacaatggttgaactagtttacactcccaccagcagtgtaaaagtgttcctgtttctccacatcctctccagcatctgttgtttcctgactttttaatgatcaccattctaacttgtgtgagatagtatctcattgtagttttggtttgcatttctctgatggccagtgatgaagagcatttcttcatgtgtctgttggctgcataaatgttgtcttttgagaagtgtctgttcatatccttcgcccactttttgatagggttgtttgattttttttcttgtaaatttaagttctttgtagattctggatattagccctttgtcagatgggtagattgcagaaattttctcccattctgtaggttgcctgttcactctgatggtggtttcttttgctgtgcagaagctctttggtttaattagatctcatttgtctattttggcttttgttgccattgcttttggtgttttagtcacgaagtccttgcccattcctgtgtcctgaatggtattgcctaggtattcttctagggtttttatggttttaggtctaacacttaagtctttaatccatcttgaattaatttttgtacaaggtgtaaggaagggatccaatttcagctttctacatgtggctagccagttttcccagcaccgtttcttaaatagtgaatccttttcccatttcttgtttttgtcaggtttgtcaaagatcagatggttgtagatgtgtggtattatttctgagggctctgttctgttccattggtctatatatttgttttggtaccagtaccatgctgttttggttactgtagccttgtagtatagttttaaagtcaggtagcgtgatgtctccaactttgttctttttgcttaggattgtctaggcaatgcaggctcttttttggttccatatgaactttcaagtagttttttccaattctgtgaagaaagtcattggtagcttgatggggatggcattgaatctataaattaccttgggcagtatggccattttcacgatattgattcttcctatccatgagcatggaatgttcttccatttgtttgtgtcctcttttatttcattgagcagtggtttgtagttctccttgaagaggtccttcacatcccttgtaagttagattcctaagtattttattctctttgtagcaattgtgaatgggagttcactcatgatttggctctctgtctgttattggtgtataggaatacttgtgatttttgcacattgattttgtatcctgagactttgggctgagatgagggggttttcgaaatatacaatcatgtcatctgcaaacagggacaatttgacttcctcttttcctaattgaatacccgttatttttttctcttgcctgattgccctggccagaagttccaacactatgttgaataggagtggtgagagagggcatacctgtcatgtgccagttttcaaagggaatgcttccagtttttgcccattcagtatgatattggctgtgggttcgtcataaatagctcttattattttgaggtatgttccatcaatacctagtttattgggagtttttagcatgaagggctgttgaattttgtcaaaggccttttctgcatctattgagatactcgtggttttagccttggttctgtgtatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtggcgcgatcttggctcactgcaggctccgcctcctgggttcacgccattctcctgcctcagccttcccagtagcttggactacaggcacccaccaccacacccggctaattttttgtatttttagtagagacgggatttcaccttgttagccaggatggtgtcgatctcctgacctcgtcatctgcctgtcttggcctcccaaagtcagtctgtgtcttttaattggggcatttagcccatttacatttaaggttaatattgttatgtgtgaatttgatcctgtcattatgatgttagctggttattttgctcattagttgatgcagtttcttcctagcatcgatggtctttacagtttggcatgtttttgcagtgactggtaccggttgttctttctatgtttagtacttccttcaggagctcttgtaaggcaggcctggtggtgacagaatctctcagcatttgcttgtctgtaaaggattttatttctccttcacttatgaagcttagtttggctggatatgaaattctgggttgaaaattcttttttttaagaatgttgaatattggccaccactcttttctggcttgtagagtttctgctgagagatcccctgttagtctaatgggcttccttttgtgggtagcccgacctttctctctggctgcccttaacattttttccttcatttcaagcttggtgaatctgacaattatgtatcttggcgttgctgttctcagggattatctttgtggtgttctctgtatttcctgaatttgaaggttggcttgccttgctatattggggaagttctcctggataatatcctgcagagtgttttccaacttggttccattctccccgtcactttcaggtataccaatcagacgtagatttggtcttttcacatagtcccgtagttcttggaggctttgtttgtttctttttactcttttttctctaaacgtctcttctcactttatttcattcatttgatgttcagtcactggtaccctttcttccacttgattgaatcagctactgaagcttgtgtatgcttcacatagttcttgtgccatggttttcagctccatcaggtcatttaagatcttccctacgctgtttattttggtttgccattcgtctaatctttcttcaaggtttttagcttccttgcgataggtttgaacatcctcctttagctcggagaagtttgttattaccgatcttctcaagcctacttctgtcagttcgtctaaagtcattctctgtccagctttgttccattgctggcgaggagctgcagtcctttggaggagaagaggcactctggtttttagaattttcagcctttctgctctggtttctccccatctttgtggttttatctacctttggtctttgatgatggtgacctacagatggggttttggtgtgggtgtccttttttttgatgttgatgctactcctttctttttgttacttttccttcaaacagtcaggaccctcagctgcaggtctgttggagtttgctggtggtccactccagaccctgtttgcctgggtatcaccagcggaggctgcagaacagcaaatattgcaaaacagcaaatgttgctgcctgatccttcctctggaagcttcgtctcagaggggcacctggctgtatgaggtgtcaatcggcccctactgggaggtgtctcccagttaggctactgcgggggtcagggacccacttgaggaggcagtctggccattctcagatctcagactccatgctgggagaaccattgctctctacaaagctgtcagacagagacgtttaagtctccagaagtttctgctgccttttttcagctatgccctgcccccagtggtggagtttatagaggcaggcaggccttgttgagctgcagtgggttccacctagttcaagcttcctggccactttgtttaccaagtcaagcctcagtaatggcgggcgcccctcccccagccttgctgccgcctcgcagttcaatcaagactgctgtgctagcagtgagcaaggctccatgggtgtgggacctgctgagccaggcgcgggatataatcttctggtgtgccgtttgctaagacctttggcaaagtgcagtattagggcgggagtgtcccgattttccaggtaccgtctgtcacagcttctgttggctaggaaagggaattccctgaccccttgcacttcccgggtgaggtgatgccccgccttgcttcggcccacactccgtgggctacacccactgtccaaccagtcccagtgagatgaacccagtacctcagttggaaatgcagaaatcacccttcttctgcgtcactcacgctgggagctgtagactggagctgttcctattctgccatcttggaactcccttctggggctgtagctttttaaaaaactgtaatattacatagtaactctcattaggagattagcctattgtggcctaattttcagattctatgatatttagtgtttttcccccctcagagcccttaaatctaattaatagaggttaaaataatttttaaatagtaggaaatttttataactcttaggtctctcctttgtcactgaatggatagtcattatttcctaccatttattttaatgaatgaatggtttcaaagattttttttccctaaggaaaggtacttaccaaaatgcagagcttattggatggcatctggccctcagatctttgtttattacctaggtggaaaccaatttgctaagattaatgaatttgccttaaaggttcaaaattcagtaatggctgatctgatattaatacccagaatgcttctgaaccaacactgtttttgttccagtacagttgcctccatatttatacttcagtttcacattgatgaaacatacacaaattaacattatgcactattccttatatctaaatacttagtaggctcacttcacttgcctagcatactcaggaagtgaggattaatacaaaaaagggttggaggtagctgagcaaaagcaaagaaaaaaccctaagtagaaagttaccttgggctgtgaaggatatattttgtttatagaattgctgctgatttgctctccttgtgctctttccctctcaatttactcttaatatttggacatctctaatatttaataatctacaattggtattttaaaaaggagccagaaatgaaaattgttgccaatgtggtaatcaaaacaagaaagacaggaaagttgtaaaaattaacacaacagaaaaattaagcttaatagcagtctggagaaaatatttgcaaatcctacatctgataagggacttgtattcagaatgtgcaaagaactcgtaacgactaaataataaaaagacaccccaattaaaaagtgagcaaaatatttgaatagacatttctctaagaaggtatacagatggccaataaaagaaaagacagtgatgaacaatgtaaggaggtagagaaaatagaaacctcgtatattgcttgtgggaatataaaatggtacaaccccttggaaaacattttggcagttcctcaaaatggtcatcatggagttaccatataacctaacagagtgccactattaggaatataccaaagaggaatgaaaacatagatctgcacaaaaatttgtacacaaatgttcataccatcagtatttatcatcgctaagaagtagaaacaacccaagtgcccgtcaactgatgaaaccaaatgtcgaatagtcatacaatgacaaattacttgataataaaaagtgatgaagcattgatacatgctacaacatggatgaaccttgaaaacattctgctgagcagaagaaactcgtcacaaaaggccacatatttgtggtggccatttgtatgaaatgtccagaattggaaagaaaaagtagatcaatgattgccagggggtagggttttagtagtggtggggcagcatgggaagtgacagctgataggtatcacatttcttttgagggggatgaaaatattctaaaattagattctgatggtggttgtacatacctgtgaatatatttaaagaatcattgaattctgtaagtgaatgaattgtgtgtagtatgtgaactatatttcagaaagctgtaaaaagtctaaaaaaagtttagagcagttcaggaccagagcttggggggcatctttgttgcagactgaggtatagtgattaatattggttaacagtcactgttggctaaaagtcagtttttgccagtgcgttttgtgaaacatgtctcctgtaatgttgttagcaaaattctgtggaaaagtgttctatgtctaaatacatatgagaaatgctggaataaacacagtttaatcaatgtcattaatgcaagactgctctgagcctgtaaagtgctttaagataaagtagataaggccgggtgcagttgctcacgcctgtaatcccagcactttgggaggccgaggcaggcggatcacgaggtcaggagatcgagaccatcctggctaacacggtgaaaccccgtctctactaaaaatacaaaaaattagctgggcatggtggtgggcacctgtagtcccagctacttgggaggctgaggcaggagaatggcgtgaacccgggaggtggagcttgcagtgagccgagatcacaccactgcactccatcctgggcgacagagcgagactccgtctcaaaaagaaaaaaaagaaagtagataaatataagggccacattaatttttcacaggcccttctccctcagttaaccttttttttttttgtatttggaacacagtgacacttttttaagttagcaagaaagttacattcattgagtatttattgcaaagcactctaattcgttgttacatttattcttcacagcagctttgtgaagtatagatactattgtctctatccctccacctcatttgcaaatgaggaaactgaagcttataaaataaagtaacatcatgcagccagaaaatgacagaaccacaactcagaaccattcaattttttaatcattcttatgccaatttaaaaagtattctaattttaaatccatggaaatatattttagacacaatcttcagattgttaaaccgaacaaacaaaaggtactagtatttaacaatttaagtttactttctattaactttatatgtaacctgtctgtcctcaaacatgccaggtgagtaagatctgtacaagatgcctttttcttttttctctcttcttttcagccattgtattttaacctgtaaataccgcttacctttctcttgaactagaatatttaataatttttcccttgtaatacttaattagttcatttgagttatttgtgtatttctagttaatgtgctgatttgtaaataaaacaatctagcattgttcatgcactctctcccaagacttggttttgatcctaaatgtagatgctggataatctcatatgatcctatgaatagcgtatttagatgtagcttatgatgcctacaaagcattttttaatgactgtaaaaaagttgatgcctatttgtttaaaaaattgatttcatcactgtttcttaatttgttatttattattctaatctcccctttattttaaacagtataaatattacaggtcatgaagatggttgaaattaaaagtcttattttgtgaatgtgtttttgttatgtattatgctacccccttagcaacagtacactcgaattttataactttttaatgaaacaagtatacttttattttaacaatagttatctataaattaattgacgttggtctctttatggctttccataaggcctttctggagcaatgcattctcaagtgtttcctcacgctcattttggtaggtggccacaattaatatctagatttgtgtggcaatttgtctacctgcttgtggaagcttctgctagtgttctggatccctgcatgtggaattaagtttttttccatgttttaaaatggagtgggcatggatgtgtggcattgggattacattgtatttaaaattacatggaaatgtttttagtgatttatgtgtaaatgctgaaaagcattactgcttacctacatggtcatattagaatgttaatagccattttgattctttttcttgagtttgaattcatggtactttgagtgacgcctttttgatataccaaaccattttactgcattattccatggagtttggttttgcttaactgtattcaagttttgcttttaagtgctctcttaaagtgatttgtcaaagttacgtcggtgcattgtctgttatgaagccctcctgttacccttgcagtgtgcttattattctttaattcacctgcttcccaatggcctgtttttcctttttttcgcatcagtaataaaaaagtaattttttaatattctaattaggttcattgagcagaattgcattgttacaaacatacgactacagggattactttgggcaacatctattacttgtttttcagctttttaaaaataaaagacattccgtgtaatattttttagtatttaatttctgtgccttaaatcaatgaacaaattggtaaatttgttaaaatcaggaaatttagtgaattttcatggtattttgattgcatcatgctaagaatatttcattatgtaattactaatagtctatattcaaagcaacattattggctcttattttactgagacccttcctaaaacacatagttggaggttttgtttttaatattcactagtaataaataacatactgtaagtgaatagtaaagagggaaatgatggcagcattccacatatgtagcagttgttcacacacatttctcccgatgtggtaatactctgtccaccaagtaataccagcgaggcatggcaagccaaggaagaatacagtagcattgaacactttggccatttattctgcattcttctaggaatgcttatttcacttctaatctttatggatttcacactaatttcgatagctcagttgccctaaccttccttcagtctcgcaaagctgtcttcatttaccttccataagagggtgggagtcgtgtgtgtgtgtgtgtatggaattgatttaataggaaaatatccttttaattgtgttagtgttgttaagagaatctctcttctctggctgtagttacaaagctgcataggttctgagtggtctgcctgtaactaactatttgtcctataagtcctgttctttttagcgaactattcttcagcggtttaaaatttttttttgcaggaacacatattatgttatgacagatacttcaggagataaaattttggctgttattttactgcatataacaaaacaaaactaaaaacaaaaatgtatactagtatacatattaattgcatgatctttaaaacacaagactactgtttagacttgaatttataatttgagaaattgtcttgggatttcaaacaacagctttagtagttagtttcattctggtcattgtgttttagaagaataaaatttctacaagttacgttaaactgtgtagcactaaaactcattaactttgttggaattttggaattaaccctgcctttaatgtacatcttagtatttttcaaggtaaatgatgtctttttacatttacaatgttgtgagaaactaaacatatcctgttgtatgtaactgatcagcccttctcttctgtcagcggcaacctttggcactgcatccatgagcatgcccacaggattcggcactcctgctccctacagtcttcccaccagctttagtggcagctttcagcagcctgcctttccagcccaagcagctttccctcaacagacagctttttctcaacagcccaatggtaagatctaacatttggcgagctgtaagttcattttatgtatcctttttatatcataatgttgtgtgcttgggcaggaagacttttctaaagaatactatagtattatctactgagtgtttacacaaaaataaaagcctttggtgatttggacctcagaaagctaagtgattttacaagtttttgtgagcaggttacaatttatgggaaatcagtgactatgtaaagagcatcccgtcattctcagaatttctattgcctttttctgattatttcgtcttacatgttctaatatacctcttgattttaaaaggagaatttatagacctagaatgttgggatttttttttcctttcaggacagaaatgtgtacctttttgtgtgtgaaatagactacttttctaatttggtaactatactgtagttagagtttgttatttgattttagaaagagacaagaagattaactcgacatttttacgtatttcatttgcttcagtttgaagtgcatagatttgaagattcttgaatcacaactatgtggtttcttttttctttttttttttttttaagtaagtggttatttaaaaatctgaaatatgggctgggcgtggtggcttacgcctgtaatcccagcactttgggaggctgaagtgggcggatcatctgagctcgggagttcaggaccagcctgaccaacatagagaaaccccgtctctactaaaaatacaaaattagccaggcgtggtggcacatgcctgtaatcccagctgttcaggaaggccgaggcaggagaattgcttgaacccgggaggcggaggttgtggtgagccgagatcgccattgcactccagcttgggtgacaagagcgaaattccatctcaaaaaaaaaaaaaaaaaaaaaatctgaaatatggaccctggaagagccataaataataaaaatatttcctacaaaatactgtgatgtttacatagaaatcattgtgttgtctgcacagcctgttccaaatagtcacaagctcgtctagtaatgaaattctataaattttagttattgagacaagttagaatgaaagagctgaatgaaagttctcttggccaggtgtgatggctcacgcctataatcccagccctttgggaggccaagacaggtggatcagtcgagtccaggagattgagaccagcctgggcaatgtagtgaaaccctgtctacaaaaaatacaaaaattagctgggcgtgctggcgtgtgcctgtagttccagctactcgggaaactgaggtggaaggatcacctgagccctggaggttgaggctgcagtgagccatgatcatgctactggactctggcctgggtaatagagtgagatcatgtctcaaaaaaaaaaaaaaaaaaggttattttaagacatgctacagtaagtttgtctttggtatctgaaagagcttgaggcctaacaacttaactttaacattttatttttgctgctctggtaggaatgtctctgaaagttattatgaggctttataagcatcagattgtctcttgaaggtatgggttataattggtggttctattttaacaaggtgcaggttttgcagcatttggacaaacaaagccagtagtaaccccttttggtcaagttgcagctgctggagtatctagtaatccttttatggtaagcaaaatttaaaattaaatactttataagttgttaaatcttattttaaaattaggaatagcaggatgttaatattcctagatggtatttggtgttatatgagtgacatcataagattgtacaaattgacacagagccattatgtgtgatccttttctgaccttttaaaaaattagttgcaaatcaaagcattgatagtttttaaaaaattagttgcaaatcaaagcattgacagtagatcagctattttataatatgaaacttatctgctttcttgtcaaaataacactttatgagaggccctaggaattagtgaacataaaagagaggtcttaagagtcagaagttttgtttgaatcacacgtgcttttctaagaccattctaagattcttcttagaatctattacaagaactgtttgaagtactggatatgaaagacgtagcacagttcatgacacatagtagtttgatatagcttattgccaataacaaatattattgccaataatttaaaaaataattcttaaccaaaaagtctaattaaaaaaattaaattcagtttaatgtttttatattttgtacatgcactacttttgtctctttatttatttgtcttatgttttcctttagactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaatatgctattgtttttgtgttcttgctgcaatgcctttaccaaagtggccttaaatatgagtagtgaattgagaacatcttgaattcttaaaagacttcttagtgactttttataaaaaggccatgtagaaaatttattaaaactactatgactgctacattcaggaatatgccagtggtaaagcatttaaatgtagcttgtcagatttaccataatcctactaatttctttgcagcttattaattttgtgaaatttgtatatatgaagaatttgcatgtatgtgtatttacaaatttttctaagtatcttgaattctcagactgcaaaaggcctattttaactattgatttttttttaaaaaaattgtctttgaatgtattggaagtagacatgcattaactgtgacattattgcacctcagtttttttctttctttttttgggcaaactgatattatctataggatatttgtttatgtttgttttttgggggaaagaaactggaactcagtgttaccttaaagttacggaatactttgttttaaaggaaaagataataagtttagttatatctttttgttaatattcaaatgaacttgtttaagtatctatgtacagtaatgcctcattcatctagaggtaatctggcagtcttgtgaaaaccgaacacaactcagaaacttggaatcgttttttttaaaaatgcctctgagcaacccatataagtcacaaagtctgtgtgttagagcttatgcatttgtttttatgagagattttaataaatttaattatttgcttgtccagactatagcatattagctgtttagaagggatggcttgaaaggaaggagactgaaaaacactctgagagcatacactgtccaaggccattagtgtaaggaccgctacccagcctagaggacatcactatactacatcatctgatgattattctttattatgcctctaggtaattaagtaaaggtgaaattgcatacacagatatgtagtacatattttaaaagttttatcttaaattgattaaaactttttaaaaagctttggtattaaaagaggtaaacatcagtttcctcaaacattttattcatgttgaatgcctttttgcaatgatgactgagttgttatcatagtattttaaaacctgtatagtgttttagacttgttaaaacattgctgtctagtgtacatctagctaaaagtgtggtttatctaaaccgttttaataagcaagatgactgggaaatctctgccccttttctgagcagtatgcctcttcttttagaattaaatgaatgctgcacaggtccagatgtgtgttgatgtagacttgaaatgtctccacattttggaggacttcctcagcccttttcattgagggaaaatatatttgaatttctgttttagattgtatcgggtcccagttgattcatgtgtacaaagttatgctacctaattacagaccattacccaaatatcctaccaggctttccatctgaatagtaaattaaacagttgttatcaaaatgattttaaagactatttctttttctgggtaactattgaagtttgtaattaaatgggggctcttactgactttaaattagcgcttataaaataaaaatgtttagttcaagaagagacccaagctgggtatggtggtgtgagagcctgtgagtcctagctacctggaggtgaggtgggaacatcacttgagcccaggagttggaggctgcagtgcgctacgatcacaccactgcacaccagcctggggatagagtgagatcccatctctaaaaaatgaaaaaaagaagagaggtagctttaaagtggtttttctcatgatattcactgtttattattaaagaaaatcagctttcgttagacttttacatttagatttattctagttttatatagaccatcaaaattatgttgagtactaaaaaggagaaaaaatcctggaaggtaacaaggctgaagaccttcaaa

SEQ ID NO: 14761 - DNA, 36028 bp, Human
  misc_feature (1)...(36028): n = A,T,C or G
nnnntcgataccagcctggccaacatggtgaaaccccgtctctattaaaaatacaaacattagccgggtgtggtggcatgtggctgtaatcccagctactcaggaggctgaggcacaagactctgtctcaaaaaaaaaatgttttccaagagccacaaatggaaaaaaatcttataataatgttaggtgaattaattgaattttttaaaacacagagaaaacaactagaaggaaactcaccaaaatggtaatagtgaatcttgattgtcagattttaaagacatttttgatacttctcagtaaatgcctgcacatttcacatgtatacatttcttttttttttaataagaaaggaactattaaatcacaaatggctgattttcccataaactccaaaataaattatggaaattattttcctttagggaaaaaaatgctgtttcccctcaaagaggaaacactccaaaaaaatctagacgctgagagctcacacaatgacataagcctgcccactgacaagtacatgaaagtcctgtccaggatggcatatgagtaacctgagtccctggattctcacatagaactgcaagttttatgacaatttcatgtttgttacaatattctttaaaatgtttgtcaaaaatagcatccttgttttggtgtttcagctcttggattagtatgtcatcagtgtttattatacattaattttgcccaaatatgagaatattgatttcaatttatgagtatttgaaatggaaaacataatctcatttctcctggagtcttaagaatggctttgagtccaatttcttggttttcttcctaatgatctgtgaagtaagggagtctgcctcacatttgtacttcattcttcttggaccctgcattaataaattacatccctactttgtaactctaggtattgactctctggaagaagactgttgactgtgggaaccagaactagcccaagagctccttgaaagtggagatttacaatttcacaattgaatctaatgaatcccatgaactaactgcaaattaaatattggtcaaattagggtatgaaggaactccctgaatgcagccttgcttcaccgtggcttcctcttctgaaccagagatcacagaaagtgtgttgacccctttctcaagtcacctactataaatgcataagaagttaatcccttgcatgcaatggatgctatagggcattaagacttaattctcttaagcaacccctgttgagaaaggctacctggggtgctgaaaacgttctatatcttttttttttttttttgagacaaagtttcgcttttgttgcccaggctggagtgtaattggcactatctcagctcaacacaacctctgcctcctgggttcaagcgattctcctgcctcagcctcccgagtagctgggattacagacatgtgccaccatgcctggctagtttttttgttgttgttttttttgttgttgttgtttttgtatttttagtagagatggggtttctccatctccatgttggtcaggctggtctcgaactcccagtctcaagtgatccacccaccttggcctcccaaagtgctgggattataggtgtgagccatcatgcccagccaaaagctttgtatcttaatctaggtcatgcttacatgaatatatccatatataaaaatccacttacctgtacactgtatgtaaaaaatacttcaaaaacaaagtcaaatggtcaaccagcatcagtggtttgaagaattgctgaatcaaaatcatggccctactaaacaacaaaatagagaaagttattttttcaaataggaaccaatgtaatttgatttggaacttttaaaaaattgctaatttatcagttggttttattatcatttaaattttcataaaagcatctctagctggttgagagataagagagttactgctcagaatatttcaataagactaatcctacaacaatgtttattgttttttctctgtaggagaccaaggttttccaggtacaaaaggatcactgggttgtcctggaaaaatgggagagcctgggttacctggaaagccaggcctcccaggagccaaggtatgcaaaaattcaagctatcacagaagagagggtgggtgaccattaactggccagtttgtatgcacttatctggcagagcactctagatgtagaaattatcaatatatttgtagatgatgaagatattaaattttttaaatgtttctctggatcatcttccattttagaaaggaaaacataaggtgtcagaatgcagatttcatcgtgatatcatctttaatggtttcataaataatcagagtatttaaaatgggacaactctagaaagaaatgtggttagctataagaaaaactatcaaaagtaaaaacatctagatttttctctttatagacaatcccacagtcttctgaaaaagtggaggctacatatcctgaagtattattaaacataatcttacagaaaagtcagcaactagagctcaaaaaggaaagttgatgacatggtagtggctgtgcaacagggacttagagcctccataacagagagtcaatatcagtgaagatttggaagcactatatagtaataacacaatttctatgctgtagggagaaccagcagtagccatgcctggaggaccaggaacaccaggttttccaggagaaagaggcaattctggggaacatggagaaattggactccctggacttccaggtctccctggaactccaggaaatgaagggcttgatggaccacgaggtacaatagcaagtgtcattacttttctccactgtgagctctgctaaaatgcagcaaactgaatgtgaaggtgttctaggcatgaagaattctcccatccaatgttcctgccctacctttcttccttctttccttcttccttccttcttttttaatgagtgccctctagaaaaggcatattaatggcagtaaatatagatctgatttaggtggaaaaaaagttaacagaagaatgactggtacagcaataccaagaccttaagttctagcacctgggtatatacttgtgctttcttttgcaggagatccagggcagcctggaccacctggagaacaaggacccccaggaaggtgcatagagggtcccaggggagcccaaggacttccaggcttaaatggattgaaagggcaacaaggtaggaggagggcctcaaaactggccaccagaagggcaggagacatgagactcctgctctgtgctttgctgcttaacatgggaactgtccagccacaagtcctgaccactgttcaatgagaaatacttcagaagtgtaaaccttgctgttatgggtttgttgcacacagtagtgtgtaccacctataaaggaagaaacttgaagttaatatagtgagttgctttgtgtcttttatgcaagaaaaatatgaatgctgaagacagagattggtgtgtgtttacatatatttatatacatattaaattctcagaaaacattttacctttaatattttcataaatatattaaagtggtaagtttatccttattattaaaatagggtaaatgtatgcaatgataccagtttaaaaacttataaactaaaatatgtagttgattgttttacatacaatataaaagaaaaaacatgaaaataaatctaaatgatgcaggctagatgttccagatgatggaaaactttgtttttggatcctctcctcatcagatctgatgaactgttcctggaaaaatgtatttagaaatcagttaatgtctgtggtctatcatactgcttatatgttcacaaataaatttttgaccaagaccttaactgttacagtggcattattattttttccagaggcatccagtggcttacctctatgcgaacggctctgtatgtcttctgcaggaaacagagtgagcagcactcataaggtgcagtcccagaatgtgtctgcaggactagaaaatagatataaagactacacttgtattactgcataaatcattggagcagagaatgttagagccagaagggagctcagaaattttacagaggggacattaaatacatacacacacacatgcgcacgcatgcgtaagtgtgcagttaccccaaatcacaaagctaaatatttacagccataaaatatttctaaagtggccgggtgcagtggctcatgcctgtaatcccagcactatgggaggccgaggtgggcggatcatttgaggtcaggagtttgagaccagcctggccaacatggcaaaaccccatctctattaaaaatacaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttaattaattcattcatttattcgtacacaggcagaagaggtaaaacggggccaaagggagacccaggaattccaggcttggatagatcaggatttcctggagaaactggatcaccaggaattccaggtcatcaaggtgaaatgggaccactgggtcaaagaggatatccaggaaatccgggaattttagggccaccaggtatccttttgtgtgtttctatttttcttcttatttcttcttcttcttaaggtggctctgtcaactgtacataggcatacgctttttactctatgcttttacttaatataaggttttccttctaaattatttgtaagaaaccaggggccatggtgcagggaaacggtggcggcaggatgaacaattacccagaatgtggctatttttgctgtgtaatcctttttatatacgactactataatatacttgctagtattttgttgagaatttttgcatttatattgagaagggatattggtctgtagcgttcttgtgatgtctttggtgttggtgtcagagtaatgctggtctgatggaacaagctgggaagtgtttcctcctcttgtattttctggaacagtttgtgaagaatcgacgctctttaaacatttggtagaattcaccagtgaagttatctgggtctgggcatttctttttgggaagtctctaaatgactaattcaatctcttcatttcttataggtatattcaggttttctatttcttctggagtcagttttggtattctgtttctctagaaacttgtccatttttataagttatctgatttgttgttgttgttcatcatatttctgtataattgttttaatttcatggctatgtttattgtttatatgtttggggagaatattctgttccctcatggcataaggacctcaccgatctcccctctggaaaagagcctaaaacaacttaatcgacacattatcctttcattcatgttattgggctactatcacatgccagcattcttctaggccctagagacacatcagtcagtggacaagtctccccttctcatagtagaggatcaataatagaaatatttaaaatctaagttcaatttgagacaagtgttatgaagaaaataaagtgaagggatagaatagaaagtgactggtcaggggctgggaggatggaatgctccaaaacttccacatatgctatcctcatccatgaatatgatttgctaccaatcacttccacataggtgagtttaaaagaccacttaccgacccatctcctagactaatacagtaattgtactatgtacagaggccattttttcaactcccaatctctgcttctaagtataatttattttagtatatggaatattttgcttttctcactctgtacaacacgtgctgctttgtgttaatttgtttccataggtgaagatggagtgattgggatgatgggctttcctggagccattggccctccagggccccctgggaacccaggcacaccagggcagaggggtaagtgatagagtgtctttctaaatagcaggaagcataaacaatgttcatttattttgcagcaaaaaaagttatgtttcattggagggaaaaatagttctgagagagcaacagtatttgattttgctgttttctatgttccttttctccatttgaatggaatcctgttttctgtaggcttacaccactacccttatgaggctgcctgcctggggaaactatttatcaagttctcagcactgttagccttttttgtttgatttgttctgttttatagtaagcactgccaactttttaatccctatgaactacctgaagaattaaggacctgatgttgttactcctgtctgttagggagccctggaattccaggagtaaagggccagagaggaaccccaggagccaagggggaacaaggagataaaggaaatcccgggccttcagagatatcccacgtaataggggacaaaggagaaccaggtctcaaaggtaaagaattgcttgtttggaatcaggacatcagagctgattctcgggctaataaattatccaggcaaatccgtttggttgacaaataaggacagtgagggccagtgtttagttacctgcccatcacacagccggttggtggctgagcaggccttagaactgagtcaccttccacgacatgttgcctcctcgatgtgtaacatttttatttctaagttaattctgcattttaatttgctatatttaaatcatcagcagtcagtttttaaattataagcctcaaaactccctctttgccaagtatggggaaaattaaacccttaaaaaaattccacattaaaaaacttttctggctgatgttgaaacctccatctcaaattcaactttattctgtagactaccagaataatattttctgattctatctaaaaacttcttctcctgttcaaaatcctttggagaataattactaaaaagaaatgcttcaatgaaaatttaaccctttagaaagactgttgttagatgtggctactaggctaaaattcaaacccattcacattatttcaagttatttgggccctttttatggcagttttcatgatatgatcaatacgaccaatataaaaccaaattttcagaagccctcccttgcagtcttcttgaccaaatgtaatcccaagcaactttagaaaaacagagaactgctgggtaaaatattacatttgcagatcagactctcatagcaggaaaggaataaaagaaaaatgtatcatggcaagaaaggaaaaaagaaaaatgtgtttgcagttgcaaaaccatgttaagttttgagatatttgaaatgacttttgagaaatgagactgtgttcaacaaatatttatatgcatggcacatgaggatgtaacaaaccttcacatgtactgccaaacctaaaaaaaaaaaaaaaaaaaaaaaaaaaaaatttgcacagggtgctgtagactacaatataaaggctgactaactggcaagttaggaagtaaaggccttctatgtacatagtcctcatctaacctggtgttgaagagacactttagttctggtacaaaaagaatattgcatttcatttttagcaatgaaaaagaaagtaatgcgacttttataaaactctgctaggactagtctaagccaagatatgaaaaaaaaaaatactggcaccaatctccagtcctcataaactgtctgcatagacaccacttcactagactattttagattatttaagtagtgttagaaacattttggaaaaaatatgaatagcatatctctgcctacataagcagaaatttggcgctcacagtataaatgcgcagtgagtactaatttgcaattgaagaattccttttgtaaagtacagaaggacacatgatatggggctatttctatacttccaacaaaactcttttactcaccctaagtacagtatgcatcgaggctgttctgtatgttttctttaggcttttcaaatgcataaccaagggacacagattgaagaacaacaaaaaaataacctgtatctaggcctccctaatttcaatatgatccatttatttttctaaatctgaatttctgacttaaagctattcacttcaaatgtggaagagatattgaatatacagagaagcacaataacaagtcactatcctctccacaaggaggctgcgtggcagacttaggcatatgtagaaaaagataataaagacgcgaggtgcaaattagcatgctatattatttaacaacgacctaagtagcatttaccatgtgcaggtactgttccaagttttacaactattgactcatttaatcctcacaataaccctaggagtaggctgggcacagtggctcacggctgtaatcccagtattttgggaggccaaggcgggtggatcacctgaggtcaggagttcgagaccagcctggccaacatggcaaaaccccatctctactaaatatacaaaaattagccagggtgggcggggtggggagcctgtaattccagctagtcaggaggctgaggcatgagaatcgcttgaacctgagaggcagaggttgcaatgagctgagattgtgccactgcactccaacctgggcaacagagtgaggctctgtctcaaaaaataaataaatacataaccctaggagtaggtactactattgcaatcatcccattttacatacggggaaatagggaggtcaagttacttgcccaatgacactctgataggaaatggcagagatgggcctcactcttggcctcctcactgtgctgccagagctctgtaggagttgagggaagtagaaaatacagcaactaagatagtcagtgaaacctccataaaagaggacttaaatgttgaataagattcagatgaacaaataaaattcttggcttaaaatctttccaaggctccctgtgctttgagaagtgaaacttcttggactgacatacaagtttattcaccacttgcacttggcctgtctctccagccacatgacatttatgtactcaataattaccttttacttaataatacctatggactaggcattttgctatgccttgattatacagaggtgaacaaagcagactttagtttcctagtcatgatgaaagttacggtttagtgggggaaagacacataatgggtccataaacattttccatttaggctaggtagtaagtatcttacgctttgtggctcacatatggtccctgttgcatattcttctttgcttttgtttttaacaaccttttaaaaatgtaaaaaccgccaggcgtggtggctcacgcctgtaatcccagccctttgggaggccgaggcgggtggatcatgaggtcaagagatcgagaccatcctggccaacatagtgaaaccccaactctactaaaaatacaaaaattagcgggcgtggtggcacacgcctgtaatcccagctacttgggaggctgaggtaggagaatcacttgaacccggaaggcggaggttgcagtgagctgagattgtgccactgcactccagcatggcgagaaagcaagactccgtctcaaaaaaaaaaaaaatgtaaaacccgtctttaaccctaaagccatacaaaaccaagccagattcagcctgaaagctgtattttgccaactcctaaaacactgaagtaaacaaacagactaaacagtatatatctttttagattgcaatcaatgacataaaaggaaaaaatgaaagttgtaaaacaaaacaatctaactccctgatactcatcactcctttctacatgctattttactctctgggaatcctgtctcattccagaccttcttcacccaattagttttcatttggtcttcaagactgagctaaaaaataccacctctttcagaaattcttcccctgtagtatattgtgcccaactctagtatagagtttatcttcctggatgataattatttgtttacttgcctgtctccccagttaaacactaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccaaatgttttgcccacctcagcctcccaaagtgctgggattacaggcgtgagccactgcacctggcccaatgactatttatgaacaggagaagagtatgatcaaagtcatgttttagggaaagtggaatggtttcctgggacgtttatgagctttccagctgggcagaactggattcaaatccaagtgttattaactgattgacactgtgattctggcctttgacttacctaatactttataaattataattttaatacatggattgagaatagaatcatctagatgagaatactgtagtggataacactttgtctttactattaaaaaatgaagaggtatttaggctgctaattcttaaaatgttgttttaaagagtacatattaagatcattgctagtgttcattgaggaataacttatgccaggcactgtgctaatgcttgacgcatattatttcatttaatcctcttctttaagagacagaagcccaaatccgcccatgctcttaacatatatgctatatgctgtactacagtaatatgccatcggtttaaaccaggatgtggatgggtctgacaaaattttaacatgaatttttgatgcctggttttttgttttgggtttttttttttttttttgagatggagtctcgttctgtcgcccacgctggagtgcagtggcacgatctcagctcacttcaacctctgtctcccaggttcaagtgattttcctgcctcagcctcccacgtagctgggattacaggcacctgccaccacacctggctaattttcttgttaatacctggtttctaacttcaggattcgcaggaaatccaggtgagaaaggaaacagaggcgttccagggatgccaggtttaaagggcctcaaaggactacccggaccagcaggaccaccaggtacagctgattctcaaatagaaaaatatcacattttacactttcctacatctaaagtaataaaagttgtttctaggcttactgggtttaaatatcaattctgttctgatagtgttccagcagaaatttgctactaaattaactaaaagaaggtgttgatagttggcgtgtcattaactaacatacattaacctacaaatagttccattttgtcctcaaaatttcattctgaaattgctgatatgtattataaattataatgtatcactatatcacatatcagagatgaaaattagagaatgctttagaagttttcaggtttgcatctttcttttttaaaacaagtaactgagtttacaaaataatttttaaataattaaagtatcccaccattcctacaaccatctcagtaacaaaatatatgacatggcaataacacttcaggatgcagttggaaatgtattaccatatgtttgcaggagcccacttttttcccgctggtgttggtcctaggatgattttagtgtttgaaacccaggtctgctaacgagaatctaactttctttagttttccatgttccaggtccctagttccctcttatttgaaggaaaaaggacagctagacaagtgcccaaaccagccggtctggctgttctgcattcattcatgcatgcaagcaacaagtatttattaaacacatactatgtccaggaactgtgcagggcaataactacttatttgttctcaaggccccagaggagatttgggcagcactgggaatcctggagaaccaggactgcgtggtataccaggaagcatggggaacatgggcatgccaggtaatgcataaggtcctgttatgagcccacaagctcatgatgggtgaggactccagattttctgtgttgtgtactgttttggttttccacttggtagaaagcttatattaaaaaactagatttgcggggccgggcacggtggctcatgcctgtaatcccagcactttgggaggctgaggcaagcagatcacctgaggtcaggagtttgagagcagcctggccaacatggcgaaaccccatctctactaaagatacaaaaaaaatagctgggtgtggtggcacatgcctgtagtcccagctactcgggaggctgaggcaggagaatcgcttgaacccgagaggtggaggttgcagtgagctgaggtcacgctgctgcactccagcatgggcgacagagtgagactccatctcaaaaaaaaccaacaacaacaaaaaaaacagatttcctattagacaaatacacagtgtgcaaccagaaaatgggtgagaacaaaataaatattgatattatataataatcatctattgtaactacctgatgcagttgcaattctgaaaaagccattcttgggagaaagcttatgtaaaactgaaaagtagaaaacttcaagatcctcatgtttatctattttactctatgttttccccctaatttcaggttctaaaggaaaaaggggaactttgggattcccaggtcgagcaggaagaccaggcctcccaggtattcatggtctccagggagataagggagagccaggttattcagaaggtacaaggccaggaccaccgggaccaacggtatataggccactgaaatatttacattttagtggtggagtgagtgccttgaaaaatatcaacaagtacccagattcggtgtgggcagagaaaattgaaactgttactatactttcagacagttatttggatttttaaaatcctatctccacaacagaggatgcttgtctgtcacagagctgtcaacttctgagagcctctttcagtcaccaaggaatttctcacactgtctctgcaatttaggtgtgctgccagaagaaggcagtgattacaggcccatacaatcagataggacagtgggttttttcttgtgatacaaagtggcccatttctgctgtactcatctcagacttagaaaaataaatttccaaaccttctaataaaaaacacttgtcggccgggcgcggtggctcacgcctgtaatcctagcactttgggaggccgagacgggcggatcacgaggtcaggagatcgagaccatcttggctaacatggtgaaaccccgtttctactaaaaatacaaaaaattagccgggcgtgttggcgggcgcctgtagtcccagctacttgggaggctgaggcaggagaatggcatgaacctgggaggcggagcttgcagtgagccgagatcgcgccactgcactccaacctgggagacacagcgagactccgtctcaaaaaaaaacaaaaaaacaaaaaaaaaaaacaaaaaaaaaaacacttgtcttacaaagactaacaaaagatacaaaataaaataactttacagcatcattagaaagcgaacaaaatcctaagatagatacatttatctttcttgttttagaactttttctgtgtaatggaatggaaatgcttaatcttgtttcaatgttttcagtgtttgtgctttgtcaaattgaggttggatgttaaagcccttactactgtattatacaaagcagcaaccagatgtttcaatagggcttggctgctttcttaggtttattctcttcccaattttctgagtacagctctcacactaaaagccagagatagaccactagagaatgattaatagaagttcctataagcagaagttgctaacgtgggattccatggaccactgggaaaatctatgggatcccaagaagcccagcaacctcttgaaactaaatgcaaaatgtttgaaaatgtttttgtagggtagagtctatttttcagatttagatttttagattttcaacagtatatgtatgactccaatatataaaaagtattacttagggaaccttctccctctttttggagacaataaaataccacctttcctaaatatttccaccagctatagtctccagtagtaactgctaaaacaagaaaaaaacttagacactacacagacccaagaaagcaactgtttactacttggagcacagacaaatgtctttgttctttatatttagattaagtcctcagaaaacctgagattgcttccactgagatatttgctcaacgaaaaatcctatttgacttcacactcaattaactgatagtttcatttagatttaaagttttcacaggtaaccaccagaataaatttttagaactgtgcattgaacacaaaatgagctggttttatcatgtcagcaaaatgagagtaacagagtagtatattttaattggctaccatagaaattttgtaaatctttatcaaacctatatgttcgggtttgtcgtaaaactgaagtgaagatttaatgaacactaaatcattggaaggtttttaaaacatgtgattgacatatgtgcatgcatagcatttgtaggatacatctttatttagtctatttctttcttactcccagctactcatcacaatttgtaattatatatttgtgtgattatttaatatctatctccttactggtctctgaagctccatgaaggcagggactgtgtatgtcataaatctatataggttaccattatatcctggtaaaagccggcttcctgggtatgctaccagtgcagtcacagaaatcctgtgctaagaagggcctccacacttggtctgacgctatgctgttgctgtcttgaaattcactttaaaaagttttaagggaaactgcattttcattttgcactgggccccataaaccatgtggccgtcttattcccagcacctatcacagtgctggcagatagcagatactaatatgaattgatgaatgaatgaaaaaattagtgaataaagtttatgctgaattcttaccacatatcctgcttatatgagaattttaaaggtatttgactacatttaagggggatccaggactgccgggtgatatgggaaagaaaggagaaatggggcaacctggcccacctggacatttggggcctgctggacctgagggagcccctggaagtcctggaagtcctggcctcccaggtaaggcttgagtttacaattctaaaagctggaagcattactcagagtatagccctcctgaaatcattgtggtaaacagaaagctatttatacttttatgctgcagttgcttttattcaactttgaacttcaaattctaacacactaagagaattcattaagagagcccaattttactaatcagcccatttggactgaaatacaaaaatatgttcctataaaaaacacttttgaagaactgcctcaacaaattcagcccaaggatacaaaatgttagccgttatacaatcataatgtttgtattagtttgtccaggcttccatagtgaattccacagactaggtggcttaaactacacttgatgttagccaaaaggctgagaagtgattaggtggcttaaactacagatgtttattttctcacagttccagcagctccgagtctgtgatcaagctgtcggcagcgttggtttcttgtggggcccctgttcttggcttgtggatggctatcttcttccagtgttttccaagtgtctgaatcttcttttcttataaagacaccactcacattggattagggcccaccctactgacctcattttaatttaattacctgtttaccagccctatccccaaatacagagtcatgttccgaagtactgaaggttaggacttcagcatatgaatttggggacaacacaattcaaactacaacactgtgctgtgactctttttcgaacccatttctggattgaattttggctttctggcttattagcttacaattcaggtttagggttttgttttattaaaaacaactgtgaaactatcgggttgcagattcaggtcttacttaaatacaataaactacctgttcaaatacagaaagtttcaataaatttgcatttaactcgcaattaaaataaaatcgcatattgagtggtgcttgtggttggtgtacacacatctttgaaagtgattagacacatctctgcactggttctccaggaaaattgcagcctggacaaaaccatggggtgaccttgcaacaagagagcttccttaaggccagcgtgagcatggttgactataaaaacagaccgtttcagtcactgttgtaatcatttatcttttggtgatcttttttcttccttcccctctcttcatttccaggaaagccaggtcctcatggtgatttgggttttaaaggaatcaaaggcctcctgggccctccaggaatcagaggccctccaggtttcatttttgtactttctctttttccttttcatgtgggagacacatttttctcctgaggtttggatttctgtaaacctactactctatagaaggtagctcctagttactcagtatccagacaaaaatgcaaaaaaaatggggttagatatttctatctatttaattcaaatatttggcaacctattccaaactgataatcctcatgataatagtaatctgtatgtggttttccctgggaacatagcttcacatagctacagttctgaaaaacagcctgtttaacacaattccacacatctccctggtattcccattaggccactggcaagaaataaatcctctttttgtataccatagtttggggtttttgggttttttttttttttttcaggtcttccaggatttccaggatctcctggaccaatgggtataagaggtgaccaaggacgtgatggaattcctggtccagccggagaaaagggagaaacgggtacaacttgctcattatctttgatccgttagttttattttggatagaatcattagtaacagtgtaatcctttgctgctctaaagatttttctctgatagaactgattatctttaacatgttttcggtgtgtactaaacttttctcatagacatataatgtaatgaaattgaccaattattaacatgccaagattatctctttcaggtttattgagggcccctccaggcccaagagggaaccctggtgctcaaggtaagcagttcttcttccctgtcctaatgtacacattttcaaggagagaaagcagttgaatatgcttgaaatataaagtaagcttaacctagtgaattaaagatgttccaatagtaatacaggatatttatcatcttggtcttcaatttaaaatgtttaattattaccatcacaacaaatggaatgaattagaaactgtgattcaattttggaatttcctactaagaaagtcttgaaaagtaaaaaggattcttctgtatatgtcttgctgttgttagcatggtttaaagataccacctcctaaaaggtgaaggtggaactgatgggttctcagtaagcatctgtccctgctgttctgagacacaggagtaatccgaatcctttcccacctgtatcttcataggtctgactccaacccccagatccagcttgcggtccatgctattgtttattaaaggcgacccagagagtctctcaacatctcagacatggcagtttactgaacatgtcattcagagtatttacaagttttttgtttggcaggccacagatctggatttctcatgtcagtgctttacaagataaacagcttcttttaactcttttccattttctagtcaaaccttccaggagaaacatcagattgtttgcacatttcattgacccgtctcagccacgcgtcctatgaatgggagcatttcattagcaaagaggcctaacacactgaagggctctagttattgatgttcacgcaaaccagcaaagagcagctggatgccaatgagaaactcagttgggcaggaaccacctcttgacaaaacagttaaagtgtaaaagtagacaagagctgttctctcccatttgtttcttactggtttgattgttctttcggttgagctcagtcttcccacatctctcagacctctcctttcccaatgaggatgaaggctcttcctgttccacagtgtagctttagaattttggtcaaaaggagagttgctcttcatgttcccagggtaactcacagtttaaccatttggaatgagaacactagcttttaactggaaataaaatttggtataaaacggtcataccttaggtttaaaagccttaaaactaacaaatagcctaattatgtaagtgaatgattatgcacctcaatccctctaggataactaaatatggagaagagttcattgagacttggaaggtatgaatccttttaattagtttattctcccaaatcctaaaaagaaatcatattgcagagcatgtaatcattttaatgaacatgaaatatataatccaagccatcttggtacttcaggtcattgccatgcaaatacagtattacaaagcttggagtgaactgaagtcatctaagcactttcttttaaaagcataaattacaggcattaaaaagctaaaggatgtgaatagacatagggctagatcgtcaatattcatcaattttattttcattgtaagtctttactatataataactccccaagccctcccctgagctattagcctccctctccttctccctctccttctgcacatctatcttccgttttcatgccatttactgctgctagaataacacagagatgggagagcagagggagacattatttgcaattcatacaatatttttcattcatgaatgtcaaagcacaatttcttgaaggttttctaagatgaaaaatattagtattaacctgtgacctttttggagggtctttggtaaatccaaacctcctgccactagtattcctattatggggaatgtgtggggaagttaactaaaggacagaataaagactgcaattttgttgctcctttgtctggatttagctggataatacttcaaatgcacacatcagtgctacgcagtttagcttcttatgctctaatgaattatcagtgactcaacaatgtcaacatgactaagttaatcagctgataataactggcttatatttatataacactttagagcttacaccatgcttttatgtctgtatgttatctcacttgatctgaaagaattagctagaacaggtattaccttcattttttaaaataagaaaatcaaaatttgtaatagtaggtaaatctgaagtgactttgccaagatcagacagctagttggagacagactgagtctcaactcagtttttgtagctctatattgcatttaccagcaatatattataaaatatatattttagaaacatatattctgaatctgaacacttttaagcaaagtacctacattattaaagatagtcaagaactctaacccaagcatatgggcattaaagaaacttattaagccttcttctttgcaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtaaagggtttacttttaaacagcataaaataacaaaaatcatgtttgacctcaaaagttttcaacctcctcctcatgttaccttgttgcttcttctttccctgtggtcatctccattcccccactacctgtggttcccatacccagcagttgtcaaggcaaggtagcctgtttgagggatgcatagttaataaattaacgagcctggctggacgcagtggctcacacccgtaatcccagcactttggtaggccaaggcagatggatcacttgaggtcaggagttcaagactagcctggccaacatggtgaaaccctgtctctactaaaaatacaaaaattagccagtcttgcttggtggtgcatgcctgtaataccggcaactcaggaggctgagatgggagaacctcttaaacctgggaggcagaggctgcagtgagctgagattgcgccactgcactgcagcctgggcaacaaaacaaaactgtatcaaaaaaaaataattagcctaaaagacagtgatgcattcattcaactctatttgttgaatccctagagctgggctaggctctagggaagcaggcacagaccctgctgtaacagaccctcactggggagaagcagatcctgctggtgggtgccaggtgcttcgctggcatcatcttctcctgtctttaccacaatcccatcacatgctccaggggaaagaatgtttgtggcaatgctaagtgaagggtttatacttcattagaaacaatcactgataaatagaaccttccaagctccctggctggcaatactgacagacttttcatgaattcaggtgcgcctggtccccctggacctccagggagtcatgtaataggcataaaaggagacaaagggtctatgggccaccctggcccaaaaggtccacctggaactgcaggagacatgggaccaccaggtcgtctggtgagtatggataattattttgactcattattaattcaatatcaacttataattattcttatattgtatattatatcatatattgttgatgttaactgtattagtccattctcatgatgttaataaagacatacccgagactgggtaatttataaaagaggtttaattgactcacaattctacatggctggggagacctcaagaaacttataatcatggcagaaggcacctcttcacactgcaacaggagagagaatgagtgccaagcaaaaggggaagccccttataaaaccatcagatcggccgggcgtggtggctcacgcctgtaatcccagcactttgggaggccgaggcgggcggatcacgaggtcaggagatcgagaccatcctggctaacatggtgaaaccccgtctctactaaaaatacaaaaaattagctgggcgtggaggcaggcgcctgtagtcccagctactcaggaggctgaggcaggagaatggcgtgaacccgggaggcggagcttgcagtgagccgagatagcgccactgcactccagcctgggtgacagagtgagactccgtcaaaacaaacaaacaaacaaaaccatcagatctcatgagaactcactcactaccatgagaatggcatgggggaaaccacccccatgattcaattacctcccactgggtccttcccaggacatgtggggattataggaactacaattcaagatgagatttgggtggggacacagccaaaccatatcattaacattgacttatcgttagtacaagagtactattatactcttataaattaattgccagatcagatgggcctggaggcagcaaaaatttacaatttttgatgcatctgtgcagtgtgcctaagggaacacagtccagaagtttctgaaaatcaaaaaatcttcagagttggaatgatttggcctctaagaggcctccaaaactttggtctgtatgggactcacctctacagcattccagatccttgcttatttagaccctgaacaagtccagtgacggaatcttcaaaaagcagctgggagttcagaatcactctaaatgacattgtcacttttccctctacttacaggcttctgaagatttctgcattcccctgtaaatgcctatttattttctgccccccaaatgcctgccaatgtttctaaataactgccatttctttccaattattttattcctggataaatacttggttctttcaaattcagtttaactatttatcagccttgcctctatactgaatacaccctagtttcaatcgccctaaaaaatatagcctctggaatgaacgccctccagaagtaagaagtcaataccccagtgagtggctaaaggacagaagggtctactgtccggaacatcaccattttaggaatcagacctaaaattccacttgggccattgggctgacctacctgtctccacattgtgcctgtaatcaactaaagcccatgggccttttcctcatgaactgctactaagttttctccattatttcttgcctagcttgttgttgctgatgtttatttgggacttaagtgtagaacttttacatttatcaatcttagacatcatcttattcatttaggcctgtgccccaagcctgcaatctctcaattcatattctctctctcaacaccacagccgtcgtccctagctttctcttagcagcgtattagacaagttgacccctctgtttacatcaaatccttggagacagatgttgaatagatgaatgtgactcagggatcataactgagtgtctactctgtaccaatggatagaaaaacaaaaagctacagtcccttgccctagaggagcccacaataaagtgagggtgatagacacagagacggccattttcacactgtgtggtaggaagaatgcagggggctgtggggacacagaggaagggtatttaatccagactgtagagggaaggtgttcaggaaaggtccctccccaaggagattgatgcctggcctgagtcttgaaagacgcataggagttatccaagaaaataggaaaagccggggtatgggtcgggtggaggaaaggagctttctgagcaaaatgacaatgggtgtgtgtgagtgacacacacacaactctattactggagctgaggtgggaatgaggacaccttgggaggagtctggagggctaagcaggagtcaggtaacggaggtctggttttctagactaagaagagggaggaggacatcacttgctgatccaagaaacacttaacaaagcagctctttgtgcccagagtttgctctctaccagctggaattaatcccttaatgaactgccttttgatgtggctattcaccaagctttaaatctatccttgttgctctatgcagcagccattttgtccacaaaaatatagtagagagagctaccatggcacatggcacagctctctctaccatgtaaattgtcagtgtaaatacattgacaattcatatgtaaatacagaacatctatggtataactcattttgtcctctactaacctcatcagtgatgcgtaatgaggtgctttgccatagctcattgttaggaatcgctcttaagtactcttggtatttgatttccagaatctaactttaaaagtttttttgaaaaatgacatatttgcccatcttcagtctgtaggtgtctctcatgttctccatgattctttgaaagttgccaatttgatccatgattacatctgaagaccttccaaaggacactgggatatataaagcttggtttggaaacatgatcttacttaactcctctggtgatttcgtggtcattcataggcttctatacttacagttgaaagatatttcttgatggatgtctcaactggcctggggcctttaacagctccctcctgctgccagggataaccctggcaacatgccctttttcatagttaccttagcctcaagagaacaggcagacatcagaagccagcaagtccttgaccagatggttctgttttgtctctctccttttttaacaacactttatccaagcaatcagatggttccttctttggtcttcttgctccaaagatagctggttcaaggccagttttatccttggcacttttcatgaccttcaaagcacattattctcaggtaatagcattatctcaattcacatggacagtatgaaagtagatttagcatacattttgacaaatagctctttccagaagccctgctccctcctccctccttctatggctttgcttgagcatctcctggctataagaccagttcatgtgagcctcacaagaagagagcacctcgttcctgcttagattattgcatccttgtcaaatatgcctgtcaaatactctctcttgacaactcctgtacactcccatccctagacattacttctcctaccatcatgatcaagtgtaatttatggctctgctagcttagtgagaatgaagcttaggtgctgtaactcaacaacggttttgttgtctttgcagcaattataaatacagattataattttcattctgggccaggcatggtagctcactactataatcccagcactttgggaggccgaggtgggcagatcatttgaggtcaggaggtcgagaccagctgggccaacatggcgaaaccctgtctctactcaaaatacaaaaattagccaggtgtggtggtgcatgcctataatcccagctacttgggaggctgaggcatgacaattacttgaatgtgggaagcagaggttgcagcaagccaagatcatgccactgcactccagtctggaggacaaaacgagactctttctccaaaaaaaaaaaaaaaaaaaaaaaaaaaaaaaaaaaaaaaaatcattctggcagtactgggctactccatttaggacacagaatatccagttgaatccaatactaaaacaacatacaccaacattagaaggtatgtttgctgttgggcttaagggaagcttttattttacttttaaaacgatagtcctaaggaaaggttctaagtggccagaggagttatagccttgattgaaagataaaaatgatgtctgctaacttcagcttattctcacccaacataatattataccctatttgcatttttaaaaaactgctgtgaattgagtgattttaaaaatttgttttggttctgctccctttatttgaaatatagggagcaccaggtactccaggtcttccaggaccccagaggtgatcctggattccaggggtttccaggcgtgaaaggtactggtttttgtgcattgctctttatatgcaaataccataacctcaattcatattttagggcacacaagtgtttgctgaagtacagacagctggggttagtacaaataggacctcaatacgagtgaagtaggaaggctccactacactatttcaagattctttgaaatagagtatttcttcagatcaatggctctcggtaaccttcttttatttgtgtaaaagactgtgattggaagagaagtcttaccactttattagttcacatcaaagcaaatattctctatgtgctgaaaagaactcctaacgtaactaactctaggctattagtaaagctagagtaataagctgagaaagtaggtaactatgacaaccaagcaatataattcaccacatggtagaacaggttttaatgtgactttgtatgttaccgtaaatatcaaattggtttctgaactcaaaaagtggactcttagggacccttccccttcaatgttaaaatacaagttcttaatgcctacttctggaatatatttctttacagactcattaagcatgacctactgggtcccagtgacatgccaaaacctatgtgaacaaaatgaaattgtagcccttgtgacagaacccataggacagagcctccaggcacacttctagtatttgtccttagagtcaatcatcaacctgaagaactaggaaacccattgatctaagtggaatcacactgtgtctttgtttgtttttaggagaaaagggtaatcctggatttctaggatccattggacctccaggaccaattgggccaaaaggaccacctggtaaataaacgtccttactattgctgtcaatgaagaaaggtaacacatccgtgaggccatcatcttcttcttatgtttatgtcaacaggtgtacgtggagaccctggcacacttaagattatctcccttccaggaagcccagggccacctggcacacctggagaaccagggatgcagggagaacctgggccaccagggccacctggaaacctaggtgtgggactggcagcattgacttggatcactaggaagtggttgaaccaaaatacctgtaaactgctttggaaacagctgatacaacttcacagaaaatgttgaacatgatagtggttttcacaatcagtcttaggattgagctcattttacccttgaccagcaaataaaagaccttggaatctattgaaagcagttgttcatagtataacttgaacaaatacactttagggcagcatgttttttttattattttttattaaggtaaaggtatgtctatctcctctgacaactgtcagtctcggggctctatttctaaatgattgtctgaatatacctgagttctgtgaatttatacttttctaacatttggtacagcaaagtattaggaaaaaatgatttagaaatcttttcaaaatactggtgtttggaaattgaactaacccctctacatatgcacagcatatcgtaataggcttctgaatggaatgattatgccttaagtttgtctgaatcacctgggagataaagatattacttatttgtttgatcaattcagggacatagtgaattctggaagaacataaataaaaattgcagcacaattttaaactgctgcatttagtatcctcatagttcattttcgagagtcttattttctgggaagtggggctaacaagttaggtgactaatcatcctagcttgcccaggactgaggatcttcccaggatgcaggactttcattcctgaaactgagaaagtcctgggttaacgggatggttggccaccttacttttcatcctatatgataaaatgcaatacaatgttggtttttgcctaggaccctgtgggccaagaggtaagccaggcaaggatggaaaaccaggaactcctggaccagctggagaaaaaggcaacaaaggttctaaaggagagccaggtaaacccccagcttgtttcctcaccgaagaagtgctatttcgacatacagagaagtcttgttcgagtgggtgactatatgagttatctaggcctttgagtttatgttgttcagatcagaccaaaggccaaggatcaaatgttcatttggaagatgagaatcaagaattattggaacacagtatttttccgacctcttagctggtcagatgggctccaaactgatgcacagtttagcctgaggacaaatagaactaataagtcctatgggtgttctttcaaaaaggccaatacctgtttttaataacttataggagttgttagttaataattatttataggagcagtacataagtatgtagctagaaaaatattaccttggtatgagtagaagagcaacttagtatccttttttaagaaagccatcttttaaaaatgccattcttcatggtggtgggtgcctgtaatcgcagctacttgggaggctgaggcaggagaatcgcttgaacctgggaggtggaggttgcagggagccaagatcacaccaccgcactccaacctgggtgacagactctgtctcaaaaaaaaaaaaagccattcttgaatagaattcaacaattcatgcgtgtcctgaaaagggacctcttaagtatagtgttttattctgaacatatgctgtatgtgtcagtttgatacctggatcaacatctaccttctgcagatgtttcaaagcactcttctggaaactacctcgatatccaaatcttctatttttaggattgctgactttgttaaagcaagaaaaaattctaaatgtgctttctgaatttactgacatatatcatgctcagatctactatattaaaatggtaaagactatagacttaaatttttaaaaattcaaatatgatgttaatataatactaattgcataactacatgtgatttaatattgtcataggtgcacagtagagtgctattaatcattcaactttccttaaagtgtggtttttgaagtgataaaccattcttattaagaattctattaatttaaaaattttaatgaccaaggctttaatgccctaagaatggggcaacagcaagagcaagggcactgcaatataaattttgtagagaactaattagcaagtagacagttcaatgctatggaggcctcacaagaatgacaaagggatctaagagtcaaactgcactggcataaactgatagccctggcccctttcttggagatacagaaatgcattggatatcacacatttgtataaaagctcacttccagttcctgccctgctcagctaatcacttcccaattcctgtgcagagatgaggagacatcttttgtttggggccaactatagctccctctgaatgagggcaggggttaggaaaagagaaaaatgtgtctccccaatatattaaaaccatggcaacttggatttttcaagtaagacatcagaccggagaatttggatgtggcctatttttaatttcaaaaaaccactcaaggtccctggaggagacaagagtgggcagaattcagagaaaattgaaaaaatgcataatattggggcttttacaaatttctgaggaaagtcctgacttccgagtcaggactaaactgtgaccctgcctgactcccaggggcacggatgtcccaggggcaacaaaactaattcctgtgatgatgtaggcccaaagtctaaccatcgctgttttctctgtgattccttaggaccctagagaaccatggcccaagtctggttggggagggagtcagcgtacagtggcagcagaaatggatgggagtgaggaagtggtagccaatgccaataccataaataatagccgttcaatgaaagaaaggagaaggaagttaaagaggaatggaagagaggatagctcactggttctcatctagaacacgacaagtgtggattagccttgtccaaatccatactccaaagtatagaaagtttttctccacagagagaaaaatgtacagaaacgatttactttgtttttaactcatataaataaactaacccttattacagtgaaaaaaaaagccttctcttcttacttgacttacaaattgatcaaaacttccttgaagtttgaacctttaaaaagagctttcaatgttttctgcaattgtttattgtagacaatgttgcaataatttgtgaatttatcaaaaccataagtaatttttgttatctactcgaatagactaagttgtagatatttgatttttcccccatcacattgtaggaggattcattcatttattcataaaaaacatacataagacctaccagatgcaggcaggccactgtgccaggcctcacagaggaattcaaagataaagacctgatctcaaaaaacgcatcaaatatacacaaacattgataagaagaggcactgtgtgataaactgcttaacatttaataatactgtttggccatttttataagccactcttctctaggattgctttcaatttatgggctcaacatatataaaatatatttaaattagtactttgaaaaaacgagtttaagatttttgtgtatgttgcaacatttagaatgtgttttttgaaggaccagctggatcagatggattgccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttggtaatgtcccagtcccagttgccagttgtgctgttccacatgcagattgtaaatctttatagcctaggatgcttccctctgaagttaagtgtaaataaccttgagtgtctcctgatacattttaaagagagcaaataaaacactggcctgtctaattttcattctggaatgtaaaatggtggaaggagcctagctcaggaatgctagcctagctcctcccattcagtgcaaacaatttgcccctaaaactccctaaaccacctgtctgcatttatctttttggtgctttttctttttcttttttctttttcacacagggtctcactttcatcacccaggctggagtgcagtggtgcaatcatggctcactgcagcctccacatcctaggctcaagccatcctcccacctcagactcccaaatggctgggactacaggcacacgccactataccaagctaatttttttgattttcagtagagatgaggtctggctatgctgtcaaggtttctctcaaactcttgaactcaagcaatcctccctcctcagcctcccaaagtgctgggattacaggcgtgagccaccatgcccagcccacccatttgcttttcaatctcacaaataactgcttttctaaacctttatttggttattagctattatgtacatatgaataagtgggaatactttgaagcaaaaacactatcccaactgatctatgctagcccccatgttctaaatcgattagaaagagccaccggaagtattaaaggtgggagaaagaagatttgtttgcctattggatctttgatttctatcagtatgaaaacttttcaatactacattttgcagataactcttttgtgttgtctttgtccagcttttgctgcaggttacatttaaattagcttctctctagtaacgatgctgaaaataactttaacttactgaaagtgatactcagtctgatgtttcattaggaactcttggcagctgcctgcagcgatttaccacaatgccattcttattctgcaatgtcaatgatgtatgtaattttgcatctcgaaatgattattcatactggctgtcaacaccagctctgatgccaatgaacatggctcccattactggcagagcccttgagccttatataagcaggtaaaaatccaatcccctagttttacaatgggaccaagtgaatcacttcccttgtaatggaatgaaaggcagcacatgacagtgcagaaagtggcaatgccgccatagtctttgtttcatgttacagatgcactgtttgtgaaggtcctgcgatcgccatagccgttcacagccaaaccactgacattcctccatgtcctcacggctggatttctctctggaaaggattttcattcatcatggtgaggagaaaaggaacaggaggtttagggtaaagactacctgtagaatgttacattgtgctgggtaaaatgtgattcccagggtcgatgctgcctgctgtccgtgtgtgcaacatgccatagacatttccttgaaaatctacaaacagactttttttttttacttttggtaaataatggagtactaaaaaagacttctcaggaggagattacctacaaattctattatgaaatttaggtgaatagtagctgcgttttattgataatggaatgtctctttttattattttttttatcttttgagacagattctcgctctgtcacccaggctggagtgcagtggagtgattttggctcactgcaacctccgcctcccaggttcaagtgattctcctgcctcggcctgctgagtagctgagattgcaggtctgtgctaccatgcccagctaatttttgtatttttggttttttgtttgttttgtttttttagtagagactgggtttcaccatattgcccaggctggtctcaaactcctgacctccagtgatctgcccaactcagcctcccaaagtgctgggattacaggcatgagtcactgcacccagcctggaatgcctattttttataagataactgctttacatacattctctgtaatttttatgaaaacgctcataggtaatttctatcatttacagttttacaaataagaatgaagtactttccccagggtcttacaactatttagtggaaaagctaggatctgaacccaggtctatctgctccaaaatctgtgccccttttgacattcatatggagataaaagcaaagaaaaacagtcttttaaagaaaaagctttcagatgtaaatgctagtgaagaagtttatggattggccatgtgtgactgtgatgactgtcatagctgcacgcaggtggttctttcttttttctttttctttgtctcttgagacagaatctccctctgtcgcccaggctggagtgcagtggtgcaatcttggctcactgcaatctccacctcctggctcactacaatctctgccttctggctcactgcaatctctgcctccagggttcaagcaattctcttgcctcagcctcctgagtagcttggactacaggcacatgccaccatgccggctactttttgtatttttagtacagacatgatttcactatgttggccaggctggcctcaaactcctgacctcaagtgatctgcccacctaggcctcccaaagagcgagctgggattacaggtgtgagtcactgcgcctggccacataggtggttatttctaatctgtagcatcgctcatgatcattcctcccctttctttactcacagttgcccattcattcaaaaaaaaaagtagagaattgaaaatttgaaccccaatggacagagtgtttattcagatttttaaaattgtggtagttcacaagtgcaggttctgagggcaccgggcaagcactggcctcccctggctcctgcctggaagaattccgagccagcccatttctagaatgtcatggaagaggaacgtgcaactactattcaaattcctacagtttctggctggcttcattaaacccagaaagaatgttcaggtaactattcaccatcaagcttaatctgatgactcaattgcagaactattcaaaggttgcctgtgttcttgggtcaacgagtagccatgattttgtactactgtgccaataaagacaaaatatgggttttgtcatcactaaacacatttaatatttgtatatgaatttatagtaaattacttgatacaatcacaaaacgatctctcatctgaatttactgtattgaaagacttgtgaataatgtggataatttaaagggtgggagtagtttttattaccaaaaagatgatctataagttttcatcaaggcctatgtttctttaatgctgctgaaatatgactaaaattataaaatgccaccatatataccttttcagaaatatacttcttccataaagagaaatagtccattaatataataaatttctctcctttttttttttttcttgagatggagtctcgctctgttgcccaggctggagtgcagtggcgcgacctgggctcactagaacctccacttcccaggtttaagtgattctcctgcctcagcctcccgagtagctgggattacaggcgtatgccacgacacccatctcatttttgtatttttagtagagattgggtttcaccatgttggccgctggtctgaaactcctgacctcaatttatcctcccacctcagcctcccaaagtgctgggattacaggcgtgagccaccacgcccgaccctgtaataaatttcaaaatagcaaaaatattcattaataaaacaaactcagcaaaaattcccttttatgcataaataaatgaatttttttggtttgtttttatttcagaaagcctattccatcaactgtgaaagactggggaattagaaaaaataataagtcgctgtcaggtgtgcatgaagaaaagacactgaagctaaaaaagacagcagaactgctatttttcatcctaaagaacaaagtaatgacagaacatgctgttatttaggtatttttctttaaccaaacaatattgctccatgatgacttagtacaaagtttcaatttgtttccccacaaaacaaagcaattctttcaagtcagttctgtgatctgggtctctaatctgtgctgtttcaaagttctctgtggcaaagcagcaactattcacaaaatatcaccaaaaacctattccacttacatccaaggcactgtcactacggtgattgtatgaagtttgaatgctgcaagttatgaaatatttggcccgctggattcccacatttgtcttctttctgtctttaagactcagggaggctaaatcagtgtttgattgccccgccaacccttcctgaaacttcagaccctgggtaggggaagagaagggggcatgtggtatcctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcatttcactgtagctctaaaatctgcttgtattccaagcatataaaattttcccccttagtgaattagttttaaaatgatattgttatatacatactatgaaatatgtataactttaacttctgttttaccagcatacccacacaaataacaagaatactacttatgaaatgtgcactttatcctcattccataaatgtcggtgcataccttatgtaagggagcagttcaataatccatgaaagaacttaaggcatttgttggtttatcagactcggaatctattttctcattgctctgaatatgtcatcactctaggttttacagatttattcctttgttacttctctaattcttcctttgtaaaaaaaaaaaaaagcaacactttttatgttatannnnnnnnnnnnnnnnnnnnnnnnnnnnnnnnnnnnnnnagaaaaaaaagacttgtttctgatctaatatcccagaaaaagtaactcattgctctgttaataatctcacatatacaagtagcttccctcccctctagttttttcttccttttcactgctgttatatttcatcatgataattcagcaggcccaagtaaaggttaaaaataaggtctatgcctagggaaactcagggcttctagtttctcttagaaaagctaagagaagataaggtctgaataatagcagaaaaaccaacatctacaaaacattaaactagtgttatacttgatgataacactatttgatgagtcttagagtccagacacaaagagacaaagctttgaagatgctttttgatctacctaggtggagttggtggtgctgatatttaaattcaggctactgcttcaatctcaattgctttgtaagtgaaaaacatgacccagaggacagcacagactatggccatggctcacatggtttacatccttcactgctcacgtgtttgctgtcaagccatttttacatctaaactaagatgtgcagcatttcacttatttagattcacttaacaaacaaatttttctgctttaaaaatgtcttattgtcccaagtgtactatagcggcatatagagctagctaatctctacaaaccctctgtaggccagtagttctcaaagtgtggtctctggaagagcagtatcagcatcatctgggaacttgtcacagatgcagattctagggaccactccagacctacagaatcagaaactcttgggggagggcccgaaatatctatgttttaccaagcccaccacatgattctgatgtactctaaatactgagaaaacctgttctagacaaatac

SEQ ID NO: 14762 - DNA, 10958 bp, Human
  misc_feature (1)...(10958): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgagatcacaccactgcactccagcctaggcaatacagcgagactctgtctcaaaaaaaaaaaaaaaaaaaaaggagctaataatgcatttttccttctgatgccccttttttttttttttgagagagagagtctctgtcacccatgctggagtgcagtggcgtgatcttggctcactgcaacctccgcctcctgggttcaagcgattctcctgcctcagcctcccaagtagctgggattacaggcatgcgccaccacacccagctaattgttttgtatttttagtagaggtggggtttcaccctgttggccaggctggtctcaaactcctgacctcaggggaccctcttgcctcggcctcccaaagtgctaggattacaggcatgagccaccgcacccagcattttttggtttttttttttttttgagacagagtcttgctctgtcacccaggctggagtgcagtggcgcaatctcagctcactgaaacctccgcctcccaggtttaagcgattctcctgtctcagctcctgagtagctgggattacaggcacgtgccaccacacgcagctaatttttgtatttttagtagagatggggtttcaccatgttggtcaggctggtctcgaattcctgacctcttgatctgtctgccttggcctcccaaagtgctgggattacaggcgtgagccatcacgcccactctgatgcttcttttactgcgacagtgaaatcagaaacagttgtcagggttgaaggacatattttgatttgctaaaccaatgattctcaaacttttgcatgtgttagaatcacctggaaggccagttaaagcccaggttgctaggccctaccctggagtttctgattcagttggtcagggtggggactaagatgtagtatttcatgcaagttgccaggtgatgctgatgctgctattccagggaccacactttgagaaccactgaactgcctcttgggcttaaaagaaggaagtatcagttccacgttcttcttccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatgaagccagggtaaggatagggtcctagatgggctcagtaccaaaggcctagtttttaccccattcagatcccagaattcccaaatgtcaatacagaagatgcattagcactgcaaaattggctagggtgataactgggcctgtaatttcatatctaggcttccttttcttaagaggaaagacagaaataaccacccttgctataatcagtgactgccaaaaaagaaaaaaagagaatacccaccttattatttttaactttttaagaaaaatagtaataatattacttgaactttataagtgaaatgttcaacacactaaaggcagtttgaaagttctgattactactagcaactgtaaattgtgcatggtgaaagtgacattaaatttgtttcccttttgcattcatagccacagtttattcctacaactgcctttcactgatactccctgatactctttttactcctaaggaataaagaaactggccaggtgtggtagctgacacctgtaatcccagcactttgggaggctaaggcaagaagattacttgagcctaggagtttgaggccaacttgagcaacatagtgagaccctgtctctattttcttttcttttttttttttttttgagatggattctcactctgttgcccagactggagtgcagtggcgcgatctcagcttgctgcagtctctgccaccctgggttcaagtgattctcctgtctcagcctcctgagtagctgggattacaggtgcacgccaccatgcccagctaatttttgtatttttagtagagacggaatttcgccatgttggccaggctggtctattttcaaaaaaattaaaagttaattaaattttaaggccaggcgcagtggctcacgcctgtaatctcagcactttgggaggccaaagcgggtggatcacttgaagtcaggagttcaagaccagcctggccaacatggagaaaccccacgtctactaaaatacaaaaattagctgggtgtggtggcgggtgcctgtaattccagctactcgggagactgaggcaggagaatcacttgaacccaggaagtggaggttgtagtgagccgaaatcacaacactgcactccatcctgggtgttagagacttcatctcaaaaaataataataataattacatttttaaaaaggaataaaggaattgatacaatgagacccttgctaattcttacacttcaaaatatttaacaccatccattgggtcttctccaagattgtggtcaaaatacaatgtattcagccatctggtgagtagagctttttggcattgccttcttattaggttgactagcgttggttttgtatgttgctatgagctacggttttcttagtcatactggaaagactaggacagatatggactttgcagccagaaaattctgtcagcctacgcagtacaaggtaattacagcatggtcttagggagccaaatagcctaggcaccgtggctcatgcctgtaatcccaccactgtgggaggctgaggcaagagaatcgcttgaacttgggaggcggagcttgcagtgagccaagatcgcaccactgcactaaagcctgggtgacagagggagactccatcacaaaaaaaaaaaaaaaaaaaaaaaagcctcaatttaaatctaagacctgccacatacgagctgtgtgacctcaggcagattcttaacctctcagtttcccatttgtaaaatggagatagtaatagtaactacctcacagtgcccttaagaggactaaataagttaaaataccaagtgcttagattagaacctggcatatagaaagttctgtataaacatttacttactactttttttctttttctatgtcacgtagtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgaggtatgagtttggtctcattcactcatgggcacccttctgtttcgtggttgcctgttggatgaggtccagagataactaaatgttggtatttcctgaaaagaagtatgtattctgagaacttcttctggttgaaagtagatcagatatgaagatctgtggggtttgttgttcagtatttttagtgttatcagaaatactgtaccatgttgattatttgtcaatcaaggaaatgtaagtggtgaatgtttagccaagtagaacagcttagatgggcatgggtagtgttctgtattcttctggccagtcggacagctgtgcttcttcagtttgcatgtgtggcagctgtgttttgacagtggccaagatgttagaggaggggtgtgttttctcattggttctcgggctctcagcaccacagatgtcctgacagatctgtgcttgtcctctcagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggtgagagtcaaatcctcgattcctcccatctgttcataagaatgttctagtccttttcctaggttcttgttcccatggtttttcttcaccgtatatatatatttgttcctgaaaggtatacttttgccttccatcctgactcacggtttttatttcgtggtgaggctagagagtatgaagcacctgttacatagcttgcagttgtatcaaggatagagttactgggctgggcacagtggctcatgactgtaatcccagcactttgggaagctgaggtgggcagatcatgaggtaaggagttcaagaccagcttgatcaacatggtgaaaccgtgtctctactaaaaaaatacaaaaaaattagccgggcatgatggcacattgcctgtaatcccggcctacttgggaggctgaggcagaagaatcgcttgaacctgggaagcggaggttgcagtgagccaagattgcgctattgcactccatcctgggcaacaagagcgaaaactccatcaaaaaaaaaaaggccaggtgtggtggcttactcctgtaatcccagcactttgggacgccaagccgggtagatcacttgaggtcaggagttaagagaccagcctggccaacatggtaaaaccctgtctctactaaaaaaacaaaatattaaaaattagccaggaatggtggcaggtgcctgtagtcccagctacttgggaggctgaggcaggagaatcattcatttgaacccaagaggaggaggttgcagtgagctgagatctggccattgcactccatccagcctaggcaacaagaatgaaactccatctcaaaagaaacaaaagaaagtagagttactaaaagcatgtttactggtgacttttaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccaggtgagctctccctcaagagctagaatacgcagcagtggggctggggccctgacagatggcaagaaggcatgagtactgttgatcatttcctcagacctccaatctatgtcttaacagattagtagaaattgctgcaaaaaaccttcaaaaagaagtgattcacagaaaaagcaaggaggtagcttggaacctaacttctgttgaccttgttcgagcaagtgaggtcagtggtagttctctctttttccccttccctgccctcagcatcccgcattttctggtacagaaaccctagtcactgtatattgaatctttttccaaggttctcaaactctggtgttttctttttaatcttaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggtcagtattttctaagtataagtcttttttgttgttgttttaagaaaaataattgttggctgggcacggtggctcatgcctgtaatcccagcactttgggagcccaaggcgggtacggtgatcacttgaggtcaggagttcaagaccagcctggcctggtgaaaccctgtctctactaaaaatacaaaaattagccaggtgcagtggcacatgcctgtaatcccagctactagggaggctgaggcacgagaatcatttgaaccctggaggcagaggttgcagtgagccaagatgaaaccactgcattccagcctgggtgacagagcaatactctgtctcaaaaaaaaaaaaaaagaaaaagaaaaatagccaggcacagtggctcatgcctgtaatcccaacactttggccaaggcgggcagatcacctgaggtcgggagttcgagaccagcctgaccaacatggagaaaccccatctctactaaaaatacaaaattagccaggtgtgctggcgcatgcctgtaattccagctatttgggaggccaagggaggagaattgcttgaacctgggaggcggagattgcggtgagccaagatcacaccattgtactccagcctgggcaacaagagtgaaactcagtctcaaaaaaaaaaaaagaaaaaaataattgtcatccgctttatagctgtatatgcatataattatgtctatctatatacatatatatgttttatttacttattttggtctcttttaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtaaaaatccagtgtctctgcacctttttaaaagtcttcacttaaatattgaagcaggaaaggcctctcgaaggggatttatctgtgaaagctctgaaagtaccatggccacttctgacagtcactttatttgagcaacaggttcagaagggaactgggttgttcccacagtaaccagggtcttaatcaatttcaatttttgataacgaattgaacatttaaaaatatatacaggccgggtgcgttggctcacacctgtaatcccagcactgtgggaggccgagtgggcagatcacctgaggtcaggagttcgagactagcctggctaaaatggcgaaacccaatctctactaaaaatacaaaaaaagcagccaggcagtaatggtgcacggctgtagtcccagctactcgggaattctcctgcctcagcttgaacccaggagaacccaggaggcggaggttgcagtgagccacgttcgtgccattgcactccagcctgggtgacaagagcaaaactctgtctcaaaaaaaaaaaaaaagtatacacacacacacacacacacaaatagaataaaatatacaaaaagagaattccgtagtgctctttggtacaccctttgtctagcagcaatgactatcaactcgtggctagttgtgtttcatctgaaccttcatccccctcctcctggggactattttgaaataaatctaagacatcagggccaggctcagtgatgcacacctgggaggccgaggcaggtggatcacctgaggtcgggagtttgagaccagcctgaccaacatggagaaaccttgtttctactaaaaatacaaaattagccaggcgtggtggcgcatgcctgtaatcccagctacttgggaggctgagacaggagaattgcttgagcctgggaggcggaggttgcggtgagccgagaccatgccattgcactccagcctgggcaacaagagcgaggctccgtttcaaaaaaaaaaaaaaaactaagacatcagataattttatccataaataattcaatgcatagctctaaaagataaggactcttcagaaacaaccacaggctgggcacagtggctcacgcctgtaatcctagcactttgggaggctgaggtgggtggatcacttgaattgaggagttctagaccagcctggccaacatggtaaacccccatctctacaaaaaaatacaaatagcagccaggtgtcatggcacacacctgtagttctagcaactcgggaggctaaggtgggaagatcgctggagtctgggaggcagaggctgtagtgagccaagattgtgccactgcactccagcctgagcaacagagcaggactcagtctcaaaaaaaaaacaaaaacaaaaacaaaaaacagtatactatttaacatggcaaactctttattagtagttcttctctctcctttccccacaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggattgctaaattgtcacagtagtaggaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgtcacttaggtcagcactcccagacgtagcacagaaaaaccctttgacacaaaccatgtgttctgatttttggttcagaaaatattgaaactgtgagttgttttttttttaacaactgggaaaaaacaaaaacaaaaaactatagttagaaaaatggaagttccataggttctatttcttactctatgtatggctttgttttcagtctatttctaggagctttctctgaatcgctaattgtcctttcagttgaaatctaatttatacaatcattctatacttaaaggttaaatacatcttaattaattttttcttaaagtcaatgtaagtcactttgttttgtttttttttaatctacgccatatgcctcatgaaaccagctgttctagaatcagtcctgagaatatggcttaattccatggaaacataactcctatcttgggacctgacataatatctatctatcctggggaactggtaatatgagacttataggttacagcagaaatgctacatgttgacaaaagccttaatcgttccactgggagaactaattgataattgtgttaagattgaagattaaccctgtgttaatctcacttgagtctatcctgacagtagttcagattctggaaaatgataaactgacctgctagatgtagaattgtttcaaaattagtgttgaaataccttgttcacagatgaatatctgggcaggatctgagggtgtttggaatgacaccccccaatccagttgcatagatgggatgtctttgcaggtttgaggagatcatcgacctgcagagccccctttgacccagtacctcacgttttatttaaaatctaaatctggggccaggcgtggtggctcacgcctgtaatccaagcactttgggaggccgaagcgggtggatcacctgaggtcaggagtttgagaccatcctggccaacatggtgaaaccccgtctctactgaaaaaaatacaaaaattagctgggcatggtggtagcacgcgcctgtagtcccagctactcgggaggctgaggcaggataatcgcttgaacttggcgggtagaggttgcagtgagccaagatggtgccactacactgcagcctgggtggctgagcgagactccgtctcaaaaaaaaaatctaaatctgacatttgatgctatttttattaatattggaatgttctgtcttgaactttattcaatataatcaagaataaa

SEQ ID NO: 14763 - DNA, 10958 bp, Human; identical to SEQ ID NO: 14762
  misc_feature (1)...(10958): n = A,T,C or G

SEQ ID NO: 14764 - DNA, 20908 bp, Human
agtatccaagagaaaagggagggaggtttctctaaaacaagacctaagagaaggaacattattgtctagaaagaaagaaataattgaaagtttctgaaaattgagatttcttcatttcaaatgaccttattattagcctgaaaaagcacacacacaaaaaatctcttccttacgtaatagtaatggtgggaatcaaaatgaatccatagatggtggatccagatgggaatgctgctacacgatagtagaattgttctgggaatccacagtgggaaaggatcagttgtagcaaaaagatccagagttgtgcagagggaccatgtcagcagtgatcacttttcagtaaccgtgctttcctgatcatcattttagcatcactgtttggcaagactgtggatggtaggagtggataccagttttttttcactgcctacatatgcttcataagctgtattttgtcttttttcctctacagacctctgtcttctttcctttcatgcccgtaatttatcaaatagatatggttttaatactttgctgatttgacatagcttcctttttcatttcattgattgctactaaaagatgcacaaggctttcaggtcctcacacgaatgatgagataagatccaacatcaagaatctgaagcaaagacactcgtggtttcagaatctataaacagagtttggtaaggccgggtgcggtggctcacgcctataatcctagcactttgggagcctgaggtgggcggatcacccgaggtcaggagttcaagatcagcctggccaacatggtgagacccagtctctactaaaaataaaaaaattagctgggcatggtggtgggcacttgtaatcccagctcctcaggaggctgaggcaggacaattccttgaccctgggaggcggaggttgtagtgagtcgtgattgcgtcactgcactccagcctgggcgatagagttagaccccggctcaaaaaaaaacaaaaaaaaatagagcttggtgattttctgttgagtttgagtttgttggaggaatgcataatgattaggattaggtgtttttctattttaacaagttgacttctagagacatagaagactattctgacatgctacttaaaatttccatacaaattcaggcatatttgtaaaaaagaaaaaaatatcagtgcaaaataagcaagatcacatgagacaactgaaaggcacaaatactatccagatgttttttgttattgcccatttattttggccagtgaacatttgaaaggcccagatatgaagttcagggaccatgcactttgtgtctctccccagtattaatgcacttacatctatctgcttttctcttttagtggaggagataatgcctgttgtgtacagcaagacagtgggtcattgtgtatttacagaagtgatgtggattcctcccagactcattagtgaccagggctgctgggcctgtttgggtttcctagactagagaagaagacaggaaccaggatgggaagacggacatgttacattttaagctggagcttcccctgcagtccacggagcacgttctcggtgtgcagctcatcctgactttctcctatcgattacacgtgagtcagtccgctgggaggctgtcctctcccttgtgtctttttagtagaccagagtccttcttctgatttctagaagacccgcactctagcgggccctcttccccatgtagtttgggatttaacttaggccaatggaatggttttcactagtcatattaactgacatgggctattaatagctcagaaggttctaggcagtgtttcctgcatggctacgctaggtatgtgagggcctcttaggtttcagccaagacaggtgactcttagcacccagagcccttcagatctgatggcggttggtattgttggtccttctaatgatttcagaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacgtaagagcgcttctcattgtccagctcctttgtttctctgtgttactgttcattaagttctttaaagaggggaatgaaaagtagaaatgtcaggccaggcgcagtggctcatacctgtaatcccagcactttgggaggcggagatgtgcggatggatcacttgaggtccggagtttgaaaccagtctggccaacctggtgaaaccctgtctctactaaaaatacaaaaaattagccaggcgtgtggtgcgtgcctgtaatcctagctacttgggagactgaggcaggagaattgcttgaacccaggaggtggaggttacagtgagctgagatctcgccactgcactccagcctgggcaacagagcaagactctgtctcaaaaaaaaaaaaaaaaaaaaaagaaaaagaaaagaaaagtagaaatatcatttctttgtgggtggcaccaaagagggtctctgtagaattcttgccatgaattttttcaaactacagagaaggtacacgcatagttacacctagaagggaagagaaacaaaatctgtgtttgtcgaagaactaaattgcttattgcttttaggtccacgtgggtgcacacacacacattgtgtcttccatacacacgcttggtcacacgcaggatgtactccgaaggacactgtaaaatgatgatgtaaaatgttcatgtaaagtatttcagaaatattactagccatagtttactgaactcataacatatgccacccctgagtgcaggcgtttacctatatcatctcctttaatcatcatggcaacctctgagctgcctgcattgtcctttccccgcactccagccacttgtcccatcactgcccccgcttgctcccttccagcccccctggcctttttgctgttcctcaaacccaagaagcagctgccacctcagggcttttgcttttgccatttcctctgccaggcatccatgtggcttatcggaccatgccattcaggtccctgttcagatatccccaagcccagtccttctctgacctgcttctacagtagcagcccctccttccaccattcctcagccagactctccctcctgccgcctggcctactcaggatatgtgtttgtgtgtttatttgctgtctccctcagccttgacagcagtggcatctcaaatactatcacatccgtgcctagcacactgcctggcagatggtaagctcacagagatacttgtttaaataatgaactcattttgcagaagacgtaactggggcttaaagtgattaattttcccaaaggctcaaatcttgaaagataacagagcctgtctgtgtgcagaactcatgcatctaatcactcattcctcacttttattttatcacaatggggaccatagaagttgagctgaggtacttctgaaaatgaaaaagggatgttatcggttattacagccataaacccagacttgtagatatatagtgggttttactgttgctctgactataatcaatataagttgtaaagaataggaagctgcaacatatgaaatgaatatggcactttttgtttgaatgtctatatatcagattacattaacagcaagcaattatttcctcctttaagggattatatgcttatggtttgcattttatctatatctctatatttaaaagtgataaagaacttagcacccagaaaagaccaagaaaatgacaaaggagttggaagtatggtttcttttttttgtctttgtgtaggggtttttatttgtattttatttttatttttgagacagagtcttgctctgtcacccaggctacagtggagtggcatgatctcggctcactgcaacctctgtctcccaggcttaagagatcctctgatttcagcctcctgaatagctgggattacagccatatgccaccacgcctggctaatttttgttttctttgtagtagagatggggtttcaccatgttggccagactggtctcgaactcctggtctcaagtgatccatctgcctgggcttcccaaagtgttgggattagaggcgtgagcttccatgcctggctttttatttttttttatttttatttttttttgagagatgaagtctttctctgtttcctaaactggagtgtagtgagtggcatgatcatcattgactacggccttgaactcatggcctcaagtggtcctcctgcctcagcctcccaagtcactgggattgtaggcatgagccaccacacctggcgaaaatacggtctgttaaaataatttaaggaattctttctcccgctgagataaagaggggtattttaaaaatagctttaaaacctgtaaaacatggacactgaccccttatttccatccacagaaagaaagactgagagtaaatgggcttaaattgttgcaagagagtttattcatctttgaagagaagattattgatactgcagtaggccaccaagaacaagagggtgctctgtgggaccagcctgggtgggcagcagcctgttttattcatctttgaagaaaagattattgatactgcagtaggccaccaagaacaagagggtgctctgtgggaccagcctgggtgggcagaagggtagaaggaaaaggggaggagtctcccaggtgctcacaccacatcctcctcccgtgtcccagatatccgtgatcaacgggaccagcccctttgcctatgactacgacctcacccatattgttgctgcctaccaggagaggaacggtgagtcacaggtagagcccattcagccgctgctcaggactttcaaggttagtgggggcaacagagacaagcagaactggaacccttgtgatgaaaatgtcaaaacccgtgaatgctcaacgatgggagcaaatatgctgtccaggatttgtctttttcgtcctgatcttcagacctgggaccgcccccacccctccagcatcccatggtccagcaggctagtgatggttaaatgccatcattatcccaccactggcttagtgggtttctcttttaaaaaatataagcctaattgagttgttccccataccacacctatccacacctataacagatgccaaagacaaattgctgttcatgcttttcagagaaaaacagagaacgtgggtgactctccccacattagcagtccagcaggagaacaggagtgcccctgtttcctgccagaaggcacagtgtgcttattccttacagagctctaggccatggcatgtgtggactcggcacgtttgtctggtcggtggctgaggttttctctaaaagcatctacagtgttacttggcaagcagacatcatggagactatacacagacgtctcacaagggggatgactgcaaatccagtattgcttactgattttatggcatatactagtggcattattgcaataatagagggaattttaaaacaaaagtagaaaacattgccctacaaatcaactattttttcattcctttcattctttagccttctgcagatctttttatacagccattgtagtgtagaaacacattgggatccaagttacttttatttatttaaacttggaatataaatacttccccacacagctacaaagctgtgatactacttttagtggcagtatagtattccttcagttagccattcagcacatgtagaagaaactctttccaagttttttatgtattttaacaaaagtattttgactattattttaacaaataatgtgtgatcagctttgcacatgcaatttctctttccttccgaatgatttctttcagttctgaagcacaggataatttccaggtatcaaataatctttatagccttcaactgccagagtcaaacagccatcgtggttaatggttaatgattgcattgcagttaccaccgtcctgaatgatcccaaccccatctggctggtgggcagggccgcagatgctccatttgtgattaatgctatcatccgataccctgtggaagtcatttcatatcctttctgttaaagagtccatgttaaggctggatgtggtggctcctgcctataatttcagcactttgggaggccaaggtgggaggatcatttgaacccaggagttcacaaccagcctggccaagatagtgagtccctgtctctaccaaaaaaaaaaaaaaaaaaattagccaggcatagtggcgtacatgtgtagtcccagttacttgggatgccgaggcaggaggattgcttgagtccaggaattcaagcttgcagtgagcgatgattgtgccactgtactccagcctcggtgacagagtgagaccctgcctcttaaagcaaacaacaatttaaaaaaaatcaatggtagctcagttttcaaagaggaatgattccttagttgtctcaagtagtaacagacgtgggaggttttctcttggaaatcatgacagggttatagcctcataaaaatggctgcgtctttgacatcttaggctacatgtctcagaaaatgactgtatgtctgctattcatataggaacaaataattcatgtcttggtcctatttgtttccaagcaattcttctaggtaagaatcatccatatttatgtcttaataatcatatgatatcccttttatgctaaggttatgtgaaacattcttgccagtccctgtctgacctaaactttggtttaattttgacttaggtcgactaatggaaaatgaaaccaacaccaacactgcagagaagcaaacaaaagagaaggcattttaactggggtcttaggaattacaattccagagacacaaacctaggaagcagctaaattgtgttccgtacaggtgcaattaggcaggggctaagggtgttccaagtttacacaactggaagattttagaagatggatggatggctggttaacagctcaggatatctctagtccatgatcaatctagtttggcatagttgtctgtttaggaggttggtcatcaggcttggtatataaatagctcaaatcaaatgtggctggttttaccatttggccaagttcaggtcagcttccatctgggtgtgtacatgacagaggtcctgcctcctttcgagatacctctgccacagccaattccatcttggattttctcttcatacttaacaccatgtggcccttcactccttaactgtccatacttatcagccaggattctgggagatggtaaagttcgcctgggtgcagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcggacacctgcgggcttgtgtgcttttccctcagagacaacggttctttccggttttgctctacacagttccgtatcttcagagctcctgcagaattgtcagggactagtttgtggaaaggtctgagagttcctggaggctataattagctttttgggttttccttctttgccttagcgttgaatttcaggagaaaattgcagtcagttcagacatcttggaaagagtcccatctctggtcaagcagagacttttcctctgttgaactgaggaacacactgtgcatttctaccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaagggcaagggccgcattagcacaggcaatcagggagggccgctgaaggacacttggaccgtccacctgccccagcccaacagtcagtcatctgtcatcagctcagctgagcagccctggatctttgccgtactgtgactgggctctttgccctatttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaacagggtgcccatcagagtggggcgggcagctttgggaaggacacaagaagcagtaagagtgtaaagaggatgctggcctgggcaggccagtccagcctggccactagcagaataccaagcagtccagtggattaccctcgtggctaagcaagtgtctgcaggagcagagatggctggaaggggcctctgcacacggaagatggcttgttcagcccattcacctcctgaggatgtgggcagtctcctccaagaacacatggagctgcttcctgatcccaagcaggtcattgccactggaaggacatggccccggtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaaatgaggccgagcatggtggttcattcctgtaatctcaacactttgggaggccaaggtgggaggatcacttgagcccaggagcttgaggctgcagtgtgctatgattgcaccactgtactgtagcctgggtgacagagtgagaccctatctgttaaaataaataaataaataaataaaaaagtcaaaatggaagatcacatgtacctttttcgagggaaagggtttggaatggcaaagaatagggagggcagaggttgcacacacctgtctttattactcatctacagccatgctttacaaggctctgcctaacgaccttggaacttccatgaggtctttggtgaaagtcccctagttcttccccaggtagatgagttttcagtgggattcacatgccatgtgaaatctacgtgttggataattatgactgtgtctggtgaatatgaaattatttacagaccagatgttgatagtttctgactctgaatcacagcatagctgcaagaggtaaataaaaagcaagaggccgggagcggtggctcacgcctgtaatcccagcactttgggaggccgaggtgggtgaatcacaaggtcaggagatcgagaccatcctggccaacatggtgaaaccccatctccactaaaaatacaaaaattggctgggtgtggcgacacgtgcctgtcatcccaactatttagtaggctgaggcaggagaatcgcttgaaccctggaggcggaggttgcagtgagccgagattgcgccactgcactccagcctggcaacagagctagactccgtctcaaaaaaaaaaaaaaaaagaaatatagaggattttattaactcagctccgacccatagctaagttaaggtttgatgttattactgaatatttggaggcagaaagactcctgattttgccaaatgattagtacagtttcggcttaagtcagatgaggcccccctaatattccatcatgtaaggctaataaagcaattatttcttttttttttttccttccaacttttattgtagactcatggggtatatgtatgggtttcgtatatagctaaattgtacaacctgggggtttggtgtacagattatttcatcacccacgtaataagcatagtacccagtaggtggtttttcttttctttttctttttcttttttttttttttttttgagacagagtctcactctgttacccaggctggagtgcagcagcatgatctcagctcattgcagcctctacctcccaggttcaagtgattctcctgccttaccctcccgagtagctgggattacgggtgcccaccaccatgcccggctaatttttgtgtttttagtagagacagggcttcaccctggtggtcaggctggtctcgaactcctgacctcaagtgatccatccgctttggccacccaaagtgctgggatcacagcagtttgatcacagaagttattatggttggcattctggcacacatctttctaatcttttttgttgtatgtaacctttttagtatcacaaacaacacttttataaaccttgtgtagaaatcattgttgctggtttatttccttaagatacattcagaaaacttatgaccattgttaaggatcttaattcattgccaaaccacagccaggaaagactgctaatttctactcccagcagcagggactcctcgtttcagataccaccatggattaaaggacctcccaatgctctatccttttcagattactggactctgcccgtttgtttctttgtttttgagatggagtctcgctttgtcacccagtctggagtgcaatggccccatctccgctcactgcagcctccacctccggggttcaagctattctcctgtctcagcctacctagtagctgggattacaggcatgtgctaccatgcgcggctaaattttgtattttcagtagagatggggttttgccacgttgaccaggctggtcttgaactcctgacctcaagtgatctgcctgccttgcctcccaaagtgccgggattacagtcatatgccaccaggccaggctgagctgttatttgtaaggggtgggtggggagcttttatttactgaaacatatcctgtattcattggaacatgttatcaagcctgcgcctctgggcggaggctagggcagggagggcacagctcctaaggccacctggtctttcaactcctcccagctgggacactgcaccgggaggcagcacggattcctgtgtcatcaaggtgcctgggtcttggcttagggctgaggttggggccttgggaagggtttggattccaagtcccttggctgcaaggatgcccccaagagcgaggagggccaagattaagattcgacttccttcactagggcctttgtcctcccaggagctcccaggttctctggcgattgggggggtgaggaagggttacaacgttcatttgtggtcagttagatgagaagtgactctgccagcgtcctttgacatccccggctaaaaggtgcgcctcttagagccccagcccacctgggccctcctgctctgccctcggccagcgcccctccccgagacatggcccctcggtcgggggtggggagagggagctgggggcaaaacctgctccttccttccttctcccatttccctggctcccgccggccaccctgggaccgcagccacgtctgaaagctcctcaccaggcagcgctgaagattgcggggcagcgccgagggttgttggccggcgcgcggggagtagagggcgcgggccgcagtgccgggctccggagggagctctgcgccgggtccttccctgtggtagccccaggacacccccatcctcaacatcccattctgggactcctgccctgttcccagattcgctctgcctcgagtctccaggagcttccagtggcttggttacccccgactcttcgtccatgcctcttagagcccctttcccagcctcactgggtgtcccttaatagtcttgggaccttaaggagcaagtcagcccctgcggaacctcccagtgaagagaaagagctggctgtgcggtggaacttggaagagacgacgtctgggagcttttgctgagcccagggggagaggcgtccctctggctgctgctccagctctggcagacacgccaagctttgaggtactttggttcttcattctccaccggaggtgtccccacactcggttgggctgggggccgggccagtggcccagctgtgacgctcctctgtcctgcaccagagacctgggttggcgggaagagctgggggtggcttttccatcagcaacgtggaaagttcatctcccctgctagcgctggtttggaagtgtcttgctggggcttcggctgcacgcgggaatcctcactgcgcagggcaggggtcggggtgcgggttcttattccatacttgggtctcaaagggtgtggctttcaaaagctctccatgaaattcttgagaaaaaatagcttggtgagttaatttgcaaccagactcaggggaagtggagtcgtgcctcactgcctctagggccttgatgttaggctttaggaaaggccctctgggccccaggacagtacaggtgcctaggaaatgtttttttgtttgtttgtttgtttgtttgtttcgagacggagtctcgctctgtcacccaggctgaagtgcagtggcctgatcttggctcactgcaacctgtctcctgggctcaggtgatttcctgcctcagcctctggagtaggtgggattacagacgcccgccaccacacccagctaatttttgtatttttactagagacggtgtttcaccatgttggccaggctgtccaattcctgacctcaggtgatccgccccgctgaggctcccaaagtgctgggatcacaggcgtgagccatggcactgggcccaaatttttgtttttgtttttgttttttcagatggggtctcactctgtcacagagcctggagtgcaattgtgccatctcggctcactgtaatctccacctcctgggttcaagtgattctcctgcctcagcctcccgagtagctgggattataggcatgagccactctgcccagctaattttagcgatggggtttcaccatgttggccaggctggtcttgaactcctgacctcaggtgatctacccatcttggcctcccaaaacactgggattacaggcatgagtcaccgcacctggcctaatttttttttttttttttttttttttgatatggagttttgctcctgttgcccaggctagagtgcaatggcacaatctcggccactgtaacctgtgtctcctgggttcaagctactctcctgcctcagcctccaagtagctgagattacaggcacctgccaccagacctggcctaatttttgtatttttagtagagataggttttgccttgttggccaggctggtcttgaactcctggcgtctggtgaccacccacctaggcctcccaaagtgctgggattacgggcgtaagccactgtgtccaatgtctagcaaatgcaaatgttgacttcctttctctctccttttacacagaggcaaggcagtcaagaattgcattttggccaggcgctatggctcacgcctgtaatcccaacactttgggaggccaagtctgcgatgccctcatctctacttttttaatttcgtgtgacctgtttgtattatttttctaaaaattaaacatgtaataaatatgtgcccccagaaaagaatcaaaaaacggaagaatttagaggggaaggggacagtccttccaggatggaagagttcactggacaaaggcttaggagtgtgacccaccacagggccctgcactgggagtctggctcttggacttaagcccctgccctgcctctttcttactgggtattaatgtctctgagccccactgcttcaattaaaacagatagggatggttatttctacctccaagggacttgggaggataacattcaatcatgaagatgaaagtgcatatcacagggcctggctgactggttctccctaactttgcacccttggccaattgtccactgtgctgaatgtaagtctccttatcagaaagctcccagtgaggaactggtcttctggagactctgtgtggcatagagtgattcaaccaccttaagaagacctctggctttcctggaacacaggtaacaaacaccttagcttgggatcaagatcctccctacccagggaagggctgggctggccaggacaactgtgtttgggccagagcagcagggtcctgcactctgcagggggcaatcacaggtgggagaggcccacagcctgggatcagaagtgccaggagcttcggaacaggagtcctggagtcccagctttcttgctgtctctctaagccttgagtctttcacctgaaaaattgacatcatcatgcccacctcagggcccagagttaagttatccagtggactcgaagcacctagcacttgtgatcattgaagtcagcaaatatgagttcccttcctttctggcactctgttggcaagggagctcaccatccatcagccagcactggaaaaagtacagttgcacttgtagcggaggtggggggctactctcctcatcttccaggttttccaggagtgggtgtggggatccagaaggcagctcgggagtcagcaggtgacagaggtgttgggcatcctccgctcactcctgtccccgcattgaggcgaaggagcagaggtgagatctgctcacaagttagaccctggcttctctcagtgggcagtgtggacaggggaagggggcaggcaaggagcaaaggatgcaggagcaaggagaaaacttccaggctcctcccttccaaagtcacccagccttgagatcattgcagatgcaacaggtgcaaacagaagaacactttaggaccttggaatgcgggaggctggctcagtgttccttccaccctgtgagaaatgcgtgacattcttaaggtccactaaaggctcagggtggttggacgccagaggatggcctgggagatacagggattggaagggtaggtggcctgtgggtgtctcctctgtggggagactcaccaggtggagggggttctttctctccagatgtagctcagcacagggacagtaacagtaacaggggcatgtgtgtaaggaatgcttccccaggccctcccctcataggtgtttgcagcagcatccatcacaacagctctaagaggttaaatattgcaaatcccattctacagaggtgcaaattgagcctcagagaagttaagtcacttgccccaggtctcatagctccccattggcagtgctgggatttggagccagctctctcgcttccatccatcaggagaccccgccagttcccagccatttggagaaatgccctactcagacttattcaacctcagcaagcctggtggtggtgtgacatccgcctaaaccgtcatcaagccctttagctccacaacccaaaagggtctctctacgagttatcctgaagcaaaaggcaggcaggacagctctgttcccaccctggggagctttctatgtacagggctgtctctctgtagggctctgatctcctctccttcctgctttgccagatgtcgagacatctcccatggatttgtgatcagcgttgcagctctcccagcagccctggacggtggtgagtcccctcagctggccaggacagtactctgctctcacctctctgcttcttgggctccatcccagctccccatcaactgatcttcttgcaaacccacagggctccaggacaccctccttctggagcccatgctgcctacagcacttcactccccaccagtgatgacaacagttgctgttctttgtccactttatttacttgtttatctttaatgacaaaagttttttttttgttgtttttttttttttttttgaaacggagtctcactcttcactcaggctgcagtgcagtggcgcaatctcagctcactgccacctctgcctcccaggttcacgccattctcctgcctcagcctcccgagtagctgggactacaggcgcccaccatcacgcctggctaattttttgtatttttagtagagatggggtctcactgtgttagccaggatggtctcgatctcctgacctcgtgatccgcccgcctcggcctcccataatgctgggattacaggcgtgagccaccgcgcctggctgacaaaagttttatacctgcctgttaaaaaaattatataatacagaagcacaccttgtaaaaggtgcaatcctcagttatgggcatgactgcgtgttcccttcccccatcttcattataataaccccccaatccccccagatcctgtgagccaggtaccggaattatccctctttcacacacgggtaaagtgatccgtcacagagagatttaagtgatcttcataagcaagatcataggctaggaagtggcagagccaggattcaacctcggcgagcctggtggtgctctgacatccaccgaagcccccatcaagcccttttagctccacaacctaaaagggtctctctaagaggtatcctgaagcaaaagacaggagttctctttgaaacatagtatttctctctacagatagatagcctgtaggtatgtaagtaggtgggtgggtgggtaggtagacagtttgatgatatcccacattattctgcaactggacttctgctgtgagcacagactatattctggcctatgtcttgactccgtattcctgggaaagtgctcgactgagaccttgggagtcttgggaagtccaatgggtagggtagccgaatctgagggctgatccctgagggcactgggcagtaattggggcatgggatgggcatgagggcccgggtccctaaagttgcccactccacccgaaggcccccagccgcccgcatgtggctgccacggttctccagcaagacagtgacagtgctcctcctggcacagaccacctgcctcctgctcttcatcatctcccggccagggccctcatccccagccggcggcgaggatcgtgtgcacgtgctggtgctgtcctcgtggcgctcgggctcatccttcttgggccagctcttcagccagcaccccgacgtcttctacctgatggagcccgcgtggcatgtgtggaccaccctgtcgcagggcagcgcggcaacgctgcacatggccgtgcgcgacctgatgcgctctatctttttgtgcgacatggacgtgtttgatgcctacatgccacagagccgaaacctgtccgcctttttcaactgggcaacgagccgcgcgctgtgctcgccgcccgcctgcagcgcctttccccgaggcaccatcagcaagcaggacgtatgcaagacactgtgcacgcggcagccattcagcctggcccgggaggcctgccgctcctacagccacgtggtgctcaaggaggtgcgcttcttcaacctgcaggtgctctacccgctgctcagcgaccccgcgctcaacctgcgcatcgtgcacctggtgcgcgacccgcgggccgtgctgcgctcccgggaggcggcgggcccgatactggcacgcgacaacggcatcgtgctgggcaccaacggcaagtgggtggaggccgaccctcacctgcgcctgattcgcgaggtgtgccgcagccacgtgcgcatcgccgaggccgccacactcaagccgccacccttcctgcgcggccgctaccgcctggtgcgcttcgaggacctggcgcgggagccgctggcagagatccgcgcactctacgccttcaccggcctgaccctcacgccacagctcgaggcctggatccacaacatcacccacgggtcggggatcggcaagccaatcgaggccttccatacttcgtctaggaatgcgcgcaacgtctcccaggcctggcgccacgcgttgcccttcactaagatcctgcgcgtgcaggaggtgtgcgccggcgcgctgcagctgctgggctaccggcctgtgtactctgcggaccagcagcgtgacctcaccctggatctggtgctgccacgaggcccagaccacttcagctgggcatcgcctgactgagaactctgggccttagagcaggccccgaactgtggtcgccaggcccaggaggcgactgcatggtggagagggagctggggcgcatggggaagcaggtccctactatcaaccgggagtttggggtcctcccctgaagtaggcaaggactgcacgtttctttctctcctgattctcggttttcctttgagtcttctggagctgccttctcatcaggtgcactcttcatggaaagcaactcttgcccctacctcttctgggcgcagggagtaagttactgctaaattaaattaaatgtgtgccaggccgggtgcggtggctcatgcctgtaatcccagcattttgagaggctgaggcgggtggatcacctgaggtcaggagttcgaaaccagcctggccaacatagtgaaaccccctctctactaaaaatgcaaaaattagtccggcgtggtggcacactcctgtaatcccagctacttaggaggctgaggtgggagaatcacttggactccagaggtggaggttgcagtaagctgagatcatgccactgcaccctagcttgggtggcagagcaagactctatcaaaaaaataagtaataaatttgttcaaaagtcctgcaatctagtgaactgtaacctcattttttctctcttttttctttaattgcatgattccatttatttaaagcagaaaaactagtctatggtgatagaggtcagaataggggatactttgtagggaggatttgactgggatgtaaccttatttattatgtaaacaaactacaacttgaccaggcagtatattcttgtaagaagaaaggagtcttctccaatcatagcagccagccttcagccaggggcagactgcagactgaccagatgtgtccaaattagacaaaggttgagctgtaaccaatcagcctatatccaatgccacttcctttttctgtttataaacgctgcttgcccactgttgctgggtggaggtctctgaaacctctctaatgtagatctctcatttaatggggagggtttggcctttaatcaccatcatccctgaacaaagactgaccaattggactcaaatgctattgaactatctttattgcatggactttgagttatttgattttgactagttgtttgttgaaactcctgataaggagtgtacttcagtttcttggcattgtccactcatagccatcataatagtctccctggtcgggcacagtgactcacgcctgtaatcccagcactttaggaggccaaggcaggcagatcgcttgagctcagaagttcgagaccagcctggccaacatagtgaaaccctgtctctgttaaagatacaaaaaatagccagtgtggttgtgcatgcctgtaatcccagctactcaggaggttgaggcaggagaatctcttgaatccaggaggtggaggttgcagtgagccaagattgcaccactgcactccagccagggtgacagagcaagactccatcttaaataacaataataggccaggcacagtggctcaagcctgtaatcccggcactttggaaggccaaggcgggtggatcacttgaggtcaggagttcaagaccagtctagccaacatggtgaaaccctgtctctactaaaatacaaaaattagccagtgtggttgtgcatgcctgtaatcccagccactcaagaggttgaggcaggagaatcgcttgaacctgggaggtggaggttgcagtgagccaagattgcgccactgtactccagcctgggtaacagagcgagactccctctcaaaaataataataataataaaataataataataatagtctctctgatgtgttgactcccctgggaagtcttacatactcctatgcagccattctttataaatcaactggtctgttagggttagagtaacaaaaacatgaagaaagcataaagaatcattcaactaaggtgaaattgtgaagtcaatactgaaacaaaacaagtccattatgatggtgacaggaaatggagtcagggcccaaggttttggtcaatctctcaaaattgagaggctgaccaaaaggcagaaatgtttaaattcaattaaatttggcccaaagttcccagcactttgggaggccaaggtgggcggatcatgaggtcaggagatcgagaccatcttggccaacatggtgaaaccccatctctactaaaatacaaaaaattagccgggcatggtggcacatgcctataatcccagctactcgggaggctgaggcagaggaatcactagaacccaggaggcagaggttgcagtgagctgagatcgtgcactgcactccagcctggtgacagagcaagactccgtctccaaaaaaaaaaaaagagaatttggcccaaagctgctgccatacctgttgaactgcaacctaacttaatatttaagtaaactgcctcccaactgagactatattcttgtaacaaatagttgaatctcagcaagtcacagcagctgtgctttaaccagtcacaggctgccaactgatcagaccaagtccatataaggcaaatgctgagctgtaccccatcagactgtttctctgtgttacttccaaaaaattcggcctgc

SEQ ID NO: 14765 - DNA, 36417 bp, Human
  misc_feature (1)...(36417): n = A,T,C or G
ttaaataaaaagacaaatggaaaatgttttgatcgtgtgtaatatctgaagatgtattggtgcattttcagtatatatgatgttctattgatattttatcattttcttatcaaaggagcacattattggcaatttcaatccctactatgtatattagagattgtttacatgtattgttttatttaattgtcacatcagctatgcaagttagatattatgggaatagaaacttggaaattaaagagtttgcccagacggaaattggtatagccaggattacacccctaaatctggtatgtttgtggaggagggggcatttttatttataccttgttatttggaagcaactcagatattacgtcaataaatctgtaaatatttcagtatgtaatggtaaaagataaggactctaaaaagctggtgtttagttaaggcaaggaggtagtttcattgccttaagaactaagatctcgtggacatgttagggaattcattatgaagagcgtattataagctcattttatgggaaaggcatatttctttcttttgtttttaatatagagacagggtctcactgtgttgcccaggctggtctcaaagtcctcctgcctcacccccaaagtgttgggatttaccggtataagccactctgtccagtgtgaaagacgtatttcttatatgaggtagctaaatgaaatatagcagggtttttagagagggaatcatcaggtttaatatattagcatgtattcggattttgattaaagatagaaggaaactgttaagattggtttgtgagtggattgaaaaaggttcttcaaatattcactaattccttagagattaaaaattagcatagaagtcgccattcaggctagatttctttaatgtgttgtttaaataaaaaataatggcctgcaggctgggcgtggtggctcacacctgtaatcccagcactttgcgaggctgaggcaggaggattgcttgagcccgagagttcaggatcatcctgggcaacatagcagttaagtgtctctaccaaaaaattagcctggcatggttctgagcgcctgtagtctcagctactcaggaggttgaggcaggaggattgcttgagcccaggaggtctaggttgcagtgagctgtgaccacgccactgcactccagcctgggtgagagagcaaaaccctttctcaaaaaaaatttttttaaaaatggcatgtatattgttcgtctaaagactacaaaaaagttacaattattgtaagtaaataagtcagtaataatcaccacatggagaacaactgttagcatttctgtgtatggtgtgcttgagcagatgaggaaacagttttaagtctgccgttaggcacacaaacctgggagactgaaaatatttgttgtccaaaattaccattaattaaatgaaaaatgcatcgtttaacagaaaacttcaaataatactaaattttaggatctgttctaaaagtttcccatttgttaataacataatttttctcaaaacaatgttaatccaagtagcctggctacagaacttgaactcgagtcatctctcaggttgcctgggtttgaaactcggctctgtcacttctgtgacaataactgtgtgacctcaattaagcttcttaacatctctgtgcttgtttcctcatttataaggattgtaataatatctcattttataggattgttgagaagttaagtacttaaagcactgcctggcacaaacttgaagctttgaggttagcctttaaaaaaaaaagtaattttggactcacatcctatacctttgaatttcctttaaaagatagtgacataatctaaagggcattgaaggtctagtagagtttaagataatcatgctataggcaatatttaaagtgattaatagtaaatttgctttactgatttgtatatttaattcataattgtttctttacaggtttctttacctccagaaagaagaatattggccccttgaattctggaagttcattgaagagtctgaaattagggacttatttcaaatttggacatggctagtcgaggcgcaacaagacccaacgggccaaatactggaaataaaatatgccagttcaaactagtacttctgggagagtccgctgttggcaaatcaagcctagtgcttcgttttgtgaaaggccaatttcatgaatttcaagagagtaccattgggggtgagattttcttttttccctgcttcatttaatcgaatcatacattgacagaaaatattttgatgttccaattgtgtgattatgaatagctaaataagtcatagagtgaagaaaagagctgttcagcttaccttagctttaaaacttgcctttatctttgttaaaatgatgtgtttttatatttgattgtttggttaatcccttgtggttatattgtagctaaaatacagataaaaaacatgagtagaatcagtgtctcaagtaataacatttgacctgatacctatttctagctaacaactagaagcttcttcaaattaatacagtacatgtttgtgctcaattatattggtttaaaatgaatagtaaaaaaggtaaccttaaattctgatctatataactgaagtatttgcaaataattatacttacttgtaaaattaaatgtaattaaatactgctagatgtacttttttttggtatttaagagatgggatcttgctgtcgcctaggctggagtgcagtgtccggatcatagctcactgcagactgcagcctgaaactctaggctcaaatgatcttcttgccttagcctcccaccaagtagttggacctaagggtgcatgccaccatgccaggcaagtttttttttttttttttttttttttttttaagagtcagagtctcgctgtgtttccaggttggtcttgaactcctggcctcaagtgagcctccagcctcaacctcccaggtagctgtgattacaggtgctccctgctgagatgcatatgtaagaatgctcctaagctgagggaagagaaaaagtgattaatggaaagggacataacaggaaaatggaacctgaagaaaaagatgaaagaagaagggaaagagtaggcactgacaagggtggttatggtgggacagagatgaggggaaggtaagatgcagggtgaaaaggagacaacaaacagtacagtattgtcaagagaggacgtgaaatgggaaaattgaattttagctggacatggtggtgcattcctgtagtcccaggtatttggaggctgaggcaggattattttagcttgggagttcaagtctagcctgggcaacataatgagaacccatctcttaaaaaaaattgactttaatcaaagaaacctataattatatagcagtgggacaagatagcctcttttgggcctctgtttcatctgtgaaatgatgcttttcaattagatgatgtgtggcaagagccacacggtttgagattcacaatattttgcaagtgatatataattaagcaatgctgttttctaaggtattcatgtatatattttaaccccatcctgtaaaattaaagtcaaactttggaaataagacaggtagataccaactggcatgtggcaacttcttggaatctgtctttcagaagcaaaactttatactgtgcatttagtgaatgctcttctgcaaatatacttgagaatgttattcataatcttagacccattctagtaagataagttacagaagtctactacctcctggcctttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaattcctgttgcgctgtgtgcggtggcttgcatctgtaatcccagcactttgggaagctgaggtgggcagatcgcttgagtccaggagtttgagaccagcctggccaacatagcaaaaccccgtctttacaaaaaatacgaaaattaaccgggcatggtggcacacacctgtagtcccagctactgagaaggctgaaatgggagaattgcttgaactgaagaggcggaggttacagtgagccgagactgcaccaccacactccagcctgggtgacagtgagaaccctgtctcaaaaacaaaacaaaacaaagaatccctgttgcctcaccatacttcatgcatcctacccctatagcacttctgatgaaattgcgtgccgtagatttagcaatttagagaattctagcttgtttgtatgggtttaaagtttgcatgacatttatgtttctattgttggtctaaagttagcccagagattagcagggagcagcaggctcagagagttgtcttccttctttacttggtactgcatctctaggcttggtagctcttcagtaaatactctcaaaaaatacttatttttaagaagacatttatgtgatatttataaacaaattaatcctcagtggttagaatatgcagtgaaatagcaagcagacaatcctttttttctcttctgagaaaagtgcttcataccacagttacaattttgtatgcactaatcaaaaaatgtgttataaactctaaagtttagatgatggaactgtacatgaaaataacattcctcttgctggttctgtgatttttgtacattagcttagaacagtggtcctcaaagagcattcccacttccagaagtagctgcattaactaggaacttgttaaaatgtagaatcccgtgttgaatcaaaacatttgggtgggaccaacaatctaggttttaataagttttccagatgattctaatggcatgttacgtttgagtagttgattttacattggtactaacattgattcacccatacatggaataattggggggtttttttgaggtgtggtgtttgtcagatttttaaaaacattgttgactgggcgcggtagctcacacctgtaatcccaacactttgggaggctgaggcgggcggatcacgaggtcaggagttcgagaccagcttgccaatgtgatgaaaccctgtctctgctaaaaatacaaaaattagccaggcatggtggcgtgcgcctgtagtcccagctacttgggaggctgaggcaggagattcgcttgaacccaggaggcggaggaggttgttgcaatgagccgagatcatgccattgcactccagcctgggtgtctcagcgagactccgtcttaaaaaaaaaattgttcatgcaactaacctagtttgagaattacatgtattatgtactgctcacattacatgttatctgtatctctttataggagaatgccttcctgttagccacctgccagacatctttaggaaagtatgatccctctgtccaatcaagagtattctgctttttctctacttagggagtacccatagttttcagtcatctgtaccactgctgctctcctttcttgtcacaaatgatcaaggcctgataatacacaaaattaattaagaaatttagtgtaggccgggcgcagtggctcatgcctgtaatcccagcactttgggagggtgccagcacactggcagatcacgaggtcaggagttcgagaccagcctggccaacatggtaaaaataccagaattagctaggcgtggtggtgggtgcctataaccccagctactcaggatgctgaggcaggagaaacatttgaacccaggaagcggaggttgcagtgagccgagatcgcgccattgcactccagcctgggcgacagggcgagactccgtctcaaaaaaaaggaaatttagtgcaattattaactcttaagtgaagtgctgtttctacttacatatttaacatccatctaaattggttagcatggccaactagttgtttttagtctaaaacaacctgtaacaggaataaaagttactgttaaaatgaagaaaaacaaggcttatttcaaagttattattaacatactattttacctaacaatttatggccaagtcattctaaagaataaactattgtggttaagagagactgtatccagattgaagtttttaccacaatgcctggcacagtaaaaggtttattaaattatagctattacagttaccatcaccactgttaacttttggctgaatcgttttgtcattgttgatatttttgttgtttggtcatgacatactattatcttgagatggtagctgttacacctagtgcatagcgtttgatttagaaaatttgaagatttgaaaaattttgtgttttttttcctttttttttttttttttaaacagcctgctctgttgcccaggctggtgtacagtggtggcatcaaagctcactgcagccttgacgtggcctcaagtggtcctcccaggtagctgggactgactataggcatgcaccccacacttggctaattttttatttttttgtagggacagatctcactgttggtgcctaagctggtctcaaactcctgggctacagcagtcctcccacctcagcctcccaaggtgctgggatgaaaggtgtaagccactgtgcccagcccaactgtgttatttgtggaagtttctcagagggagaaattacagggctaaagtactacacgtgtgcatatattaaagttttttccagtaactacttaataatgtgtacttgaaaactgctaaattcttaaatgtcctcaccattaaaaaatagtaagtgccgggtgcatggctcatgcctgtaatcccaacactttgggaggccaaagtggtcagatcgcttgagaccagcctggccaacatggccaaaccccatccttactaaaaaaaaaaaaaaagcaaacattagctgggcgtggtcgcgcatgcctgtaattccagctactcgggaggctgaggcatgagtattgcttgaacctgggaggcagaggttgcagtgagcccagatagcgccactgcattccagcctgagcaacagagtgagactctgtcgcggaggttgcagtgagctgagatagcaccactgcactccagcctgagcaacagagtgagactctgtctcaaaaaaaaaaaaaaggtaagtaggcgaggtgatcaatattgaattaccttgatttagtcacctcacaatgtgtacatgtatcaaaacatcatgttaatatacatatgtatatattgtaaatacataacgatttttatttttcaacaataccttaataaagctggggggaataaagttacttcctaaacagaaaagctagccagaaaatttaaatccaaataactcatgtttttccagtagtagaaagctttctacaattgcccttcacttgttagccttcagaatgacttctttgtataattataatctgtgcatttatttaatgtgcttttatctttttgcatgtgcacattgttaaaagtgcttttgagaaaggatagaagacctagagaccaaaccaccagcatgtggtttttgattcgtgagaaaaattgtgtgtttgaagtattcattctactttctgatacattgatagttaaaatttgtggaagttaatcatttggtttcaagcaaaataataatatctttgttaatcatattttctcctaaaaagtacatattcagaatttgagaggttgttacccagagaagttggtagagatttgatatttcaaatttatatcacaacctaaaaaaatctttcggtagtcttaattattccccaatttcttaggttaaaatattatcatatgtggctacttaaacattcccgtgagctgggagtcagtatgcatggttctaatcctcacatgctttcataagcatttatgtgaactctgtttacacatttgtaacacgagagtattgaactctaggtaaggattcttgtaggccaggtgtggtggctcacgcctgtaatcccaacactttggaaggccgaggcaggcatatcacctgaggtcaggagttcgaaaccagcctgaccaacatggcaaaacactgtctctactaaaaatacaaaaactagtggggcgtggtgtcatgtgcctgtaatcccagctattgaggcattagaattgcttcaacctgggaggcagaggttgcagtgagctgagatcacaccactgcacttcaacctgggtgacagggcgctgaggtaggggagactgagacatgagaattgcttcaacctgggaggcggaggttgcagtgagctgagatcgcaccactgcacttcaacctgggtgacagagcgagactctgtctcaaaaaaagaaaaaaggattcttgtagagcagatgttcttataaactgtgtactcttctcattaaacaatacagtcaatacaatttaacttttgttttcttaaaatgtatttcaagatttggaatcattatgagcatcagtttttgccttgccgtgcttaatgtgttgatgtcctctggtgctttggaagtattcaagctgtttggtagaatgattttgccaaatagctcttagtgaactgctactgattcactaatttactgcttttatttgttatatatgggaaatattaggttgtctaaagcaaatcaaaataaaaccagaaatcatctctgatgattctaaaactagaaatcagggacaacttcttggtatagtttgagagacagattgagtgaacattgtaatctggtgctatatattaaaggtttttaaaagtgatattatatgccactttttaaaaattaagcctaaatctccaactgatcttcttgttatgtactaatttatatatatatatatgtatgtatatataaatcaatctccaaaagaagatatacatagaaagtggtctcagttacattccgaggaaatctgtaaatttgcataacctttagtgcatggactttgtgagatttattctggctgcatttactcttcttttgctagctttctggttgtgttctgattttttttttttttttttgaggcagggtcttgctctgttgcccagggtgaagtgcaatgatgtgatcatggctcactgcagcctcagcctcttgggtcaagcagtcgtctcacctcagcctcccaagtagctgggactacaggtgtgcaccaccatgcctggctaattttgaaatttttgtagaggcgaggtcttgctatgttgcccaagcaggtcttaaaactcctgacctcaagtgatctcctggcttggcctcccaaagtgctgagatatagccatgagccaccgcgctaggctgtgttctgaatatataaggtttccagataattgatctttttggagacacactcagaggcacatgaaagacacttggttttgaataataattggtggaggctgtgggatgggaagtgttttaaaattttgcttttagaatagaataagaattcttacttgatagaaacatgggaaattttggcaaactgtttctcccttttttaggtcatataccataataacctgacattgcatatacataatcttgtttatgaagtatgctgagtaaatttatgataggatagtatcatttggagttacatcaaaagccttttcagcaaacctctttgtgaaggagaataaagatgtgtgagagtaagaaaagcaataagagtacttctaaaggtttttgtttttgagatggggtctcgctctgtgctagactggagtgcagtggcatgatcatggctcactgcagcctcaacttctgggctccagccatcttcccacctcagcctcctgagtagctgagaccacaggcatgtgtgcccctgcccccggctaattttgtatttttggtagagatggctattctccatgtttcccaggctggtcgcgaactcctgagctcaagcaatcaacctgccttagcctcccaaagtgctgggaatacaggcgtaagccactttttcaggcatcattttttgtcttttaattcattggctaccttgatgtatatgtaaactttagttacctagttgctaaattcctcaagatgaaagttaagtgttactgaagtcatatgttggactttgaaaataagaatgctctacaaatcagaatatctgaagtaagtgttgctaaacagcattcatcctccgtttgaggaaaggtagaagcaggatgaagaaccggttagttattcatggttttttaagccttaagtgttcgcagtagtagttgttggatattctttgggccccaaagaagaagtgggtaatcttgatacatgactagtcactgcataattatcagacaccttcagcttttctcagtcaaaaaactgttctttatctttgcataaaactagagccagaatatattccacctagttactatcgtttttatttgaggtataacatgaatagaattttctcctctattgcattcataagtaatttgtaaattttagaaaaatgtgacttctaggaaataaaggataatttaaagataggacacttacaataattacttgttatgtgatacattcctagaacttaaacaggattttcagaagtttcatctgtaccttaccatggctatatgggaaggtactaattttatagacaaggaaactgaagcaataaaggttaagtatatgcttgaagttttgcaactaggtgacagctgggattaaagacatctttctgaaatgccattcatgttctggaatgtactgtgtatgtgtgtatttctccttgcaagaacctatcagactagaaaatttggctcatagttagagtacacatgacaagtgttctgttaaataatatgtagtatttgacaggtaggggccttcttgctatgtatcacttaaggaaaataatgtgaaagtattttgagaacaaaagaatataagacgattatttaaattgtccatattcctaaattatcaccaccattttcatttttatgccatcatcatgtgtcacacgctatattttaactgcctttaatcaaatgcattaatttgttcatgtgagtcaaaattcaagaggtttataaggtttaccatgaaaaatctccccctcatcttctatctagcccactcaattctttttcccaaagatgatgttactttgttatatatccttgcaaagttactactatactcaaatctatatattcttgtctccctttttacaaaatttgaaatatgtcagatgtactgtaatacactttttatttttcactttaatgctgttctagttatctattgctgagacacaaatgactcctccaaaatgtagagacttaaaattattttgtcatctccatggttctggtgagtgggcttagtaggtggttctcactctgatcttttccttgctcttgcagttcattacggggcaagaatcatctcaacacatccggcagttggtgctggctattggttgggacctcagatggggctgttagctagaacacacctacatgtagtagccttttatgactttgctccagaagtcacatagatagatagcatctgttctattctagtcacaggcctgtacagattcaagggaagagtgtcaacatcacactgtaagaagaatgtggtgtagaatgtcttgttgcagctgccttagaaaatacaatctacaggctgggcgtggtggctcacacctgtaatcccagcactttgggagactgaggtgggcagatcacgaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttctcatgttgcccagggtagtctcaaactcctggcctcaagccatcctcctaccttgacctcccaaagtgttggaattaaaggcatgagccaccatgcccagcctgtgtttagtttttctgtgaactattcataacctcatgttatttctatgtagatttctttataatagtcacactactgtgttccatttgatttattaatggtaatatttctcagtacatctatattgtcatattttagtatctggcaatcttctctttttattattttttaactgttccattgttgggcatttaatgtttgcttttttgtttgctgttttaggtaatcacctaataggggatatcttagaatttcacccccccccccgacttattttcgtaagatcaatttctagaggtgattactgaacccaaaggaattttatcctaataaaattgttttgtaggatcaaaagaattctaatcttcatcctttttcatcccttagagatacatccagtttctttgggggttggcatagataattatatcctaggattacaggtttcctctaactgttaataggagtttaaagttttccctctctgtttagtcttcttttctattatgttgtaaaattctcagatatcagaacttttgtttttgttttgagagacaaggtcttcctctgtcacccaggctgaagagcagtggcatgattatggctcactgcagcctccaccccctgggctcaaatgatcctcccacctcaccctcccaagtagatggtactacgtgtgcatgtgccaccatgcctggctaatttatttttaagatggagtcttgctatgttgcccaggctggttttgagctcctggcctcaagcaatcttcctgagacaggaatcccaaagtgctgggattacaggtgtgagccactgtgcccagccaaatattagaacttttaaattcatttagtatgtaagcttactgccaagcatgaaagaatcactttgaaggccagtaatgttttaaaggtctggaagattctcttgagggctaggaagcattatgtgctaggttcttgaaccaggagaaaaggggtatcactaagaagaagggaaggaatcctggtatgcaaaatagcttgggcgctatccttgcacatttgacaagtttagtgaagtactattgaactgttcagtaaagtatctgttgcctatagataaaatgtcttttgtagatacttatatatctacctacctatagatatctatatatctgtatctatatatcccttaaagctaagctaatttccttaaccttttctctgttgatatttgtttggtagcctttatctgattctagttaataactcgtaccctgtcatttttttaaaaataccctttgtttttgtaatgtgttctttcattcttcttcccaattcagttttggtacgttcctgttacgtaaatctaatctggtgagcagagactttcttaggattatgccacttggtgaggcaatcacagggtcttagccctgaaggcgcccatactgactttatcagtttattctagggagatcaggtttggggcactaacttaatactaacaaactcctaagattaatttaattttatttatttgtttgagacggagtcacccagggtggagtgcagtggcgtgatcttggctcactgcaacctctgcctccctggttcaaacgattcttgtgcctcagcctcctgaggctgggactacaggcgcatgtcaccacgtctggcttatttttgtagttttagtagagacaaggtttcaccatgttggccgggctggtcttgaactacctcaggtcccaccttggcctcctaaaatgctagaattacacagacgggagctaccatgcctagccaaaactcctaagatttacttacttacttactttatttatttatttgagacggagtctcgctctgtcccctaggctggaatgcagtggtgtaatctcagctcactgcaacatctgcctcctgggttcacctgtctctgcctctcagatagctgggattgcaggtgcatgccaccatgcccgactaatttttgtatttttagtagagatggggtttcaccatgttggccaggctggtctcgcactcctgacctcaagtgatccacccgcctcggccccccagaatgctgggattacaggtgtgagccactgtgcccggccctaagattaattttcaaacaatgtgcatcagtatgttagaaatacctagtgttagccgggtgtggttgtgtgtgcctatagtcccaactactctggaggctgacttgggaggattgcttgaggccaggagttcaagggcgcagtgaactatgattacaccactgccccaacctgggtgacagtgggagaccctgtcttaaaaaaaaaaaaaaaaacttagggcgacgatgttcagctggtgacatgtggctgactgtcttatgtactggttagtgaattcccttagagttgggtgtcccgtaagggttgctgtcaagctgtgatagtaaaaagcattgacttctcaatatcctttatcctagacagtgttggagaaatgctaatttttattctttacctcactcttgacttcatgcaggatcttccctgtgtatcattaatattcttcaggattttaaattgtttcacaactattacctttagatgttgctcatagatttttatatttgtttccttccttcctttattttttggggcaggggttgggatggggacgggatgacagggtctcactgccacccaggctcaggtgatcctcctgcctgagccacaaacctctcccaccaaccccccgcccagtagctgggactacaggtgcacgccaccacacctgttttgtatttttgttagtagaaacgatttctccatgttgcccgggctggtctcgaactcccgggctcaagcagcatacccgcctgggcctcccaaagtgctgggactgcaggtgtgaaccactgcgccttacccagatttctttttaaaattgcggtaaaatatccgtaacacaaaatttaccattttaaccatttttgaatatacagttgagtggtattaggtacttttaacattgttgtgtaactatccaaaactttatcttccctagctgaaactctgcacccactaaacaataactaccccttcttcccgtgtctggcaactaccattcacctttttctctctgactctgactactctagctacctcacataaatagaattgtacagtatttgtacttttgtggtttccttatttcatttagcataatgtcctcaacgttccatccatgttgtaaagcaagtgccagaattttccttcctaaaactttttaggctggataatattccattgtatgtatatacttcatcttgcttgtccatcattggacacttaggttgctttcatctttagctgttatgaataatgttgctgtgaacattggtgtacaaagagtgttttaagttcctgctttcactacttttggatgtatgcccgtaagaggaattgctggatcatatggtgattctatctttaatatatttgagaaatctctatacagttttccataccagctgcaaagcagttccagtttctccacatgatcacccacactttacctttttctcttggtttgatcatagccattctagtggcagtgaagtggtaatttgtggttttgatttgcatatccctaatgattggtgatattgaacatctttccatgtgcttattggatttatttatttatttgtttcggtttttttgaaatagggtctcactctgtcacccagactggagtgcagtagcatgatcacagcacactgcagcctgacctcctgagctcaagtgattcttctgcctgtacctcccaagtagtccagcgcatacccccatgcctggctatgtaaattttttatagagacagagtctcactatattgctcatgcagatcttgaacgcctgcttaagcagttctattgccttggccttccaaagtcctgggattacagttgtgaaccactgtgcccagctcttattggtcatttgtgtatatccgttggatcaatgtttattcaagtcctttgtccatttttttttttttttgagatggagtttcagtctgccgcccaggctggagtgccatggcaccatcttggcttgctgcaacctccatctcctgggtacaagcaattcttctgcctcagcctccagagtagctgggattacaggcaaccgccaccacgtccagctgatttttgtgtttttaatagagacagggtttcgtcattttggccaggctgatcttgaactcctgacctcgggtgatccacccacttcagtctcccaaagtgctgggattataggcatgagccattgcgctcggccctttgtccattttctaatcaggttttttgttgttgctgagttgtaggagttccttacattaatatgttctagctttcagtcccttatcagatgctcattgatttttaagagtgaattgtagataaactagtatagatcacctcttaagatggattaatttggggaagattgctgtctttctgtatgctatctacataataattttttattttcttgttaggcttttggaatattctctttttgggtttactcacagtgtgtatgctttactgtgccttattttttcttttttccctcctgggtgctgagtaatacttagccctattctacttttatttcttactcttcctcacattaattgaaatgtaactcttccctaactacactcacgactgtcgcttctgcagtccattcactgggtgcttcctgtatacacacactttcataggaaataaaaatggcctcagtttttatttttcctgttttcggctatgtatgattcttctctgtgtgtaattttatcatctgaagttagtgcttatctgtctgagaaaatctgttatgtcggattactgctgttagtactcattttcccagtgaaccaatttctgtcttcactgataactttagtacctgattctaacaatctctaacttgaatttttttttatcacaaagcctcattctatttctgaaattttgaacaagaccctttctcccctctctagtcactgcatgcatcctttccttttagttttaatttaattgctacttaatacttagttactagtattttttttcacttacacattgggattgtttttttaaaggtactcaaatatgacagtctatattattgtttctctatacacatttatttactaccgaaaattgaaaaaaatagcacatcgaaatttccttttactgcaattcaaatttttgaaaaccagaaaatctgatttattatactctagccaaactacccagtgttttctttacattctttccccacaagttactttacttctgattctttcttttgagacagtctgtcacccagactggaatgcagtggcataatctcagctcactgcaacctccgcctccaggatttaaggtattcttatgcctcagcctcctgagtaggtggtactacaggcacgtgccaccatgcccagctaatttttgtatttttaatagagagccagggtttcaccattttggccaggctggtctcaaactctgggcctcaagtgatcctcctgcctcagcctcccacagtgtgctgggattacaggcatgagccactgtgcccggccttacttccaattcttgatgatggatttcatttcactaacaaggttgtttttaattattaaatagttttaaattctttgagcataaaagtttgttctacctactctcctgccctcacactatcttttggaattttagtgagattattaggttaaaaagtattagcattttcttgcctttgctacatgttgccaaaatcctttccaacggagttgtacgaaatcaccagctgtgcttgggttttttgcaaattggtgttttttggttttggttttttttttttgtttttttttttttttttgagatggagtctcactcttgttgcccagactggggtgcaaaggcacgatcttggctcactgcaacctccgcctcctgggttcaagcggttttcctgcctcagcctcccaagtagctgggattacaggcgcccacatccacgtccggctaatttttgtattttttaatagagacagggtttcaccatgttcctggctggtcttgaactcctgaactcaagtgatccacctgcctcggcctcctaaagtgctgggattacaggcgtgagccaccaatgcctgctgtatttttattttttcattatgctaatttaggagataaaaattgttttgactatgtggatgatttcattgactactggtcctccttttctgttcttttgtgaattgtctttacacatttatccctgaggttctaaagtttttctaaacatttataatagctttctacacattgaaaatactaatcacttagcatccattgtagaaatttttctcattaggtttgcccctttgttatggatgttatgacacaagttttgcaaacctgaagtttcatatttttgtgtaatcaaatctgtagtcttatatagaattttggtcaattttaataaagcaattctttcctgtcaattttgataaataataagtttgggcttgaagttgtatggtttctcagtttttgtatttttcccctttctgtttaattcatgtagaatcattttagttatggggtggcggttactttgtttttcttttttttcttgagacggagtctcactctgtcacccaggctggagtgcagtggcacaatctcggctctgcaacctctgcctcccgggttcaagtgattcttctgcctcagtctcctgagtagctgggattacaggctcatgccaccatgcccggctaatttgtatttttagtagagacgggttttcaccatgttggtcaggctggccttgaattccagaccttgtgatccacccacctcggccaccatgcccggctaatttgtatttttagtagagacgggttttcaccatgttggtcaggctggccttgaattccagaccttgtgatccacccacctcggcctcccaaagtgctgggattacaggcgtgagccactatgcccagccactttgttttttaattattaatctttggtttaatgccatcaatttgaatatcctttcccttgcccagtgtgttacagtgtcttcccctggcttactgtttaagtcttgcatattataataggcctttggtatttgcagatttgacatttaaagcttcagctattctcacctgattccagggtctgtggtaaagtaatttgtagttttgctgaggctgaaatgttacttgcttgctgccaggcttgcaaataggagctgatcacgtagctcagagggagcctatcagacaggccagcacccacatctcaacgcagctttgtttttctctacttgtcatcgcgtacacagtaactctcgaagtgataaaagctgtttctttgtgaaatatgggcccgaaaagaaaaccaactgctagtgctggtgatggaagtgaagagaaaatgaagcggtctaagagtgatggttcttagccagaaaatagacgttttggataaattaaagtggttttacagattcaggtaagtttgtggttggttaatgttgctacagtattgatgtagtagttttatcttttcagtggcagaatttgtttacgtaactttataaattactagtaatgtatttttaggagcactgaggatttgaagatgtcacctaaatgtcagttacacttcaccgagttttataggggaaattaaacactgtagtggaatttggccaggtgtggtggctcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattttttaagtactatcagtgcatttctttaattgtagagcaattttgaaatgcagtcttcgctgggcttggtggcttacgcctgtcatcccagcactttgggaggccaaggtgggcggatcacctgagatcaggagttcgagaccagcctggccaacatggtgaaaccccatctctactaaaactacaaaaattagccacgtgtggtggtgcatgcctgtagtcccagctactcaggaggctgaggcaggagaattgcttgaacccgggaggcggaggttgcagtgagctgagatcacgcccctgcactctagtctgagactcttgtatcaaaaaaaaaaaaaaaaagaagaaggaaaagaaatgtagtcttaagtttatttagtattataacaagcttttttaagatgcagaagtttttcaatctgtgatttcactacaaaggccctatatgtaagcatatatgtaaatagcttagaagcacaggtttgccagtatttaaagctattatcagctgtgggtatgcaatctgtcaagtttctaggtgttttctttttttttcccccctcatttattacttttaactgacacataatagttgtacatacttacggggtacagtgtgacattttgatagatgtatacaagcaggtgttttctatattatgaaaacatttggagaaaaatgattgacttattgtagtccttttctttcagctgcttttctaacccaaactgtatgtcttgatgacactacagtaaagtttgaaatatgggatacagctggtcaagaacgataccatagcctagcaccaatgtactacagaggagcacaagcagccatagttgtatatgatatcacaaatgaggtaagtatggatgcattccacagtaaaactaatttgagtacccacttttggtgttcagaattttgattaaatgttttggaaaatctttttctgatagtcatgacctttctgctgaagcttttgtgaattagaaaatctggttttaaaaaaaaacgaaaatgtctcataatacaatagtcctaataatttctttcccacagtcacttgggacagtcttttaaagccttgtatcacaaagatgcttcctaaccattttttgagcctgtgctcaatggctgtttctttgtttaacaggagtcctttgcaagagcaaaaaattgggttaaagaacttcagaggcaagcaagtcctaacattgtaatagctttatcgggaaacaaggccgacctagcaaataaaagagcagtagatttccaggtatgttaaatttaactctcatttgaaaggcacttttttcctgtatgtttttctttcatgtcaacacttgaattagttataatgtcaaaaccatgcaagtaatagaaaatactgatttttaaaacaaatataaagtactacatataataaaatgtttctgataaacctaaatttttaaatagattattgtaatatataaactgacccaaagattttgtagacttaaacaataaaggccgggttcagtggctcacgcctgtaatcccagcactttgggaggccgaggtgggtggatcacctgaggttgggagttcaagaccaacctaaccaacttggagaaaccctgtctctactaaaaatacaaaattagctggagatggtagtgcatgcctgtaatcccagctacttgggaggctgaggcaggagaatctcttgaacccaggaggcggaggttgtggtgagccaagatcacaatattgcactccagcctgggcaacaagagcaaaactccgtctcaaaataaaaaagaaaaacagtaaaagtagtcattgttcacagtgcagaaagtgattgtatcctgccctaattcctccatcccacacatactttatgtcctaaccctcttctactcatgtgcaaatatgtatcagcacatgtgtgtaccccacatatgtacatacgcaaacacttatgtggttgttcttaaaggggcattcaaacataaaggttctgccaatctgtatccagagttggaaaataataagctaaaaactaataattaaaaaaaatttttttaaggctgagaaaatccagttttgtattacgattgctaattcagaatgtttgctgctgcaaaataggcaagtgcaatcacttaaaaacaaagcaagtcctctatttagacttttttttttttttttaagatggagtcttgctcagttgcccaggctggagtgcagtggcgcaatctcaagctcactgcaagctccacctcctgggcttacgccattctgctgcctcagcctcccaagtagctgggactacaggcgcccaccaccactcctggctaattttttgtgtgttttcagtagagacagggtttcactgtgttagccagggtggtctcgatctcctgaccttgtgatccacccgcctccgcctccaaaagtgctgggattacaggcgtgagccaccacgcccggcatacttagaccttttaaaactgtgcctgttctcttgctctttggcttctctactagaagggcggttgtggctgttctgtatatatcagtgatgaaatagttttcttttttgatgacgtagatggaatccatgtattcttgcatcattaggtattaagttgggcatgttacatttgtaattttatttaattcttaggacaacgatgtgagatgtagtatccattactctttccaaaattgttgccttcccagcacaagagtggcagagaaaacacttaaattacagtcagaagtggccctgtcacataacagttcagaggaacctcagttgtttctttgtccaatgggaaagatcattggttacccctcacaacagctatgaggatcaaaagtaataatatatgtaaactgtaaaagcatgacaaaaatgtagggcagtgatgtaattttcaaaggaatgatttatgatatattcaagattataatattgctgtagaagtcattgaaaattaaatatgaggttgtcatttagtgtttgaagccagtgttagatatttggtttccctttgtcttcattgcagacagtaagtgcaaataaaaattgccgttgagatcaaagagagttttatttagaataagataattctcccccatctctggaactcagtatttgaaagcagatttaatgtaagaaaagattaatcaaggtgggataatgcaagaatttcagacaaaaaaggaaatagtccattataaaattatcttgcacagtgctcttacctctgttgtagcttattatatagttgttgattatagatgattataggaatcaggttgtagtaataagaaagtctccttttctataacaagtttaaagcaggtgtagtgtatttccaagagatatatctcatatatctcattttttgttctgtaaacaggaagcacagtcctatgcagatgacaatagtttattattcatggagacatccgctaaaacatcaatgaatgtaaatgaaatattcatggcaataggtaagattaatatctctttttaaatgatcaatataagcaaaacaagtgtgaagcatatttggtttgactgtctcttttttaaaaaatttttgggggtgggtttgtgtgtatgtttatgtgtgtgtgtgagagagagagagagattataccacttttctaagtcccttccacaaaacaatattttgttggtaatattgttaaatttgaaagatgattacctattaggttgtaatactgtcagtttaggcagcttcttccaggtgagttaagccttaacctcttaacctgatagttcagacagacagattttgcaaaggtttcgctgggaaatttggataaatattttttttattagattatactttttaaaaatcaaattattggtaaatataactcagaagaacatgacacataagtatacagattgacaaattattttaatgtaaacattataaggaagatgatttcaaagcatagaggcgtaaggagaaaaaaggaaaacaaaacaacatccatactttatattacctcagatggtcatttgatcttacacaatgttcttgctgttgctttaaggtacttttttttttttgagacagtctcgctctgtcgcccaggctggagtgcaatggtacgatctcagctcactgcaacctccacttcccggattcaagcggttctcctgcttctgcctcctgaattgctgggattacaggtgcacaccaccacgcccagctaatttttgtatttatagtagagacagggtttcaccatgttggtcaggctggtctcgaactcctgatctcgtgatctgcccacctcggcctcccaaagtgctgggattacaggcgtgagccactacacccagcctaaggtactttctttttttttttttttgaaatggagtcctgctctgtcacccaggttggagtgcagtgggacgatctcggctcactgcaagctccgcctcctggattcacgccattctcctgcctcagcctctcctgtagctgggactacaggcacccaccaccatgcccgactaattttttttgtatttttagtagagacggggtttcaccatgttagccaggatggtctcaatctcctgaccttgtgatccgcccacgtcagcctcccaaagtgctgggattacaggcgcgagccactgcccctggccctaaggtacttttaactgatggtaattgctgtttcagttataagtaatgaagttggagtagtaataagcctccttttttctataacaaaaataaaggttggttttgttttttggttttggattttttttttaaccctttcctctttccagtggttttaatgtatagattctacctgaagggtctgttttggtggttctcaaagtttgccgtctgtggtttttcatgtgcccagcactcttctcatcccataacaccttttattttacagcactgattcttaactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaatgagttaataggcctctcaaatcagcctgcactgtaaacctttctcacaatatttaaactctaccagatgggctttagtttgtacctttttattcaaacatgctaataaagtcatttttcgagttagaaagcagcctacatattttagttttttgtttttttctgaaattagaatgttgcacttcttaaaagaaaatctatgttgtaaatggaattgtggcctttccatttccttcactaggttagtaaattttttttttctttttttttttgttatgaaggaacactttgatagattagtaacttaaatcacacagtgcactcataacaactctaatcaatgcaaggactaaaaagttactcgttctagtttacctccttcatcctcttaatctcactcacctctgatttaaacacttagggaacatgctaaagggatacatgattgattactcaatctggaacctaagttgttattatatacaatatatagtgctattttgtgtcccaggtaccagtgttcaacatttctggggctttgcttgtaaatacatttgactggagatttaccattataatgctatttatgctaccagcccagagccagtcccagagaagtggcccaattgaaggctttctttccaaacttcagtgctcctggctcccaaatccattgcccaacccagcatctaggattctaaaaatgattgatgctgatgtagaatggaatgtgtagaacaaataaaggataaaaggttcacaatgcaactaggcaatccgatctcaaagcagagtgtattcaatttctgagtaacctgagtcaaagctatggtaaagttagagtcttaccatagtggtctgtccccaagattgatagagatcagtgtgtgcagccactcttaaaatcagtactcttagtcatctttaatattctgcctcccctcaaaaaatgaatttagcacatcaaggatcttatgtattaaaacaaactacagcaatctccaactttacagtggtttgacttacgattttataactcgatggggtgaaagtgatatgcatttagtacattcttaacttactacgggattacatacagaaacccatcataaattaaaaatatcataaatcaggctgggcgcagtggctcactacctgtaatcccagcactttgggaggccaaggcgggctatcacctgaggtcaggagttggtcaggaaacaagccgggccaacatgtcgaaaccccgtctctactaaaaatagaaaaattagctgggtgtggtggtatgtgcctgtagtcccagctacttgggaggctgaggcaggggaattgcttgaacccaggaggcagaggttgtagcgagctgagatcgtgccactgcactccagcctgggtgacagagcgagactccgcctcaaaaaaaaaaaatcataaatcaaaaacatacaacttaggatggatatatcaggatgtagccccattgtaagtcaaggagcatctgtatatccagcaggtaagtttttttaatcagtgggaagcacactccagagaacagccactagctgtatagagcttggcagaggtaaagccgtaactgctggttgagagtgttgtctgaatttgacaagccacactcatcggactcaaataaaattaagaaatagtttttggagatgaggtcttcaggataattctatctggattaggtacagctactggtcagtcagattaggattcatcagcccataaaaggagaaaatgaggttggttgaggtggctcactcctataatcccaatactttgagaggccacggtgggatgatcttcaaggccaggagttctagaccagcctgggcaacagagcaagaccctatctctaccaaaaaaaaaaagccaggcatggtggtgcacaccctgtagtctcagctacttggaaagctgaggtgggaggatcttttgagcccaggagttcaaggctgcagtgagctatgattgatgcaccacactctaacttgggctacagagggagaccttgtctccaaaatgaaaagaagtatggctgcaggctacattcaaactaagatcacaacgaagtgttgagtatgtctaaatgtatgtggatatgtttgtgtctaagtgtatttccactagcatgctaaggtatgtttgtgtgtgagtatgtttcctccagtatgctaagttttgacacatgcaggcatctaacttgggtgttatctgtccttcctttgcccaaagcatagattataattgttcattctcaaaaatgcaactcttatctgtttcccctttatttgaaggcagctgatggttactctgcaaggtgtaagtttctcttttaaaaactaagcggtcgagcatggtggctcatgcttgcagtcccagcacgtgggagtctgaggcggaagagttgcttgagcccaagagttcaagaccagcctaggcaacaaagtgagaccccatctcactttggaactcaggactgcagtaagccatgatcataccactgcacttaatcctgggtgacagagtgagaccttgtctcttaaaaaaaaaaaaaagagagcatgtatatagatgttttaaggccaaaggctgtggaagccaggaaggaaatagtagatatgatctatcacaattcggggtgataattagttgcacagtagaggacaagttttgttggggtgatgattgcaaaggtatttgtatcctgacttgttctaaaaaatgtttgtggcagtctagagaacgctgatatgagctgagcttctttataaacttactggctggccatcatctttattgacttagattttatttaatagaagtaataatgaggccaggtgccatggctcacgcctataatcccaacactttgggaggctgaagcaggtggatcacctgaggtcaggagttcaagatcagcctgggcaacatggtgaaaccccgtctctactaaaaaacaaaaattagctgggtgtggtggggcatgcctgtaattccagctactcgagaggccaaggcacgagaatcacttgaacccaggaggtggaggttgcagtgaactgagatcacgccattgcactccagcctaggtgagcctgggtgacagagtgagactacatctcaaaaaaaaaaaaaaaaaaaagaagtaataatgagtataaaataaaatagaacttttctggtattattgagtgaatcggtatagagaattacataaagcactagttaggcttaagttttaattgtatctacaaccagtccccatctaccgttcccccaacacaattaccccagaaatcaaactccctaagacagcaaccaatattttggcattcaatactcagtaaacatttgaaaagaatgaacatatggttatatgatactttgggggtaacctaactggaaagaaaaattatagataagcaggtgaaactgatattaatatgagtattcaaatattctatttatttgatcattttctttcagctaaaaaattgccaaagaatgaaccacaaaatccaggagcaaattctgccagaggaagaggagtagaccttaccgaacccacacaaccaaccaggaatcagtgttgtagtaactaaacctctagtttgaactagctggaatagtcttctgcttcctaaatgttaataacaatggaattggagcatttaaccagcccagtatgacttccaaaagaagagacttatgatagagtcaagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccacacagttaaccagcccatttctccacactggtacagtagtcacctgtgaaaaaaaaaattggaacttactaatttgggcttttcaaaaacattctttgtttagaaggagattctaaagttatttatgatgcttagccatagtattcaggcaaatgttcatttctcctggtacctgtatttaaaatgtacattccacattttaataaattaaccacaagaaaataatcccacatatacaaggtcaggggtggggaagagtattaatggtatcttaattatacccagtctggttttttttttttaaatggggtaaaaatcaaatgcaaccccatcttgttttaggaattttgagaactaataaatgcaccttaatggtcagtgttcctttcaaacatgtgagttctttaacaaaaatgaaataaaccaggtgtctgtgatttctaattaatcaccgctggccattacacaggttttgttgtttggggtggggagggggcttttgttcccttttgacataatatagtcaatgcactaacaattatgtatattcaaacttgattattttaaattcgatcttcagctgtactgtaaatagggtactgcattgtagtctccatatctgtattacttttctgtaatatttaagagttgcttaaaagcatacaaaatgtactgttactaaaacagctaattatttctctctccccctttgacaggaaggggcttcagttgttcctccatggctagaaccataataaacaatgtacccgtaatttgtaacataaagtattggaatatgttagtaacaatcttgcagccttcctttccaaagttcattttattttgatcagttcagtatattgcactaattattttaggtattttcattatatgaaagctaccatgtgtcagagatgatttaatctatttaagtgttggactgctaggagaacttgtacatttatgataatgcagaattaggaaaacggttcaccagtgtttagttttatattgaggtgctcaggttggaataaagtggtataaaaagcaagtatcggcttttctcttttccttttttttggcataaaacagtgaatatatataaatgatactatatgacctagtatccgcttttatattttctttactatgttcataaaattatttgcatggtattgatgaatcatcctaatagctggatcattgaagaatcactttatattttggtgctctggataattggaactttatttttttatgtcagaagctgatattcacttccattgagaaatattaccataactgtaatgttgtctctggagccagccagtaaagcagcatttacaagttcatggctaacatactcagctgcgccttcatagaaactcttagtgtctgattctttttcatttgttgccacatcatttacactagttggtctgtcagttactttttcactgcaaggtttacgatgagtcgtttctgctggaaatgtttctacattctcagggttataaatacagtatttagaatagtttgaatcggataaattttctttggaatttgtagttgacacacgtacttcagatacagatttatactgaaacaatacgtgtatattactctgtgatttagtaaggtttggttcactggttgaaaaaagcagaggccctttggatggtgatttgttaggtatgataggacagtatgttt

SEQ ID NO: 14766 - DNA, 86116 bp, Human
  misc_feature (1)...(86116): n = A,T,C or G
gtctcgctctgtacccaggctggagtgcagttgtgcaatctcggctcactgcaagcttcgcctcccaggttcacgccattctcctgcctcagcctcctgagtagctgggactacaggcgcctgccaccacgcccggctaattttttgtatttttagtagagatggggtttcaccatgttagccagggtaatctcgatctcctgacctcgtgatccgcccacctcggcctcccaaagtgctgggattacaggcgtgacccaccgtgcccggcctctcttttcttatactgttacacatatatacacacttcagaaatgatctctgtcctggagaattttatgtatgaggtcaaagcagcagccactctgacaattttcttcaaattagacttatgctgctggtcacggtggtgcacgcctgtaatacctgcactttgggaggccaaggtgggcggatcacctgaggtcaggaggtcgagaccagccttggaacatggtgaaaccctgcctccactaaaaatacaaaaattagctgggtgtggtggcgcatgccagtaaccccagctactcaggaggctgaggcacaagaatcgcttgaacctgagaggtggaggatgcagtgagacaagatcttgccactgcactccagcctgggcaacacagagagactctgtataaaaaaaaaaaaaaaccaaaaagtttggataactgtattacaaaagtaaaaataagtcaatattaataatatcttttctttaacccatatatccaaaataatacatttaaacatataatttcaatatgtaatataaacattgttaatgatgtattttatattttgcgctagtcttctaaatctgtatattttgcaactacagtgcactttgatttgaactagctggatttctagtgctcaatagccacatgtggccagaggctaccgtactggatagtatatgtagatggctctaccctagagtgacttcatctgtgttacatgttattctaacaatgtatcttctggtttcccagccacagctgacttgaagcagtaaataaatggtgagagtgacagagtgctaagaatagtagagaaggggcagaagaattatttttataagtggctgaggtcattcattgcaagcacaaatgaaaggtatgaacctttcatacgttgagacctgctgaagcatacagtgtggtacctggtagaataattgataatttttcatgcttgccttccatttcataggtcagatcacttaaagaaggctacatcatattcactcttggctacaaacatagggaagtgtgaagagtatgtggacaaagttaaggaagctttctatcaagtgttgctaaaataatggtgttctagtacaggaaacctgggaaatgtacgtgtaagtagaaacccaggactacatgatgaagccctcttcatttctaaagctgggagctcacagaagtcttggaggcgcctgcaagtgtgccttcagctgggtgtgccccgtctcatcttcctaagattgctaacttcttcggttctgtgggtttcccttctggtccatggggcagagatgcagctggtgccttggaacctgcaaggctcaaccttagcctagaccttagctgtgtttgtgggacatcaggagtctggcttgtggatttggaatgtccatcttttgagatggactttcttggaactcaccacttcatggacacccactgggggcaatggtagcaaagtgtgtgggtcagctgcgtgagctgtagcatgcagattccagccagcagacaacaaaagaaaacaaaaagcaaagcactcaaatcaaataccacctttgggttttctgtttttctcttgtgtatatggcagacgacaaagtcaggggtgaggggatagctgtcatataattagtgtacattgttctcatgtaaaaccatcagtccacggctgcctgttaaataattttgtctctttctttattccatttttaggccgaggagtcttgtaaatgtaatggctggaaaaaccctaacccctcacccactccccccagagccgacctgcagcaaataattgtcagtctaacagaatcctgtcggagttgtagccatgccctaggtgagttcctaaatcttcaaggaaagtataacgagttcattgtagcgtgagactcttaacttactgaattctgtgggttcaccaaatttgaacgctatgtacctctgtatgagagcaacaacaagagcctctctagtctcacgagtttgctgggaagggcttctcgtgagagacaaatgctgcactgtgtgcagtgactttgtcccttcttcctttcaagagctgagttggactgggggattgccaaataagatgaaacatgacaatcgagctagttagcatgaataatgtgtaacatgtcctgattcattttgggggttggggcctgagggtctttgacctcagggttgaaacctcaaccaactggtttaatgataataatgatcatttttattatttctgttgccctgaactttctggggtgcttcattttatcttcatattccttagttttgtgtatctgatagctctttcttcactgggctgctctttattgtgtttattgaatgtttactggtggtttccctttcaactttcttatctgaccctgcaaaataatcattgtcagtgatggctcagtaggccctgctgcagtcactcaaaaggcctgtgctagtatgttgttctttgtcctaatactagttttatgattaaaatatttaaaaaaatcatatgttgtttgagtagataaaagttgaggaattagtttttcctagatactaaaatttcagtccacgaagaatcttagactattcttactttcctgccttcagttatacagtctcccccaaaatgtcaacaaggccagtttgctgtccgtgactgcaaggacatagcactcactgggcagaacgttcttgctaaggtacttgctctttccacctgaccattataagtgggtgacttcttatgccatcatttctctagagcttcctgcttacaagaaatggtgtcgcctccaaggttagcatggtgttaggtcgtctgaaattttattttgtactcagagagtatttcaatatttacagagcatacaagtagataatgtgatcttcccaagaagtcatcacattggaataaccttctgaaaatagaaatagtcctgatctcacaaaagcaacacactaataatttcatcattttgttgacttaattggtatctcaaacaatgtgagctctgagttttgaagcactcaatacagagcaaaaatttcaaaagttagagaactgtccttgattataatttaccttttttaaaaaacaaaaaataaaataaaacagaacgaaacaaaacaaccactaactctgaatggagtgaatggagtttaggattgcctcaggaaatgtgacgtaataaatgtctggactcaagaaatccttaagccctaggcttgaagtgtatttgttattgattgggaaatcctattatcctacatcaattaacatttaaaacaggatcttctttctttcttagccgagcagattgtctccattctaagcacgtaaacacacatgaatgcctgaaggcagagacagtgcttcacaaaaaaagccaactttgtttccttttttatttcttaccaagctttgaaaacaaatgccctcattctgcaatacataatcaagaatgaagaatgaaaaaaaaaatcacatatcctttgacctggcaaatccatgccagaaatttaatctgtgtgtaaattaagatgtgccctcaaattaaactaaaaggacggtgacagtgttttctggccttacttacgatagtaaaaagcatgaaacaacctaaatattccaatgtaggagatgattgtgaagaaatcaggtaataaagcagcttgataggaggttttataatttaggactaaattattggatctatcagcctgagttcaaatcctaactctataaccagtagctgtgagtatgagcacattacttaatctgcctggacctcagttttttcaactctgaaatgggttaatacatagtagtatttaccttgcaggatcattgtgaggattaaatgagataagaaaaaatcttagaatagtacctggcatgtaaatacatgattattggctgatgttgttcgtagtagtggtactataacactatcagggttcttttacttcacacagcagatatatactctgtctagcttaaataagaaaacaatgcatataagaagggtactagtagcttctagaagctgaaaacaatgggaaaacaggttttgatcttgtttggggatctcagctgcagaagttcacagagcttctgttcagtctgctgccactgaatcatttaggattcagctccaactgcctctgtccctgtgagtattggttcaggatttaaataccctgtggaggagcttgtgcctgttatgtgtttaactctgaagtttaccccaagggaactaagaagttggtcctttcccaaatacaggatgctgactcagaaacagcattgatgtttcatgagtataatcccattttattactttagaaaatataataccataaggccgggcgtggtggctcacgcctgtaattccagcactttgggaggccgaggctggcagatcacaaggtcaggagttcgagaccagcctggccaacatggtgaaaccccgtctctactaaaaatacaaaaattagctgggcatggtggcaagcacctataatcccagctactcgggaggctgaggcaggagaattgcttgaacctaggaggcggaggttgtagtgagccgagattgcaccactgcactccagcctgagcgatattgcgagactctgtctcaaaaaaaaagaaaaaagaaaatataatagtataaaacttttttctattttactcaacacagaacacttctgtgaccagatgtgtgggttttttttttcttcactcaccaagcaattctcccactctctgaacactagctggaggtcccgtaattcatttcggttctgacatgacctacctggagatagcatcacatcccacaggttaagggcacagtcccacaatactgctcccacttcagatgccaattgcaagtcccaggttatgacctttgcttctgaccgaccggctataaatcagggttcccatcataccccttccttggtttcaataatttgctaggatggcttacagaactcaaggaaacacttcagtttactggtttaatataaaggatacacagacagccagatgaagggatgcacattgcaaggtttggggaaggggagtgaagcttccttgccctctccaggtgcatgaccccccaggcacctccacatgttcagcaacctggaagcttgagcctgtaatcccagctacttgggagactgaggcatgagaatcgattaaacctgggagcagaggctgcagtgagccgagatctcaccactgcagcctgggcgacagagcgagactcccatctcaaaaaaaaaaaaaaaaaatttttttcatacggctttatctctacactttccctcccttacctttcttgtagattgatgggtggggttgaaggttccaatcctttaatcttctaataacctggtctctctggtgagcagcttcatcctgggttatctgtgcactatcttaagtcacctcattagcataaactcaggtatgatcaaaaggggctcatgatgaacaataaaagatactcctcctgctcaggaaatcccaagggttttaagagcttgtgacaggaactgggacaaagacgaagtatatttcatactataccacaaacatgtattttaatatatatgatcaggaaaaggtctggaaggatgtatattgagttgctgactgattttctcagggtacggggggtataggtatttaaaaaatatttccccctactccttcctttcttccttgtttcttctctattctttagtctgctttcttaaaactgaaattactgcacattttcaagtggtcttggaattattgttggaatgccagtgtttatttattggtcttagtataacagctctagaaaacctttttctgagattactcttccttcctccctcctttccgtgctttttgaaaaactttttttcttaatggaaagtttcaaacacccgtaaaggcagaagggatagttgaatgaactgccttggactcagcacccagctctaatgattatttacatttgccaattttgttgtatctaaccccctgcttttatttgccagagtattttagcaagtttcctacattttttcttatcttattcatgcagatatcttcttaattgttaccgacaaagtacaagttggggtctagggaattctgttaggaattacgcaagcctgaattctcaaatacatttcagttggtatacattgttgttctgttttcacatacagtagtcaccattctgagcatggttgatttactcaccagtaattgtacacacgaaatgaaatattcttgaatttgtcagaacaaaacatactggcttattgattgagatagtatcaattctattgattaaatgttgggtttcttttgcctcagccatatatgttctttggagctctggttttgtgtagtctcctgacaatttctttcatcccagacatctttggtctaccataatttaatactgttctgtgtttcatggacataaaacacaggagtgagatagtctgatcaagtagaaagaacattcagttgggaactaggaagtaataattctagcctgtctgggtatggtggtttgtgcctgtaatggcagctactcaggtcgctgagatgggaggatcctttgagcccaggagtttgaggccaaagtgagctgtgatggggccactgtgtgtgtagcctgggagacagagcaaaaccccacctctaacaaaacaaaaccaagaaaagaattctagcttggccctgcagtttaccaagttccttaacctttttgctgtttagtatctccatccacagaatgaaatggttggtctagacctatgctgtacaatacggtagccactggccacatgaaatgtgtttactctgaattgagatatactgtaagtgtaaaatacacacagtttttgaagacatcataagcaaaaacaatgcagaatgtctcagtaattatattttatattgattatatgttgaaatgataatattttgaatatgttgggttaatgtattattaaaattatttctactggaaaatttaaaaatcacattgtatttctattgaattgtgctcgtttagaatattctagttcattctctgaaattatatttgggattggcacaataatattcagtttacaaaaatttgacaaagggatctaacaaagtgctttagttggtcccagcatttctccttattttagtattaataaagatttttcttattttgggactgctatttaaaaagcagcttgggtcttgcatggtggctcacacctgtaatcctagcattttgggaggctgaggcaggtggattgtttgagcccaggaattcgagaccatcttgggcaacatggcgaaactccacctctacaaaaaatacaaaaatcagctggtgtggtggcatgtgccttttagtcccagctactcgggagactaaggtgggagggaggatggcctgagcctgggaggcagaggtttcagtgggccgagatcgcaccacttgcactccagcctgggtggcagagtgaggccctgtctcaaaaataaataaataaataattaaataaaaaagcagcctgtttttacgagcaggaaagtaggaaacaaatccttgtgatcaaaacataattggaatttctattgttattttggagtccattgttctgaactgtttcagaatagactgattattaaatttgtctagtaataatattttagtttagaggttttttgattatttttcagtgttgtcacctttttctttctcttctgtccaggctgatgtgcagtggtgcgatctcagcttactgcaacctccccctcttgggctcaagcgatcctttcacttcagcctctcgagtagctgggaccacagacatgcagcaacatgcccagctaattttttttttttgtatctttggtagagacggattttgttatattgcctgggctggtctcaaactcctgaggtcaagcgatctgcccacctcggcctcccgaagtgctgggattacagctaccgcacccttcatcatctttttctgatatatgtgtatatatatgtatatatatatgtacacattcagcagtgggaactgactgttttttgtcactatagattccttgcttttctgcttgtttacagtagggaatttcttttctgttaacttttaaaattttgagttaggcagacccctcaccctacaaccagaattgattcaaagagactcccagagctttttttttttttttgagaaggagtctcactctgttgcccaggatggagtgcagtggcgcgatctccacgatctcagctcactgcaacttccgcctcccaggttcaagcaattctcctgcctcagcttcccaggtagctgggattacaggcttataccaccacacccagctaatttttgtaattattattattattattttttagtagagagtggattttgccaagttagccacgctggtctcaaactcctgatctcaggtgatccacccgcctcggcctctcaaagtgctgggattacaggcatgagccaccacacctggcctcttttttttttttttttttgccacagagtctggctctgtcacccaggctggagtgcaatggtgcaatctcggctcactgcaacttctgcctcccaggttcaagctattctcctgcctcagcctcccaagtagctgggattacaggcacccaccaccatgcccggctaatttttgtgtttttagtagagacgggttttatcatgttgaccaagctggtctcaaactcctgacctcaggtaatctgcccgcttcagcctccccaaatgctgggattacaggcgtgagccaccgcttctggcctgagactcccagagatttttaaggaaggtcaagagttagctttaacaatcacactagagcttacttcttgagtattatgaagaaaataccagtatttttctcatggatatttcaagtatttaaatcatttaggcagatcatttgactcaacacattttctttgatcatacgacatttgcatagacttgtaccatataattgccccctcagttcccatttatacatgtactgtgcagatgccaaaggacgtaaacatggggcccagctagcacaatgacacagcctcctgaattgagccagcatattcctcttggctggatgtccactgctggctaatgcagcctttcagatgccggtttcagagttttcaggagctgtgggtcgggcacagcaggagttaaggggataatactggtaatattttctctgctcatttggtataagttatgtctccctgacgtcctctggtcatgaaatcctgtttgatactcccttcaagttcctgcctctagcactggctgaatttaggcttttcctcattattccttgcctgtgtctgctgcagcttctggagttcttatttccattcctgcatacctggctttcccataaagtgatgatacaatgtgatcccattctcctgcttaacccctctgagcttctcattatcctcagagtgaagggtgatctgtagttgagcaagcaggttcagttcattgaggcctctttattttcaaagcttttctccaattatcttcattgcattttggccatcaggctgctccatgttctccaaaggttctttgaactttctcccacctctgccttagatttggaagctcacaccaccttcaatgcctttccttcattttctgccagggaattctgcttatcctccaaggcttgactgcagaactctgtagagagaataaaggccttcttagagctctgtggcaatgttccttcttatataactataattatataccaatctgtactgaactgtgattaagagttgactttttctctagtttgtaatatatttagttcgttgtgcataattgtgcttattcttttgttggtaaatagtcattgaattcaataatggtaaaatgagggctggttgcatatatttgcagaggagctttcaaagtttataatctatacctgctgtgtccaacacagtagccactagccatgtgtggctattgaacacttgcaatttcactagtttgaattgtgctgtaagcgtgaaatgcacacaggttttgaagacttagtacaagaagaggaatgtaaatagtaacttttaatattgcgtacgtattgaaagaataatactttggtatatattaggttaaataaaatatattatttaatgaatttcacctgcttcttttgtctttttaaacacagctactggaatacttaaatttacatatgtggcttgcattatatttctactggactgctctcatctaatgggctcttactcttaggcttctcttttttttcattccagatctgagattacagaaaatgaaaccacttttaaatgataagccttttgcacattagtcaatttgacagatttcattgtagtcattaattttacctcttctagcctcgatgccaaattcccatgaacaaaaaatgtatttgagcagccttcaaatcctattgtgttatttgcttctggtccagaggagcagggacatgttagctgcctgcccagctgctgcctgttcacactgcagggcatgtgaggactggctgactgtcttcacgagaagtgcaggccaatgatacacggagccagaggttagtgagggtcacggcacacagtgacagtgtgcttcctgttctcagcaaggttgacagctgcaccgtgattcttggcagcagtcacacggcgggtcactctctggcaccctgggtgtttgcaagtctgacacagcactgagaggtgccaaggtatacccttctggagtgatctaaagaaggcaaagcctcccctcgtcccctcacttgcaccttctgtctgctttcttgtgcccttcacacaaagtggacactgggggaactgtggcccaccaaaaggaataaactttgccacagctcaagggttggtcaatcttgggtaattagtgtatatcaatgctttgtatcaggctcttggaagactatttaaagtaaaagcaggattctttaatgatcaaattcaggtggaggaaagattgtaaaaacacttttaatttgcaaataattaaaaatttacataaaagtcatgagaataataacgaagaatatcccataaatcctttccctagatttacctattagtaacattttattttatttgctgtcattggctcatatatatatatatatatgtataaatgtatatagagagtctcatatatatatatatatgagtctctacgtataaatttgtttttctggaactatatgagaataagttacttatatatcatagcccttcctcccctaaatatttcaatatacagttcctaataataaggttttctttttttgaaatggagacccactctgttgctcaggctggagtgcaatggtgcagtcttggcttactgcagcctccacctcctgggttcaaatgattctcatgcctcagcctcccaagtagctgggattacagatgcctgccaccatgcccagctaatttttttatttttagtagagatggggtttcatcatgttggccaggctggtctcgaactactgacctcaaatgatccgccctcctcagcctcccagagtgttgggattacaggcttgagccaccgcacccggccacggttttctcttaataacctcagttcaattaccaactttagtaaatttaacattaatataatacctttatctaatctactgtttgtattctaattttatctgttgacccaaaaatgttctttataacatattttcctttccattaagcctccactcaagaatcacatatctgtttagttgtcatgtctctttagttttctttaatctggagttcctcagcattttattttatttgttgacttttataacattgacattttgatggaggaatgttttaaattttaaaaacaaactctttaaagagctaggaaaaatacattttttgttattttttgtttatgtaggaaaaacctttgcaagcaaaaccttaaagaactgccaacgtagatatggctttctaaaaagattaacatttttctacaaccaaaccaaataaaccaaaaatccctccccaccaaatacgtaagcatttgcaatgagtatggcagactaaaggtagtacataaggtttattcaaggtggtaagaaaaagactaacatcttaaaaaccaagcaaaggaactcaaattggcaggtacacaggagatcaaatacaaacagccagtagtatgaaaaacaaacaactccctgggccttccgttgaatgcagatcaaaacagtagggggtgcttattaattttcaaaagattggttaaattaccgaggatggttctccactgtaggcagagcacaggaaaaaggaatagtctctcactactgatacagtgtacattgatgcacatcttgatgagggaggttaaattagggagcgatacatcaaagttttacatagcagcgacttcatatcttgagttttgtggcaggttgactgctatagatttgtgcattgtagtttatagatttttattttattttttagtttttaataatatgctcctagactcataaataatagaggcctatctctttaagaaaacatacttttagataattgaagggagcctatttgcatcaaaaagtcttcttaataaaaggttaagagaagggtttcttttaataatgaatgactctttttggtttaatatgaattgattgtcagtatagtaaatagtttagctttgcagttagagtgaggttcacctgggtgttgacatgggttgggattaattaggagactggtaaatctagagataagttaaacaagtctaattctggtcagcatccccaaagagccaggagtagtctctggatctggtagagatggggttgtttaaggaaagtggtattttaggaagactaccctggcagcagagagaacagtctagggggctattttattatagtaggtttgacattccaatggaagaaaggtaggatggggaaatgcagtgtctctgagagagaatgaggaagctcagtggagtctggtggctggtaatgtgtggaaggtaaaggacactaaaggaatgaatgatgggcttgttggcagaaacagggccagcaagaggtagctgccattttgaggagggccatgaggagttcagtctttgagtcattttccgtgacggtggtgcacctattttgttgggatagggaggatggaaggtggggttcggggaagattggagctggagaagaggttagctggtgatgtgtatttgttgagaacagaaagttcagcgctacttcctcagagattgagttaggtgagagctgaaaaggatttttggtcaaaagggatctgtagttggcctccttggagaggggctacattggagggtctgagaagttggcacatttagacaactacgtatttatatagtgtagtcatagctgttcttgtctggctttcttattacagggaagcttctctttgataacaacttgtctggacctttttccacccttctccagcagactgtccactccatctactttcatttgatcttcctccacctcattgtttattctaggaagcttaacctttctcatacaatattctcctgcttcagtgctccccctaccactccagacctgcgtttatttcattctcagagtaagagctatcctcttctgctatgaaagttactcaccctttgtacaggggagcctctttcttctcttctgggaaactgttgctgctttatttacattttcccccatctccatctccctattcctttctactttgggtttcatacagagctctgaggagagatcacatattgcattatggtaataaataaataaataattaataaatgcaaaaaaaaatcacaaaaccacaagcacatttcattatgggcagagtcagagggaaatgagcctcctcaggtttcacttaagcattttaatttttatcaggctactcttcaaaatatgcaaaaagttggttctaaacagtggttttaaagctgcagaatcccaacaagggaatgggatgggttcttgagccttctaaaaatagaagctttcacctctatttcatccagagcaactccttctaattctgattagtaattaattttggtaaagtgttttggggctttgaaaaagtaagctactatttcaaaagtaaatcatggcatgtacttccatgagttaaacctactatatgtagcaccttaattagatggtttcatattatggagcatctgaaggaatttacttgatattgtatactgattgctttcatagcttatcacaaaaagagattaaaagtttgtaagacaggccagatgcagaggctcacacctgtaatcctagcactttgggaggccaaggtgggaggattgcttgagcccaggagtttgagactagcctgggcaacatagtgagactccatctctatgtctattaatttttaaaaaaagtttataagacaaaaatagtcctaaataaaattatttctgtaaataactgacataaaaatgttgacctaattgtctgcagaatgaggcctgtttcccaaaggcttcagattgacctcaaggaaaattttgcagtcttaagaaaaagatgacccagcaaatgttctacctaagatgaagtctgattttgggtatcttttagaaagtgatgaggtaacgtattgtatagtcaaacagcaaataatatatttaaacattaatttttgtgtttacacacacacataatttttcttttttctttctttctttttttttttttttgcagggggcagagtcttgctgtctcccaggctggagtgcagtggtgcaattttggctcactgcagcctccacctcctgggttcaagtgattctcttgcctcagcctcccgagtcgctgggactactggcatgcaccaccacacccggctattttttgtgtttttagtagagacagggttttgccacactagccaggctggcctctaactcctgacttcaggtgatccacctgccttggcctcccaaagtgctgggattacaggcatgagcactgcgccctgcctacatgtaatttttctatgatgtaagttatttatatacttagaaacaatttaattgattattctttttctatttgataatgtaataatacagtgttgacattttattcaatactgctgaagtcagacagattataaagattaattcctctcttcttaccttttaaaaatgctgttttgagctgggcatggtggctcacacctgtaatcccagcactttgggaggccacagtggatggatcgcttgagctcagaagttcgagaccagcctggacaacatggtgaaaccccatctctacataaaaatacaaaaactagctgggcatgatggtatgcacctgtagtcccagctatttgggagactgaggtgggaggattacctgagcccagaaaagtcgaggctgcagtgagccataattgtgccactacaatccagcctgggtgacagagtgagacactgtctcaaagaaaacaaaaacaaaaaggaagaaaaacaagctgtattggagtctgggcatggtggcttacacctgtaattctagcactttgggaatccgagacgggaggatcacttgagcccaggagttcaagactagcctgggcaacatggtgaaactttgcgccaacggaaaatacaaaaaaattagccaggcatggtggtacacgcctatagtcccagccacttggaaggctgaggtcagaggatcgcttaagctcaggaggtcaaggctgcagtgagccaagatcgcaccattgcactccagcttggatgaccaagggagaccctgtcttgacactgccccaccccacaaaaatgctgtattggggtgcacacccatgcatattcctcatcatgggtccatcactctgcctttcaattacttttctgtattagaaatgaaaggtgggtggcctctacctctctaattttaagccctttaaactgtcttcctctaggacatttgtgttatttaaaaacaaatagatttttttttttttttgagatggagtctcgcaggctggagtgcagtggcgcagtctcggctggagtgcagtggtgcaatctcagctcaccacaacctccacctcctggattcaagtcattctcctgcctcagcctcccaagtagctaggattacaggcatgtgcccccatgcctggataatttttatattttgagtagagatggggtttcaccatgttggccaggctgcttttgaactcctgacctcgtgatccacctgccttggccttccaaagtgctgagataacaggcgtgagccactgcgcctggctgagattttttaaaggatacaaaattacagctggataggaagaatgagttctagtgttctatgccactgtaagatgactgtggttaacgataatatctagtttcaaatagctagatggatgataccgagtgtttccaacacaaagaaatgataaatatttgagatgatggatatgctaattacactgatctgatcactgtatattaaatgtatcaaaatattgctgggtacctcataaatatgtacaattatatgttaattaaaatgagaaaataatttatttttttcggttttattaaggtttaattgacaaataaaaatgtatatatttatcgtgtataatgtgatattttgagatgtatatattataaaatgattaaatcaggctaattagcatatctatcacctcacatacttttaattttttgtggtgaaaatatttaaaattgattctgttagcaattttcaattatataattacaatgtattattattaatgatagtcaccatgccacacaattgatctccagaacttctgtgtaaatgaaactttgtactctgtgaccagcatctctacccgtacctcacgttccaagtccctaataaccatcattttactttctgcttctgtgattctgactttttaagattctacatacaaataagatcatgcagtatttgtctttctgtgcctggcttatttcacttagccttaagacaggctctcactttgttgtccaggccagaatgcagtggtacaatcatagttcactgtagcctcaaactcctgggctcaagggatcctcttgccttaggttgctaagtaactagggctacagatctgagccaccatacctagctaattaaaaaaaattttttttttgtagagacagggtcttgccatcttaccaaggctggtcttgaactgggctcaagcagtcctcctacttcagccttccaaagtgctaggattacaggtgtgagccactgtgcctggccatttccttagtttttaaggctgaatagtatttgattgtgttcatatactacattctctttatccattcatttgttgggttggacacttaggtaaattccatattttggctattgtgaataatgctgcagtgaatatgggaatgcagatgtctttttgacatactgatttccttttctttggatatatatccagaagtggaattgctgggtcaggtcatatggtagttctgttttggattttttgagacatatccatatggtttaccatactggctgtactaatttacattcccaccaacagtgtgcaagggttccttgtcctcacattcttgccaacactcatctttcatctttttgataatagctatcctgagcgtgaagtgatatctcattgtgattttaatttgcatttctctgattagtgatgttgaacatttttccatatacctgttggccatttgtatgtcttcttttgagaaatgtctgttcatatcctttgcacattttaaaattgggttgttttcttaccattgagttgtataagttccttatatattttggatattagcttcatcaaatgtatggtgtgaaaatgttctcttccattccataggttgtctctttactctgttgattgtttcttttcctatatagaagctttttagtttgatgcaatccagtttgtctatttttgttttgttgcctgtgctttttgatcatattcaaaaaatctttgcgaagaccaatgtcaagaagctttttcctatgtttccttctagtagttttacagtttcaggtctatatttaagtctttagtccattttgaataggtttttgtatatggtatgagataagggtctaatttcattcttttgcatgtggatatccggttgtcccaacagcatttattgaagagactgtcccttccccttggcatctttgttgaaaatcagttgactgtaaatggatagatttctgggctgtctattctgttcagttggtctatgtatttgttttttatgttggtagcattttgttttgattgagatagctttgtagtagattttgaaatcaagtgtagtgtgatgactctgcctttgttctttttgctcaagattgctttggctatttggagtcttatgtagttctgtacagattttaagattattttttctatttctgtgaaaaatgtcattggaattttgatagggattgcattgaatctgtagatcactttgggtaatatggacattttaacagtattaattcttccaatctgtgaacataaaagatatcttatcacttattcgtgtcttcttcactttttttttttttttttgagatggagtctcaccttgtcacccaaactggagtgcaatggcgcaatctcagctcactgcaacctctgcctcccaggttcaagtgattcttctgcctcagcctcctgagtagctgagattacaggcgtgcgccaccatgcccggctaattttttttatctttagtggagatgggttttcaccatattagccaggctggtctcaagctcctgaccttgtgatttgcctgcctcagcctcccaaagtgctgggactcccagtgtgagccactgcgcctggcctactttctttcatcagtgttttatagtttgcagtgtacatatctttcatctccttggctaaatttattcctaggtatttgattgtttttgatgctgttataaatgagattgtttccttgattttttgttttgttttgatagtttgttgttagtatacagaaacatggctgggcatggttactcttgcctgtaatcccaatgctttaggaggtggaaggattgcttgagcccagaatttgagaagaacagcttgggcaacatagtgagaagccatctctattaaaaaacaaacaaaaaaaaaaacaaaacaagaaaaaaaaaacgaatggtactgatctttgtgtgttgattttgtatcctgcaactttactgagtttgtttattagttttaaaagctttttggtggtgtctttagggttttctgtttataaaattatgttatctgcagagacaatttaacttcttcttttctgatttggatactttcatttctttttcttacttaattgctttggctaggacttccaatactacgttgaaaagaagtggcaagggtgggtatatttttcttgttcttaatcttaaaggaaaagctttcagcttctcaccattgagtgtgatgttaattgtgggtttgtcacatacggcctttttgtgttgaggtacagcacattccctctatgcctaatttgttgagagtttttatcatgaaaggatgttgaattttgtcaaatgctttttctgtatctttagagattaccatatgatttttctccttcattctgttaatttgctgtatcaatttattgctgaaccatccttgcatccctgggattaattcctcttgctcgtggtgaaggattcttttaatctgctgttgaattcagattgctggttttctgttgtgtattttcgcatccatgttcatcagggatattggcctgtaatattcttttcttgtagtttccttgtctggctttggtattagtataatactgaccttgtaaagtgagtttggaagtatgcatccctcttcagttttttgaagtttttttttagagtttcactttgtcataaaggctggagtatagtggcacaagcatgggtcactgcaacctcaatcttgtggggtgggttcaagcaatcctcccacctcagcctcctgagtagctgggactacaggcatgtgacaccacacctgcctaatttttatttatttatttttattttttgtagaaacagggtctcactatgttgtgcaggcttgtcttgaactcctaggcttaagcatttctcctacctcagcctcctgaagtgctgggattataggcatgagccactgcacttgggctttttgaagagtttgagaattagtattagttctttttaaagtgtttggtagaattcagccttgaagccatcaggtcctgggcttttccatgatggaagattttttatttaattactgattcagtctccttacttgttattagtttgttcagattttctatattttcatgatttagttttggtaggttgtacattttcaggaatttacccatttcttttagattatccaatttattgacataactgttcatcataatctcttataatcctttgtatttctgtggtatcagttataatgtctcctttttcatttcttattttgagtcttctcttttatttcttttgtagtccagctaaaagtttgtccattttttttatcttttcaaagaaccaacttttagttttgttgatcttttctattgtttttcttgtttccatttatttctgctctgatcttttttgtttactctttctactaactttggactttagttcgttcttctttgtctagttctttgaggtgtaacattaggttgttcatttgagatcttttttcttttttaatataggcatttattgccataagcttctttcttagaactgcttttgctgcattttgtaagttttggtatattgtatttccacttctgtttgtcttaagatatttttaaatttcccttttaagttcttctctgacccattggttgttcaggagaatgctgtttaatttcaacctatttgtaaattttccaaaattcctcctgttaatgatttatataggttggtccaaaataattgcggtttttgccattgaaaggaatggcaaaaatgctattatttttgcaccaatccaatactttcctaccagtgtggttggaatagacagttggtatgatttcagtcttttaaaagttgttaagacttgttttatggactatcatctgatctgtcctagagaaaatttcatgtgcacttgagaagaatgtgtattctactctcattgaatggaatgttctgtatatgtctgttaggtccattttctttaaagtatagttcaagcccagtgctttgtcattgattttctgtgtaaatgatttatccattgttgaaagtgtaatattgaagtcccctactattattgtatttcattctatctctactttcacatatttatttatttatttatttattttttatttatttgagatggagtgttgctctgttgcctaggctggagtgcagtggcatgatctaggctcactgcagcctccacctcacaggttcaagtgatcctctcccatcagcctctcaagtagctgggattacaagcatgtgccgccacatccagcttattttttgcattttcagtagagacgaggtttcaccatgttggccccactggtctcaaactcctgacctcacatgatccacccaccttgtcctcctaaagtgctgggattacaggcatgagccactgtgcccagctcagatttattaatgtttgctttatattatattatatatatattttatatatttacagcaaacattaggtgctgtaacattaggtacatgtgtatttacagttgttatatcctcttgatgaattgatccctttatcatcatataatgccctttttggtctctgtatcgttttttgttgttgttgttgtttttgagatggagtctccctctgtcactaggctggagtgcactggtgtgatgtcggctcactgcaatctccgcctcctgggttcaagcaattctcctgcctcagcctcctgagtagctagaactacaggcacgcaccaccatgcccagctaatttttgtatttttagtagagatggggtttcaccatattggacaggctggtctcgaactcctgaccttgtgattcgactgcctcagcctcccaaagtgctgggattacaggtgtgagccaccgtgcccagccagtttttcacataaagtccattttgtctgatataaacatagctgctcctgctccttcaggatcccctaccccttggtgtttaatcctcttaactttctgaaaatgcatttgtttagacatgttagtttgagttccccaagaaacagactctgagacaaggatttgagtgcaagtagtttatttgggttgagagtaggagagttaaaagtgaaacactgaggaaaaggtggccaataaagagtgaattactaagccagctctcactgtgggcaactggtactcaattctgtgcaggaataattgggagctggtgtagaacacttacctcagagttattccatctgaagagtgaggaaatgagtatttataccctaacttctttagtctttggctaagagctgctcttgagggtatataggtggcagagtaggttacagtgataagaaaagcccttaggccaaatggagctgctggtagttggaaaccaggagttgtggtaaggaggggggatatataggtggatattagcagcatcctctatcccaggcttctgactgagcattgtggttcaatggtgagcgcatcatggtctccagagtagactgacctgtgtccagcacctggcagatattcctcaatagcctttagtttcatctccctttaaaagaacgaggaaaaatctatcactttttaaatacgtattttaatctttctttaaaaatcatttcaagcactttaatcttcaagcatttttaagccagcacacttagagctatacctaagaggatcgttcttgaggtgccgcctcctgttatgtggcaaacgtagtaatagatgttggggataacagaaataaaagacatgattccagcccagagaagttcctgggctagtgggtgattattagatggtttatctagggatcctttttcaagtgaaaagggacttgaagtgaatcatttagtcaacaaaaatatgtttgtaggtgctttagaatttgggtcaaacctttttcagtttcaaaccctagctctgccttgttggctgagtgacatttgatgaaacaatatttagtctgtctgagactgtattagttcattttcacacagctataaagaactacctgaggctggataatttataaagaaaggaggtttaattgactcacagttctgcatggctggggaggcctcaggaatcttacaatcatggtggaaggtgaaggagaaggaaggcaagtcttacatggcagcaggagagagagagcgagcgagcgaggagggacctgccaaacacttttaaacatcagatctcatgagaactcactatcatgagaacagcatgggggaaactgcctccatgatccaatcacttcccagcaggtccctcccttgacatgtggggattgcaatttgagatgatgtttgggtggagacacagagccaaaccatatcagagccttagtttcctcaattgtaaaatgcaattactaataccgaccgcatgggattggggattaaatgtaataaccttaaaagatggactgtatttgagtagaagagatcacaaagggatgagtgaggagagagtcaatggacaggtcacaaaactatagtaagacaacagaacaaagatgcaaaagtgggtttgcagctggatcacggaggatgttgaatgtcaagctaaaataggccgtggggactttgcagcagacagtgaggttttagtgtgtctcaatcagaaaggctgaagaaaaaggccttcagtctttacactgtcatgatattctttggtgaatgagctctccacaggacttagagctatacctttagggagcttggttttctgcatctctgaaccaccaacttacaagtcctgcattcatgactaggaccatagagaaccctcttgacatggtggagaatttgcttatatggaaacctaagaagttgaccctattaggaccagtcttgatgctaccagtactgattcttaaaatatacattatttgcatacattagccaccagcccatttttaacgttgggtggggaggctaaggctcaagaacatggtagtctcttaattataggtagattttgtgagaagacttcagtcctataggagttcagaaattttctcttattaccagtgatcttaaaggattgatggtaagactgatgaaagaggaccgtccacttaaaaatggggaatgtttggtttccaattgaggtcttacatatgtttctttgatcttatcataagctgctcatgtttcccacctggagaatgtgtcagaggaagaaatgaacagactcctgggaatagtattggatgtggaatatctctttacctgtgtccacaaggaagaagatgcagataccaaacaagtttatttctatctatttaaggtgagattttaacattttaaaaacattttctctcattattcaaatgtacccagtctccatatgccaggtcgtggctgtgaaggctttcagctcctggtacattttgccctcagagtttgctgaacaatacgtttcttcatgactgattctctaaaatggcccaccatagtttgaacacatcattctctttgaggcttttacacttgtatgcaaagttgagtatcttggtttgcatatgcaaatagattttttccatccacccaacaaatatttattgcacatctgttctgcatgtggcactaacgtaggcatgagggatagaacagtggacaaaacagagttcttcccctcatgcaatatatatttcagtagaagagacagtcaacaagtaaataatacctttgcaggtggtgataagtgttggccgaagagaaacaaagtaggataagtggaatcagaatggcagggatggtggcgagttggggacatgccagcgaggaaggtcagttaggatagcctctctgaggagatggaagttgagcagaaacctgagtgggagataggagccatctgtgcaaagtgctaggggaagagactccgaggcagagggaggaacaggtattttaggccgtgcactaagagagcttgaagtgatgtctgtacagcaaggagggcagcgtggtggagcccagcgagcagagggttgggtgggaggagatgtagttggaggagtggctgtaagtcctatctctaatgctttaagaggaggaatcaacatattccaaatttattttggtaacttagccactgttacctgtttctcactgacaccagtcaccgattactgctgccattccccgtagctgcctcttcactagttctacctcagctccatgtgggtcacatccattccctactatagacatacatctcctcaagcttctgattagagccaggactaacgatgtgggaaggaaactggtggtggaaatgggtagcaaaacttcaggttgccaaaaatagatctataaaggaggctgccagaaggaataaccttaaaaaaaaataaacctgctactgagggcatagtagattatgttgtattgtgtaacccttacaaggatgttgaaagcaaaacaaaagcactcagagcttatgggtaggaaaagtttgcctcttctaataagaagcactgtgcttcattttataataactctccttcaactcatttatatttatttgtacttcatttttatatgacaaaaatagctaaattttccagtgagttccctcttttgctttggctgctaggaatcttagtgcaaattttgtacccagttcctatagctcttttcttttctttgtctgaacttatttgattcataattttgcctttccccctttttattaacttttgtcttttattgtactaatgggtttttttgggtggttaggagataggagtgggaggtagaattatatttttaaaatttggtagatattaaatttggggatattaactttaaaaagaataataggaaagagagagagagagagagagaaagagagtgggggaagagagagaatatgaacagctggattccccacagccattagcaggcactggaccactttaggcatccaggtgacaacttgttgacatggctgtgaggtttgagtcattcagctcgaaccctggcaggttcatagtgtttagagcttctttggaaaaagatcttagttgaagaaaaacaaggtctgcctgactacagctattatttgtcttggaactgtgctccctggcagctccccactaccctgttggaagtgaaggtggtgtcaaggtttccatcctgtcagcctctatttagtttataaccaaccaaacaagccagaaagcattgctctgctttaaagtacatcttctctctctttcttccctccttcatcttaaaataacagtgcaaatatatttgcttgtggaaacacaatccaaaatattcagcattctccccacctcctgcaaaaagtattattcttgggcaaataagttataaataatctattccttagcttctgaaaggcaattcctaaaaacaaaacaaaaataatgattaaatttttttttaattttaacttttttgagacagaatcttactctgtcatccaggctagagtgaagtggtgtgatctcagctcactgcaacctccaccacctgagttcaagtgattctcctgcctcagcctcctgagtagctgggattacaggtgtgtgccgccatgcccggctaatatttgtatttttagtagagatggggtttcacattgtcggccatgcttgtcttgaactcctagcttcaagtgatctcccccctcggccttccaaagtgctgggattacaggcatgagccactgcatctggcccatgattttttaaaaagaaaaaaagagaaaggcagttcctgtgtctcatgtgtcaataattaaagtaaaaatgtgttacatattttagtagaattaaaaaatttcagtcttagtctgggcacggtggctcacaactgtaatcccagaactttgggaggctgaggcaggcccattacctgaggtcaggggttcaagaccagcctggcaaacatggtgaaactctgtctctataaaaatacaaaaattagccaggtgtggttgtgtgcacctgtaaattccagctacttgagaggctgaggcaggagaattgcttgagtccgggatgcagaggttgccatgagctgagatcatgccactgcacttccaacctggccgacagagtgagacaacgtcccaaattaaaaaaaaaaaaaagtcagtcttagatgttgaacataaacccaatggaaagctgcgtcctaaagttgaagtatatcttagtgcttacaaatgtggcgctggagtctaactacctgggtttaaaactttgctctatcacttactaaatgtgactttgggcaagttaatctgccttgttagtagtagcacctacctcaaaaggttgtaagtattaaatgagataatatatgtgaagaaccatgaagattgtctgttgaaattaaggatgcaaatgcctgctgctattaagaacttttttttatatgcacacttatcccagcttcatcatcttatagataaactgaagttcaacatctccacaatccatcagtttacctccaaattgaaacccccaaatgggccaagttcctaaatggtcttattttaactggggaaaaaaagtaagcaaccagaattatttgtatttaatttttatgaccaatctttagatattcttagaaacatatacaatgacttatctttattgctaatttgcttttataaagatgggcataatacttgaaaggatgaacagatgccccatactcataatttgtatggcacccctggaaggagttgaggtccttgtaagacacagttcagtggtgagacatggtcatcttcaatcttggtggttcatcaggttccatttacccctgagagaatggtttccatgttttgtttctactgaaaaggcagtaagcgagaaaggagggaaagatgttacttaaataaatgtgtggccatatctaactgacccacatgtaaaagttacagaagattcaagcaaagatcgaaggtaaagaatttcaatatcaaatttattttctgcgttgttcttggtaagtggctctgtgttcccttttctgtttgctctttgagagctttaaattccagtggcaggaattaagagcagtgtttttgttttgtgggcattgagatgccagaacagttggcctgcattctacggatggaagggaaatgaaaaaaagactgtaacagtgaaagttgcccatttagagctctgcagactttcttcctaaagagcctgtgccctagatgatgcgtatgccgtgcagctgctgtagacagctcctgtcccctggcctcttttgtgcagaatagatcttggtctctcacgtctttaaataagatcctctagagcttcagcacacctacggtggcctggatgggcatgtgccaagtgtgtagggttgcataccaggcctctgggtcaatggaaagccagaaacagtggggagaagagggaagtgcatgggacggtggtgtctgttggaccagcatgggtggcctaggctgcccagaacatgaaaggtgtccatttcttcataactctggccgtggacatgaaggccaatttgggttacctgatagttgcccattttattgacttaaggatttgtttatatatagttaagataaatagaatatggtaacttcctttaaaggctgtgtgtgtgtgtgtaagagagagagagagagacagacagaaacagaagagagaggagagagagagagacataccaattaagtttttctttttcttttttttaatgatttctttgcagctcttgagaaagtctattttacaaagaggaaaacctgtggttgaaggctctttggaaaagaaacccccatttgaaaaacctagcattgaacaggtaaaaagattttaaaagccctctttttattggctcaaggctgaagaaatcttttaatcctccttttatatctctatctacggcttccctcctccatacccaggttagagatgtttaccagtctgtggaaattgtcctggaggctttggatcagaggtgtatacctaatttaatacatgatctagcttttgccttttagggttgttacatactcacagtttactgtgtgtttggggaagaaaaacattaagtagaacatgtagtttgtaagaagaacacatgaaatgtgctttttcttgttgttggtgctttaaaatgaagtctttgtccatttgcttggcactgtctgagaaagcctattgaggtgaggggatttagtagcaatgtgaaaaacattgtaagtcaagcaaaaaaagcaaaaaagaaatgagattttgtacccagaaatggacttcctgctacattatgattcctggaaagaagccgttttactcagggaatctgttaaaatgtaaagagtttttctgttaggtgttgtcagtatctctcattagcatcacttttttagcctttgattgtttggctaaacaaaaacactctggactgaattttttgatgagaatgactactgaagtcatgataccagaatccttaaaaataaatgcatttttatcagtcagttttcagtaaattttattttgcctccaaactctattaaataagaattcattgctcttttatttgaaattagatgagatggaaatattctgtagaaagattaaattaacagtttttttaaaagcccataattttgaatgatatatatattttggtaagcttattgacttcaaacaaatgatagtaaagagtttaaattttagttgtttagttcagtggtaggcatgatagcaggcttttgattagcatttttgtaatgtaaaaacaatatttatctaagaactgcattatatgtgggctactctgctgatagtaaagcaataattattctgcacaacagtcatattttcttgtttcaggggttttgaccttttcagtccatggttttgattttctccttaatgcttcaggatttcagcaggcgtagaatcacaactcacagcctctctgtcttgtcacttttcatccaccgtgatctgaggcaagattccctctggggattgctattttcttttagggaaaaggaagagatttttgtgaacagagaaatgtctgttattttgctaataaccaccaatcatgctggctgtgtgggtgttcagaattagtatgattgcatagctgcatgaagaaattgccttccctctttttaagggtgtgaataactttgtgcagtacaaatttagtcacctgccagcaaaagaaaggcaaacaatagttgagttggcaaaaatgttcctaaaccgcatcaactattggcatctggaggcaccatctcaacgaagactgcgatctcccaatgatgatatttctggatacaaagagaactacacaaggtaatcagatgcaagttcttttcctttggccccataaagcctgttacagacctaaaattgtacttgactctataagtatagggctgcctagttatcattatgactccatcaattcagagataatgtctttataatttaacttgcaaactcctgcttttcattgctatcataatatgttgaggtgtgagggatgtaaatcatctatacccagtgtgatagccactagctatatgagcacttgaaaatgtggctagtttgaattgagatttctatgattgtaccaaaaaggagtttaaaattgctcattaatacttttaaaatattgattacatgtagaaatgatagtacattggatacattggattaaataaaatatattgaagttaattttacctgtttttaccattccagtgtggctactagaaaatttaaaatccatatgtggcttgtgttatttatctattgaatatagttgactagatagctacactataactctgaaattaattagagccctcactcaaaaaatgcaatgaccatataatgaagttaaagaattttttttaggctgggcatggtggctcacacctgtaatcctagcactttgggagtctaaagtgggtagatcacttgggtcaggagttcaagaccagcctggccaatatggtgaaaccccatctctactaaaaatacaaaaattaactgggcatggtgtcacgtgactgtaatcctggctacttgggaggctgaggcaggagaatcacttgaaccctggaggcagagtttgcagtgaactgagatcgtgcactctgggcaacagagcaagactctgtctcaaaaaaaaaattttttttaaaggaaagattagcttagttccagaactgtgatggaactgacatcattatacatattatcttccaggttttgtccttttaaataacattttacattagttataatgaaagaaaatgtagaattttgtagcctttatgtctcttcacttaatatcatatcaaacatttcacaggttacattatagtccattgagttgatttaccacaatttacctaaccatttctctattgctggacattcaaactctgcagatagtcttggattgaacatatattttcttctaaagtggaaatttatttttattgcttattacttgcagaataacagaattggttttacaaatcttaaacttgtaccatacaaaatataaggacctacatttattttcatctgaaggactgtgacttgggtcatccattcttttcaacttttttataacttttctataacttttctctgtttatatttcagaggcacatcaagcttgcattagggagctttagtgcctacttttttcctgatttaaagtgggcagtagtatcttttgatagcctgtcaagaccacttgtgcccaggttattttctgtaacagcagataacatggaagaattgtataatttaaaataagctttcctctctgacattgacctagtttcatgtgtaacacacccttttcctctctttctcttcacttttgcaaatatatgcaatttcagttataaagtattttctccttaataattgatatttataggaattgcagatttcttcaaaataagtttttaaattatatctttatttccgtatctttcattttaggattttacattaacaatagttctgtattattgaaactctgctatattattgaaactcttgtttataataagagttgagacgataagtctctcaaaaatatgtattttttaatcccgtctgtgaacaattgacaaagctgaatatttgtcaaagccagggccctgaatgcatttgcgacttttagcagagaaaataatcgtttcatcaagaaaaaggagaattaattgtgaagcagcttgggagacattagtatattttgttttatttttatttttattttttttagagatggtgtcttattctgtatcctgggctggagcgcagtggcatgatcatagctcactgtagcctcaacctcctagactcaagcaattcatctatctcagcctccttagtagctgggactacaggcacatgccaccatgcctggctatttgtttattttttatagagatggggtctcgctgtgttgcccaggctggtctcaaactcctgacctcaagcaatcctcccaccttggcctcccaaagtgctgagattacatgtgtgagtcactgtgcccagctatgatattttagaaaacagaagaaaaatgcaaggcagcctttgagaattactaagaaattggtggcacttatgaatacttaagaagtagtaaaaatggaaattggtttggatgagtgctgggtttgaatggtgtgggtccatctctccctttttacatgagctttagaccagtctctggtctaaagagacttttggtttctttctctgtccaagtgtcatgacttttgtgagtattccatgggtggtttgtatgtagtttctgacacacagagcaggtgctgggaagatgctcatcatcattttcctcccatgcacattgttctctaaaactcagtcactgccaatgtggagcttattaagctaaagccttaaatgtataattgagtgagtgtgtaattatttgaatatcgctttagaaattaagatagcagggaatagaaaaacagcaaaagagtcctttatagcccagcctcctgagccaacagctgaaggcaaaaagtggagtcagacaatgggaaagagaaacttgctgagagaaacagaaatgaatatgccctaatgagttctgaaacgtgctgatttctaggtgaaatgtagaccaatagcccctattaataataaataaggaaatgaaggtagatgacaccaacctcccccacgtccccaccatcacgtcatgttgatgaggaaagggaagtagagaggaacaacctgtgaaaattaggagaatcaatattcggagtaaaacctcactgccatgaccacatggggaattaaaaaaaccacataccaccacagcatgatgtctcactgatactgatcttctcaaaaatgggtaatattactggctgcaggcaccagcaggctttatcttgatgttgctgtaagagaacctcaggacctataacgctggttcagcttataacttacagcagttactgtaaatattagaacaaagatgtgccgaaaatgtttgcagtatatcagtctgaaaatgaagttaaacaggattctttgtggaaaagactggacttagaaaatgattgtgttcattacagagctaacttgtaaatatttattccataaaaattaaaagcagactgaacagtagtactgcttaaattacttctctgttctgaagaaaagaaaaatataagtattctttttttgttgtttttttgttttttttttttttgagatggagtctcactctgttgtccaggctggagtgcagtggcgcgactcagctcactgcaacctccacctcctgagttcaggcgattttcctgccttagcctcccaagtagctaggattacaagtgcgtgccaccatgcctggctaatttttgtatttttagtaaagatggggtttcaccatgttggccaggctagtctcgaactcctgacctcaggtgatctgcctacctcgtcctcctaaagtgctgggattaaaggcgtgagccaccttgctcaacctaaatattgttacataagtgtatgttaactgtaccttatatatactcccaggagcaattgtggttatagaaaaaaatgtgggcaaatattttgaagttcctgaatttcatgatagtacactatttaattccatgaagaaataacctaaaaagaaagtgtcacaggattatgacttcttaaaatacaactgtccaacagtctgctgaaggaaagtgcaagtaattagtcttagattttgaattgtgtagaacttttgaaagttaaagcttacccccacactggggagatgtttcataagaatacagagtggctgtgtgcagtagctgatgcctgtaatcccagcaactttgggaggctgaggcgagaggatcgcttgagcccaggagtttgagcccagcctgggcaacacaatgagacttcatctctacaaaaataaaaataaaaaactagctgggtgtggtggcatgtgcctgtggtggcatgagcctgtggtcccagcgactctggaggttgaggtgggaggattgcttgagcccgggaggtcaaggctgcttggagctgtccatgatcctaccactgcactccggcctgggtgacagagcacgaccctgtctgaaaaaaaaaaaaaaaaaagaagaagaagaagaaaaagaatacatagcaagttagctagaactaacttgtttttgggaaacagttttatttagccattcttctatgatgtacagcctattgccatgtatactgagcattcattattagacatgtaagtctagaacagatttatcaggaagcatggaaagaacactaggaaacaggagatctgacttctagtctggactttaattaagtaactgggcctcagtccctgtgaactagggcaggtcagtttattcctgaaaaccacaggattttcagttcagcaagtcagtagaatgacatggtcttctgtgttcacatttttaatttctgttcacagaagttacaaatcatcatcatgatgtgaaaaatctgggagttatttgaacagtaagaaaatagcatgcaaataccatctttattagacatacaaaaatgaacgaactatcattttgcttctttttagtagacccgaaatcagtcatgtaggtaaaatcttttctacagttacttctttggaggaatacatgtgctcatgcacgtccgtttccttctttctgtctcactgtgtgcaataataatatcaatcaatttattaaaacaacaccagaagtacacacacacacacacacacacacacattctgtctctctcacacacacacacattgactcagcctcattgtcttaatctacagtgaatttaacagattacaaaataagattaatcttggaagttaagaaaaagctgaaaagtataaattgaggtctataaaatgactttgaggaaatgaatgaaagcccattatttgaacatttttactagctaataacaatctatgctgtcttctaccctgggaagattgaataacctgttaaagcacttttggataactttttaggattttatgataatatttataacctatcatctttgtatcagaaataatgtcagtcttagagccttagacgtttgcagatctctcctcagatggaaatgctgtttagactctaaatcagcactgtccagtagatatataatatgagccaaaaatgcaagccagatatataattaaaaattttctagtagctacgtataaaatgaatagatataagaaattattctgaattttatgtgtgtatatatatatatatatatatacacacatattattcagtgtttcttatatatattattgagacggagcaggccagagcatcccaggcaggggagtagcgagaaatcttggcacaataatctccacccacagagtcaagagatacagcacagcatccgagtaggagagtacaggcatgcgcacacgacagcgcattttgtatttaagagagcagggattcccgttggccggcgatagggccccggcttagaatatgcctcccgccgccagaggtgggttttgggagacaccaccaggcgttatttatatttagccaaaaaaaaaacaatcgagggggcgcgccacccttatcttatttggggtacgaagaaggccggagaaaaggacacgcccgctcccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggctggggcaggagagttgcttgaatggggaggtggaagttgcagtgagtcgagatcatgccattgccctccagcctggggcacagagcaatactatgtttcaaaaaaaaaaaaaaaaccccaaaaacaaaaaacccacaaaaatataatttcaccatgtaaccattgtgaaaaattattaaggatgtatacttactttcttagtactgagtccttcaaacctccaaatccagtgtttattttgctttttccttttttttttttttttttttgagttggagtcttgctgtgtttcccaggctggagtgcagtggtatgatctgagctcactgcaaccttcgcctcccaggttcaaacgattctcctgcctcaggctgccaagtagctgggactacaggcgcctgccaccatgcctggctaatgtttatattttttagtagagatggggtttcatcatgttccccaggctggtcttgaattcttgacctccggtaatccacctgcctcaacttcccaaagtcctgggattacaggtgtgagccactgcacccggccaaatccagtgtgtatttttcacacatcttaattcagtagctaaattttaaacaattaaaactaaatggagtcctactagaacaatcaagttgtgtttaatgggaaaacattttacactgtttccatttaaaagtaaaattgaaattgattaaataaaattaaaagttaaacttctcagtcatactagccacatttcaagtgctcaatagttaccaatggctggtggctactgtattggatagcagagacatagaatcatccccatcatcagtgaaagctttattggacaataaatctttaaacctttcattgcagaagattggacatattttgttatttttaaaatttaggatctgcataacaacattttagtcagcaatggaccacatataatgacagtagtcctttaagattatgccaaaattttgctgtacctttccatgtttaggtatatttagatatacaaatacttaccattatgttacagtcgtttgtagtattcagtacagtaatatgctgtagaggtttgcagcctaagagcaatagactagaccatagagcaggggtcccccacccctgggccatggtccaccataggtccgtggctcattaggaaccgggctgcacagcaggaagtgagtggtgggcgagtgagcattacagcctgagctccacctcctgtcagatcagtggtggcattagattctcataggagcctgaactctattgtgaactgtgcatgtgagggatctaagctgtacattctttctgagagtctaatgcttgatgatctgaggtggaacagtttcatctggaaaccatcccttctacccccagccatggaaaaattgtctctcatgaaagcaatccctggtgccaaaaaagttggggacctctgccatagagcctaggtgccaagtgtgtagtaggttctaccatctaggtttgtgtaggtacactctccagtgtttgcacaatgataaaatcacctgactcatttctcagaatgtattcccgttgttaagcaagacatgaaagacatgaccatattaattcttacagatagtcttgtgattgcctaagtctcacgaaattgaacttctgattatgaagatctgtgactgtttaactctatggtttcattactagttatttgatctgacttcccctcagccccagatagatagatagatagatagatagatagatagatagatagcatgtcagtgtctcattctgtcactctgtcacccaggctgcattgcagtggcacaatcatagctcacagcagcctagaactcctaggttcaagtgatcctacctcctcagcctcccaagtagctaggaatataggtatgtgccaatacatctggctgatttttaaactttttgtagagatgggcgtcttactatgttgcccaggctggtcttgaactcctgggctcaagcgatcttcctgcttgggccttccaaagcactgggatgactggtgtaagccaccatgccatgcctagccagcccattcttttaacttaattaagtggccacagactaacatctagcaaacaattggctttgaaagcaatgaatttctatatgaagcaccttatgaattacaaaataaatgcactttataatttttttctgctaccaagatcactgtttcagacaaaagacaacattaacacttaagatacccatttcagtattgtaaacataaacaacatttgggtgtaaattattaaaggaaaaaagttgagagaagacatagaaatagtagcagaaattttaggttaatttttaatgtaggcagatgaactaacactaatgaaagctttttctccaaaggtgaaccactgccacagccaccaccatttccaccactagcacacatacaggcaaaatattttataatgcagaataagatttaaaaaaaaaagtcaggagcatgaataaattaatattattcctctcttcattaaagggctcaaagttcattgggagctttttgtagcagcttgggcgcattagaaagctgtctcccatttgaaaggagaacaggaaagcacatagggaggagaggtttgatttttggaaggcagtcctttcctagaagaggatgatttgggtctgctctgaaggaataagaatctgtggaataatgctttttgaccttttcctcgtttggtgccaccctccatggctaccactgttatatttatgtttttgggtcctgggaaattcacatcttcacttctgggagataaaaaaaaaatagggttgtctcagtttggtagctcatgcctgtaatcacagcactttgggaagccgaggtgggtggatctctttagtccaggagttcgagacaatcctgggcaacatagtgaaaccccgtctttacaaaaaataagaaaaaattagccacatgtggtggtgcatgcctgtggtcccagttgtttggcaggctgaggtaggagggtcacttgagcccaggaggtagaggttgcagtgagccgagattgtaccactgcactccagccttggtgacacagtgagaccctgtctcaaaaaaaaaaaaaaaaaaagaaagaaaaagaaagaaaaagaggtttatttttgaatagacttttactctccactgtatgttggccgaatgcactttctaaattagatgacctgtattgtcagtgtaccctagaactgtggtcacatctcaagaaaagtcctggcttccctctggtctgggtcctcctccagcgtcgtgcagtgatgctgaggtgcatttttgactttgagtctgagtcgttgaaaaatgtacctaggcgacaaatggtagaagcttaatacttcctacatttttgactgagttttaaacagtcctgaagatcattatcttcccaccaaacctccgataagtgctgtgtaggcattttaaataaatcttacattttactcaaaggactaggtggttaattctgattctttcacaaaagggtcttcctcagcttctcctttaattttttcttttatctaaactaccattaatgtgccagtaactccagttatactatgcattttatatacagtatttcatttaatgctcacaagaacccaatgaagtaggtattattgttgtccccattttacaggtaaggaaagaaaggctaaatagcataatcaaattttcaaagttatgcagctagttaagtgacacagctggaatttgatcccaggggctgtttcattccaggactcactgtatgatgctgcagaataaggtgattttaacagaattagacacaagtggtgatgtaagggtaatctaattgcattcccaagtttcactagctggcagggatattgttgcttgttattgcaggcctagtttttttctgctatagttaatagtacgagataaacataattgaatatttctgatgacctgggggtttatgggatattgatggtgcttgacttctcttgtcacaggtggctgtgttactgcaacgtgccacagttctgcgacagtctacctcggtacgaaaccacacaggtgtttgggagaacattgcttcgctcggtcttcactgttatgaggcgacaactcctggaacaagcaagacaggaaaaagataaactgcctcttgaaaaacgaactctaatcctcactcatttcccaaagtaagggagagtttttgctggtctttgtttgatcccagagcttgaggttgctaaatacaatgccaaagcctgcataaataacaagatcggaaatgacagaagaaacattccaaggggatgggagaaaagaccctcagttccctttgtgaatcttcttgggtattttccagtccatttattagcctgactttgggttgactgccgtcattgctcccttatcccctcctcgtcctacctgagtcattgtctctgactcacatagaatggggcagtgctttcttttgtatattcagcggccaggaagctctaggacgatgagggagaatgtttaggtacattttccagccactcagaaatggtgcaaaagagctcaagtggcttttttttttttttccgttcaatttctccaactttttccaagcactggtgaaccatccctgcctcagctatagtagacttgcccccactctttggaaactagactgcaaaagcagggatgaagaggaatagagagctccttcagcgtgatgaacctctatactaaatttcttgtagaataggcatactttggtgctccttgcttcttgcacctgtcagagctccaaggcataaatgatcatttaaatattttaaatggaaggaaatgctgcaaagcaatagaaagttgcagtgctgcaccattggccttggaaatgcatttttaatgctaaaaaccaaaaatttaagctaagcggttggatgctggtgggataggccaagggtgcagttgatgacttctcatggagcagtaacagcgagaaatgaatgagacagttcattctgtgattatcattccgcctagatcagcgcttggtcaggaaggtaaaaggcgtaatttgaaaaggctggctaggtatgatatagccttccttccccatgccattctgaactgctgatgtagagaatagaatttgagaggaaatattctttgatcaaagattgatgaaacactgttttgtttgagaaactagatttttattattcagatagtgttattagattatggaatttttgtctcagtgaagatagagttttaattcataacaataagttaggttcaaaacaacaaaaataaaatggttttctgacagaaattgactgaagattccttggcagtttaacccaaatcctaaaccttagatagatgtcatgggtaattctgatgggctttggccaaacacccaatatttgcacatatatttcaacaacctgattgtcaaatttttctttagagaaccagtacatgagactaagtcatgacatgaacattttgttgtcctctgtggagggagattctgaagcacttaaactgcagtttggatgttgctcccaaaatgggttatgaaattagggcacactcatgtatttcagtgtcttttaactgatgtaagctcctttccttagagattgaagcagttttcttacttatgtatctattacatttgccatataagcagcattttatgttttcaggtaatagttgtcattctgtctctgagtcaaggtacaaagaagactcctcccttcccaacacctgttatggtatttaaagagaaattttagttactttgcataataaatttttttcccataacaaattcattttgcttcttgcaggtatttgctaattatagtgtgttttgttccctcagcccatagttctggcatgcttatgctaggagctaaaacatcaatgctgccttcttttcttctctattactaatggtggggtaaaactaccacccacttctccttttaaatccttttcaccgaatatgacaacatttaaggctattggggatttatacctacagttttggcagcagaaccacacatgttgaagcctgaggtattatttgagtcttgggcactgtttcagagtgagagctgggaccggcttcccagcacccagggaggtctctgcaattctcagatgtgttttcagggcttacattcttatcttcctattcttcatatgtgctgcctttttttccacttggctttaatgtgtgcctctttccccattcacctatttacaaagtgtttttgtttttgtttttaagttgtgtatctatatttcattctaaaagtgaagaaaatttggttcagggaaaaaatgaagaagaagaccactgatagcttcaccactctgaactatttttagtgcttttagttatttctgtttttcccccatttattggtgaaaaaaattcagtaagcctcagagggacttaggtatctgtatttcttttctctttttttctcttttaattttttattctttttaaatcacctgccctattctgataagcatctgtatttctaataaggtttccagatgatttctatgggttgccaaaacttgagatccatttagtttaaagttagcatagtaattaatcactggttccaatcctgatcctgccatttactagttgtgggaatttgatctaaatatttcacttctctgtgccctagtttcttcatctgtgaaatgggtatgaattttatctcatagggtcgttataaagatcaagtgagttaatatacatcaaccacttacaacactgcctatcatgtagtaagagctatatatgtgcgtgacaaataaaaatagaatatataactcatagggttgatgtgaggattcagtaagaagttcttagagcagtgcaggcacaaagcaagcactcgataaatattagtaacttttatgatggtaatgacagtgacagtgcagctatatggagggctgaaatcgtgctctgagattcactgaggaagattaatgcatttctactgatgtaattcatatgtctgtatcctgtgctgtgttaagctatgcagggtcaaaagagtaaacatttgtataaatgcatttctgtatttgaatataccagggctgcccaactaaatcataatttgagttgtaattctccattatatttctgattgaaggtttgagacgctgatgttaaggtgattgccacagataattagggctgttatccttacagtagtttttttttaatcttattgctattactcttgtgtctagatttctgtccatgctagaagaagaagtatatagtcaaaactctcccatctgggatcaggattttctctcagcctcttccagaaccagccagctaggcatccaaacaggtaagtttccttttacatgaatcagagaacaaccagggaggccaacctgaagtgtaagttgcagttcactgcaacttatacttagctctatagtcaaatgagcttagctctatagtcaaatgctggctattttcaaacccaattatagtctcagtcgatggctagatacacctaggaatcaagtctcagtctgacctcttaatctatgatgtctgttttatacatcaagttaccaccaggtataatggtggatagtgagtgaaagcggcagtcttgagtctcaggatgtgaactacttccctgtggggcagggcatccttgctattgcttaaatcagccagtggcatcagttggcattttgtgaggaaggaagacagatgccttctggagtcgcagtgatcccagaaagaggatctgaattcctgcctttgacactaggaagactccatggagaggtttggcaagaaatgccaaagcagtttatatctggccatggggaaagacaggatgcaaaattttgacgtcaagagttttttgtagtgctctaggtcaatgtgtattatgggggcttgtgagtattgcctctaatgcctccagcaaagaaaaaatgatttattcttgctttaaaaacaaaattgaagtataatttatatatagtaaaatgtactctttttactgtactgtgttttgacaaacacatatacttgagtaatgaccactgccatcaaaatatagaacagtggcctccttccagacagattgccttgtacttctctatagtgcattcatagtcctacctccagctctgggaaccagtgatctgtgtttttgttcttacagttttgccttttccagaatgtcataggagtggaatcatatagtagatagctttttgagactgataactttaattcagcataatgcatttgagaggtgatttttgaaaaaggttttcatctgaacctcaagtttaggtgtaaatataactaaatccctacaaaccaaagtactagtgaatgaggaattttatttgaatcatactctttttgtttgagctcattaccaaaaacatgtcaaaaacatctttgtgtcctttttttttttctaacctgagatcgtaatttcatgtatctctggtccaaaacctgtagtgctttggggcctgtctgtgcctattacatgtttcttctacagttgagcagttagcatttagtggacatgttttctgtggttactggacatatcctttgcattgctccctctgtacctgtgctattcactttaccttggatttgatctcacctaactttcaaatggcatttcttctgcaaactcttccctaagttctcccatcccctctagcaaggactggatctcttttcttccagactttcatagagccttgaatatatcctatccatggttctcaaacatggcagcacaatggaatcacccatggaatttgaaatgcactgtatactgttttctgagtgccattccaagagagtgtgagattattgtcctggggtgtggcctggacattgggacttttaaaaagctccccaggtaattttaatatgcagcaacatttgagaatgactgtgttagacaattctcacctcatattatcctagcccctttttttctgtatgtcttttcatctcctgtgaatgcagctttttgatggtcagagacccagttttgtcacaataattgatacatttattaagtgctcagctaagatgcttccttggtatctaagccttttcacaaaccctgggaagttggaattatgatctcctttacatagttgaggaaatagaagctcagggaggagcaacaaattgcccaagatagaccttgtaagtgatggaattgggtttcacatccgtatctaattcctaaatattacactgtattaagagagccagaactctaaccactacatcacaccatcttggtgtgtgctgccaatatacagcatacacttgtggaaggaatgagtgaagaacagtttcctccctcaggcagtgggggaccaaagttattcagcaggatcaacatagttctcctgtggtgggtctgtggagaggatttctgtgtgtgaaaactccccttgacccttgtttgctcaaaattctccagtctgctcaacttccagccacattgttatctgtcatagtacaggatggagaaggaagaggttgttgcctgtgaccctatgggaattttattcgtttttctgtggctaaggttgtcaccaagttaagttggcgtgtacactttagtattacctgaagccatcagaagtgggctgtcttctcttgttctactgtaattgcaatgtgttctcttgggggaacagaagagtgtaatcatctacttaattagcatgtctgcgtatcgatgcaactgtgataaatgacattcataaggatgaacctgaaattttacaagatactcagatgtcttctgaatcaccagagctttctctttgttcagaatcactccagtatgctttgaaattcagaaggcctatatattgggagaaaaaaacatagagcctggcactttagtatattctgatttttgacaaaccactggctattcagttagaagtgctatgggttggtatctctcttgcttggtttacttattttattgccttcttggctgctgggaatgtccttgttgactgaactgtggctgtgttgaaacgtagatgaacgttctctctgacaattgtctgtactgccatgctgtgtcctgtatgtgaccagtgttattgagaatgtctgtaccccttgtcacctctcacctcatcagctaccagtcagcaacacagctagcaaagcagcatcctactttgtacaatggccttttctaaaatacaaaatagtccctttttgtttggaaatactgtcaaactcacagagttacaagaagaggacaaagaaatcctgtatattttcagtagagttacaagaaggtgacagagaaatcctgtgtattttatatgctttacctggttataaaccaattgttaacattttgccatccttgctttattattaccctttctctatcccttctttttctctttaattctctccactcttcccctaagttatttacatgtatatataaaaaaaaatttaggagaaaaaaattaaatatatataaaatatattatatagtttaaatttatatataatatactatatatttacatatgtaaatatgtaaatatatttacatttttacaaaaatatgtaaatatattatttatatataaataaataattatttatatataggtatatatattttctcctaaatttgtgtgtgtgtgtgtgtgtgtgtgtgtgtgtatgtgtgtgtatatgtatatataaaacttaggggaagagtagagagagagaaaaaaagagaaagagagctatataggccaggcgtggtggctgacacctgtaatcccagcactatgggaggcttaggtgggcggatcacctgaggtcaggagtttgagtttgagaccagcctgctcaacatggcaaaacctcatctctactaaaaatacaaaaagtagctgggagttgtggcaggcacctgtaatctcagctactcgggaggctgaggcaggagaatagcttgaaccggggaggcagaggaggttgcagtgagccaagattgcaccactgcactccagcctgggcgacaaaagcgaaactttgtctcaaaaaaaaaaaaaaaaaaaagagagagagcgaactatatatataatatatatatttatacgttatatataaatacaaatatatattatatatattttttctcctaaattagttgaaagttacaaacatcatgcccctttagtaattttgatgtctctcatgtattctctaacataaaaactatagttttctgtcagcaaatgtaacattgatatagtatagttacctaagctatatgctgtcttctgtttttgcctcttgtctcaataatgtggtttattgcaatttttccattgcatcaggaggcatatgatgttggcttgtcccatcattgttggtattaagtttgatcacatggttctggtggtggtcaccagctttctccactgcagtattaccacctttcctttttaatcaaaaaaatacttttgtggggagatattttgagactgtataaatatcttgtcttcatcaaaattatactcacaggttttagcctacacacatgaacttccccaaatcagttatcatatggtggctgccaaatagtgattttttttttttttttttactaactaccataactccgtccttatttctttgttggtgttcttgagcttttctcatctccactaatttatttatgtattcatttattattttatcaatatagactcagatatccttattctatttaatgagttatagtccctgctgtctttactattttgatgccttgtggcttatgttttaaagatgacttattttgtggcattgggcaggagtggggtggtcccatgtgcacttcgtttcttgttacctaagaaaggagtcagtcatctaacaccttcttctccttttgccggggcagttatcaatccacctcctgtggctgggacaatttcatacaattcaacctcatcttcccttgagcagccaaacgcagggagcagcagtcctgcctgcaaagcctcttctggacttgaggcaaacccaggtaagctcttaagaggggataagagagggctgtgacttgctccaggagctccattacctgaggagtgcaaaaggtagacttgaaccaagtacagattgtgcatgtccaggattttaacagctagaaataactttgtattaggcttttggctgtactggttagttattgctatcttaaaactgtaataacttattgtcatagctcactcatttggtgtgttgcctgagagttggctgatttcagctagtctcactcaatcttggctgggcttggttgcaagttacccattgattataatctctgttttgggcttggcttggctagagcacttaagctgaagcaactctgcttcacatatttctcataattttcctgggactattgggctacccggaacatgtccttcttgtgatgagagagggcaggaagaaatacacagtctcttgaagcctaggcttggaacttgtaaaccatcacttctgccacattctttttttttttccttttcttttctttttatttgagacagagtctcacactgtcaccctggctggagtgcagtggtgcgatctcagctcactgcaacctctgcctcctgggtttaagtgactctcctgcctcagtctcctgagtagctgggattacaggtgcccaccatcatgccctgctaatttttgtatttttggtggagatgggtttttgccatattggtcaggctggtctcaaactcctgacctcaggtaatctacctgtctcggcctcccaaagtgctgggattataggtgtgagccaccataccctgctgacttctgcctcattctgtcgtccaaagcaagtcacgtagttgaactcagagttgagaggtggagaagtggaaaaaggtagtctattcctttcgtaggaataactgcaaagtcacatagcaaagagtgtagataccaggagggtaaagaatttggccattaatgtaatctaccacatgggcaaaaatatctcttgagcctagaagcatttcacagttagagaatgttttgaaggttgcatttctgtccacagacttgacgtcagacaaatcttggatgtgaccaaatttttaaataaaagaagtaccatgaaagagggaaagaagaggaccttataatataagaagtgccatatatttagcatatgccaccattccctttcacttccaagggagatatcactaattcatgcagaaactctttaccagtgagcttggattcagcctcagactttttaaaaaaaatcataaacaccattagcagtctaacaagcagagggcatatcaagtacaaaccccagctacgaaataaatagttttcagcattactcttagggaatcatggaatttgaggacttattggtcagatgtctgaaaatattgttacttgtctccaaaaacaaacaacaaaaaattgtaaaaaaaagaactcgacaaaagtgatttagtaaataatatgtaatacttctggaagaatcgtctacagtcaagttactttatactgttctgctccttttcaactagagatagtgagaatgctatgtggagaatgttatattgagatagcagtgggattcacatgtgaggaaataaattagatctagacatcttaaaaattcaaaaaatttacttgtaaaaataaatacatgttatgtctggaaaaaactggaaaaaccaaacatgagaatagaaaggagaaaaaaactaccatgcaatctcatgaggaaagcggaagaaagttctctctgcctttgcatggctctcctattgtgtggaatggtgagattgcatctacttgataggctagtggtcctgctcactttgtgaggcatcattttagggcaaaaaagcattgtaaaagataaagtgtgtcattttataatagaaaattaaatccataaatttgtttattaaaaataatttatggtatatttcaaatatatagctatatatatacataatatatatgcatacatacacatatgcatgtgtgtgtgtgtgtgtgtgtgtgtgtgtgtgtgtgtgtgtgtgtgtgtgtgtgtatagccaagcccagcacagagattccaatcagtgggtagactcatgaacaagcctgccaagattgaatgagatgagctgaaatcagccacccatcaggaaacatacgaaatgaatgagctatgatagtaagttattatggtttaagactcatttggggttggtttattacatagcaataactaaccaataaagcccaaagcctaatgcaaactgatttccgtacatatatggtggggtgccggtgggggcggggtggaattaacatgactacaaggagaaataatcaaatcaaccaacggttgaggctttaaacaaacaactgagtaattcataggtcaaacagacaaaaatatcagtaaggctcttactgatatccatacaacatgatctgtaagctgaagctaatggagttatagagatcaaaatatgaaaatacacattctttccaagaagacactgcacatttacaaaagattggtcttattttaggtcataaggtaaaaatttcaatccattttgacgttttggtgtcatatggaccatgttctctgaccttgaagagactatattagagagtactaacaaacaatagctagaatcacccctttgcatttgcagatgaaggaacatgtgccttaatatttcatgtatctagttaaaaatcatcatagaaagtagaaaatattcacaatgaattgggttggcagttattgtgagctcacaatggctctctttcctgtcttcctttgtcaccccttcccctggtggtaaagatagagttgacctccatgcccatcaatgctgttagaaaattagttggcgtgtattatttgttttgtgtttagaaccacccattgtttgccttttattttgatcatcataggagaaaagaggaaaatgactgattctcatgttctggaggaggccaagaaaccccgagttatgggggatattccgatggaattaatcaacgaggttatgtctaccatcacggaccctgcagcaatgcttggaccagaggtcagcagggtaaacctgggcagccagctggtagacctcttctgctctcctggccactccagctgtcagaagtggggatgctaatgctgagagttaacatgttatgctaccctggtttgcatttaacctggtggtcagtgtggagagggcaggaacaactgatcaagaggtaattccccttgatgaatatcacatcacaggtccacttactaataatctcacagttgaaggcatcattcccagctttttatcttgaaaaatttcaagccctcataaatgttgcagaaattctgtaataaaaatccatagactctttacttagattcagcagttaacattatgccacatttgctacctctctttctctctgcgcctccccatatgctctttttctttctctccccactccccatgaaccatttggaaccatttcagaattaaaaacacatgtcataatacttcacccctaactatttttgcatgtactgtatctcataaggaagctattctcttacataaccacaatgcagtcattactcttagaaaatttagcctggttacaatattttctaatacagggttggtgaattacagcctgcaagccaaatctggtccactggctgtttttttcaaataaagttttattgaaacatattgtctgcagctgtctttgcattacaacagtaaatttgaataattgagacagggaatgtgtggcttgcaaagtatgaaatatttattatctggcttttcactgaaaagtttgctgacctctggcctaatataaaaccgtatttaaatttcccatatagccagatgatgtcagttataacctttgttgttgttgaaggatcagttagggattgtgcattgcatttaattcttatctcttcatttgtttagtctcctttaaaacaactccccagccttgttttggtcttttgcagcactgccattggtgaagagtcttggtcgctagttttgtataaggtccctctttttggatttgttgattgtttactaaggattagattcaagtaaggcatttttggtaaaaatgctgctgtcatctcattgccttgcatctgagggcatgcaaggcaatgacatttcttaagacatacctgtcttaagacatttctgacagcttccaggaaatgaagaaatggcttggagattatattacagtgttaattttcaatttgtcatgtttctttaaatatttattttatgacattgaggatacttcagagaaccagaatgttgtaatagaaaaatctcttcctaaaattgatctttccatttccttctagatgtccagtctgtgagggcttaagactatagttttttagggatttagtaacattacagattagctgagtttaggtttttttcagctataaaatggggatttgtactagtctattgcattgctacaaagaaatacctgagactgggtaatttatttttttaaaaaagagctttaattggctcacagttccacagactgtacaagaatggcatcagcatctgctcagcttctggggaggcctcagggaacttatactcatggtgcagggtgaagtgggagcaggcacatcacatggtgagagagggaacaagagagtgaggaggaggagccagacccctttaaaccaccaaatctcatatgaactaactgagcaataactcattcatcaacaaggggatggtgctaggccattcatgaggggtctgccctgatgatccaacacttcccactaggccccacctccaacattggagattgcatttcagcatgagatttggaggggtcacacattcaaactacatcaggatgcagtcacatgtttgaaaatattttggatatattaatatttagtagtgtactagagctggcttgtactggaatgcacaagaaaattgttaaattttcaggagttttgtgagctggttgttccatatgttggtagcttgaagttgactagcatggcacctggttacctggatagccagttctggactaatgagatgaagtgtcaccagttagggccttccttccttgaagagctgtttgtggagcatctacttgcaaaccactaggcagattaaataagatggggagcataagtgctggcacatggttgtgcttccagctatggttgagtgtaggtcaacagatattctctggaaagaaaactgttctttaaaaagaggtgttaagaatatatacatgaggccgggcgcggtggctcagcctgtaatcccagcactttgggaggccgaggcgggcagatcacgaggtcaggagatcgagaccatcttggctaacacggtgaaaccccgtctctactaaaaaatacaaaaaattagctgggcgccgtggcgggctccagaggctgaggcaggagaatggcatgaacccgggaggcggagcttgcagtgagctgagatagcgccactgcagtctggcctgggcgaaagagcgagactccgtctcagaaaaaaaaaaaaaaaaaaaagaatatatacatgagtgctactattgggcctgtaatgagaatttgaatctgtcatctcaagggtccttaaagctcagctggagaggattccttgaagccagaggttggcaaactataacccacaggccacattttgtctgcttactgtatttttaaataaagttttattggaacagtactgcacccattctttaacatattgtctgtggatgcttttgcattatagcagaagaaggagtagttgtgacaaacaccttatggctcacaacgtctaaaatattttctatctggcccttcacagaaaactttgctggcccctaatctacactgaatatcatccgtgtacacatataatactccaatttctcaaaatgctttacctgccttttctgtcttgtcttcataacttgtatgtgtatgtgtctctgtgtgtatgtgtgcacacatgtgtatttaggactctgaaaatccacaaatgtgtatcttattagaacaaagatgagaagcttggatgtgtcccatccccactgtcttgagagaatagctctgtgtaattttttcctgtctcttgcatctcagaccaattttctgtcagcacactcggccagggatgaggcggcaaggttggaagagcgcaggggtgtaattgaatttcacgtggttggcaattccctcaaccagaaaccaaacaagaagatcctgatgtggctggttggcctacagaacgttttctcccaccagctgccccgaatgccaaaagaatacatcacacggctcgtctttgacccgtaagtggtactttctgttccttcttccttatttcctttttaaatgaaagaggaactgcttagatagtgaaagtcagccatagtcatccaccgaatactactgcacctgtcttgctgtggatacagagcttcaccaagctgattttcatgtctgaaagtgctaagagtaattttcaacaatttacaaattttcttgttaatgatgatgaaactttatattttacgttgctgatgactctcctgtgcttcattctttatagcagtgagagaatgtaacactaagatgttctgctttcttcataatcaaaatattggttttggtatcttaactaggtgccattattgcccaggtctgtgggcaattattgggatataagacaggttaactttgaaaatccattgcttaaaaaaaaaaaacaaaaaactaggccgggcatggtggctcatgcctgtaatcccagcattttgggaggctgaggtgggaggatcacctgaggttgagagtttgtgaccagcctgaccaacatggagaaaccccgtctctactaaaaatacaaaattagccaggcctggtgacacatgcctgtaatcacggctacttgggaggctgaggcaggagaattgcttgaacccaggaggcggaggttgtggtgagccgagaccgtgccattgcactccagcctgggcaacagagcgaaactccatttcaaaaaaaaaaaaaaaaaaaacccacgaaaccctaaagaactaaacttctctaattgaatttattttaacatacatagcccagtagcctatggggactgtgatccatgcctgtgacaattcagagtgatgctttagacagagggaaggattccataatgcggaattttgcaaattgtatatgtaaattttaaattctttttcataatgtttctgtaatattttggagtaagacttaactcttcagagacacataccatgtttgtccatgacttcctgctctccctgacccctccttggcactggctgtgccagttccagagcacctctgcacatactctgttctctatttgtaaacctcaggcacttcttaggtgactggtattttgttctgatgggagtgctgatgacatcttgtgcaggcgacctagctctaaaaagttcagataaaaggatggtctagcgagataggggctacatgaaggaagtttctatagaaacttaggacatgtccctctttcttagttggttaataaggaacaccccaaaaagtatatttatataactaggataggtaaaactttgacataatcttattctttcaggaaacacaaaacccttgctttaattaaagatggccgtgttattggtggtatctgtttccgtatgttcccatctcaaggattcacagagattgtcttctgtgctgtaacctcaaatgagcaagtcaaggtaagggtaaacccaaggtcttagaagaagagcagaatgtggggcttctcactaaggcctgcagagcttgggaagatctctctgtgccatgtccagagaaggttcaaagtggagttaaggactttctgggaatagtcctctcactccaatggtctccaacctttttggcaccagggactggtttcacggaagacaatttttccacgggtcagattagggctatgattttgggatgaaactgttccagctcagatcatcaggcattagttagattctcataaggagcatgcaacctagatcccttgcacgcatagttcacaatggggtttgcactcctatgagagtctagtgccaccactgatctgacaggaggcagagctcaggcggtaatgctcacttgcctgccactcacctcgtgctgtgcagcccggtccctaacaggccacggactggtaatggtctaggggttggggacctctgtctcactgtgagtgtatgtgtatgtgtgtgaggagagtaagtggtttcacctaccaacaagtagggttgtaccaaggctttgttggactttggggcgaggtaccaggatactgtacaagttcaatatgtaactcaagtgtagtcgatagcaaatgaagggatatttgaaaaatagatctcagtgttcattgttaatttacacatacacgcaaacatgtaatcacaattagtgacactgaactactggaaaggatatggttaatgtggattagaaagatgatttaggcagcttacacttcagaaagatttcttatgaccttgtccctaagggaaaacaaggactaaggaaattctttaagggaagtcatgaaattctataagggaagtcatgtaaatttatgaataaatttcagaagttattcctgtagggtttggcatgtgttggagtgtctttttgttttgttttgtttttttttgttgctaatttatcttcccagttgtctttggcttaggtcccttcctttccaggaactgtgtccatgttttattggtattgcagttggtgtcgcagtctggcgagaataaaccagactctgaattgacagaaagagctctcatctataccttgtcctgttctactttcttgcttttaagaaaagggaaccagaaaacatgtccttagaatgttattcatttagggctgggcagtggctcacacctgtaatcctagcactttgggaggccaaggtgggtggatctcctgagatcaggagtttgagaccagcctgaccaatgtggtaaaaccctgtctctactaaaaatacaaaattagcttggtgtggtggcacatgcccgtagtcccagctgcttgggaggctgaggcaggaaaattgcttgaacccgggaggcggaggttgcagtgagccaagatcacagcactgcactccagcctgggcaatgagagcgaaactccatctcaaaaaaaaaaaaaaaaaaaaagaatgttattcatttaggattttcatgggtggactaaagattagcagctccggatgattaagatggctgctgagaaaaattattggaaggtctaaagcaatgtgtccaatagaaatataaagcagcctgcaaatatgaggttataaaagcacacatattatgtgcttttaaattttctagtagttatatgtatatatttttaaaaaagcaagtggaatccagtgagattaattttggaaatttattttacccatatatccaaagtattaatataactgcaacaggcattcaatgtcacgaagaattatggagaccttttacattacattctttgttctgtactgtcttttttttttttttttttgagacaggttcacactctgttgcccaggctggagtgcagtggtgtgatcttggctcactgcaaccaccgcctcatgggttcaagtgattctcccacctcagcctcatgcgtagctgggaactataggcacatgccaccatgcccggccaatttttgtatttttagtagagatgaggtttcgccatgttggccaggctggtcttgaactcctgacctcaggtgatctgccctccctggtctccccaagtgctgagattacaaacatgagcaaccacacccagccttatactaactctttgaaaccaagcatgtattttacatttataacacatctcaatttagacaagctgcctttcaagtgcttgataggcacgtgtggccagtggctcctgtattggacagtgctggtctaagtattttgttgactccttcagcttcaaagaagcaataccatttacagaaaccaaaagtaagtccctgaaaggaatcattctctgcattaggggcacagcctgggctattggtactttagctttcattaacagcttcactctctggtcacagtacccattttttaaaattattattattattattattattttgagacagagtcttgctcttttgctctggctggaatgcagtgatgtgatctgctcactgcaacctccgcctcctgggttcaagtgattcttatgccacagccacctgagtagccgggattacaggcgtgagccaccacgcccggcctcagcacgaattatagctgctgcaatgtatttattctcacaaagcacaagtggagctttttgtcttcgactcctagcactaagcatcaaagggcaaatgcaattcagcagtcttacattcatcattctgactggggaaggtgaagacccacatttgcttgaaactgatctctggctcattttcaaggaattctgacagtgtgtctttagatggtgctgttgctgtgtttatcattattctccgctagccaaagtgacaaatgtccagatgtttccaaatgttcaaagtttaagaacttacttaaaggaaaattttatttggcttttcttagggtgaagacctggaaaatatgcccttggtttgtaattttagaaaaagatggcataatttttattttcaaagatagctataccaaacaccttgtttggaaatgctgattaaggttgagttggacacttttagggatactaaagggaaactgaaggtatttaatacgaattggatactttgtcttattacttcccagaaaggcaattcccccccataaccatgtaattttctaaagacttgaaggaaggtggccaagcatcacaaactcagaaggaagaacaagaaaagcaatcacttcttgtaagtgacttgaaactgtagttttagaaaatgaagataatgaagattagtctttcaaaacaaaatagaatggatgagtttagtgtgtgtgtgtgtgtgtgcgtgcatgtgtgtgttttttaatggtaagaacgtgtgtgtgtgtgcatgcgtgcgtgtgtgtgtgtgttctaatggtaagaaccaatctttagtagaagtaagaatgtgagaaacagttcttcctttagtttcctggccttttttttttttttttttttgagacggagttttgctcttgttgcccaggctggagtgcaatggcgtgatctcggctcactgcaaactccgcctcctgggttctggtgattctcctgcctcagcctcccgagtagctgggattacaggtgtcagccaccatgcccggccaatttttgtatttttaacagaaatggtgtttcatcacgttggccaggctggtctcaaactcctgacctcaggtgatcgcctgcttcggcctcccaaagtgctgggattacagttgtgagccactgtgcccagccaatttcctgatctttttactgtcctgtgtcattaatgattaatgaacaacttttgagacatcacactgcccaagatatttacattttcactggcgtatagtctaagataaagattgctgagctctgccaacccagcaacactagacaacatggaagcacttcttcaatatggagtaaaactgaatgggtcccagtggctatagcatatattactgaagacagcaaattcataagcagaggttttatttttattttaattttttaattttttgagatggggttttgctctgttgcccaggctggagtgcagtggcatgatcacagctccctgcgtctgcgacctcctgtgctcaggtaatcctcctacctcagcattctgagtagttgggatcacagatgtgcaccaccatgcctggctaatttattttttgtagagatagggtctccctgtgttgcccaggctggtcttgaactcctggtctcaagagatcctccctccttggccccccaaagtgctgagattataggcgtgagccattgtgcccaaccataaacagacgttttaagtatttatttactatattaaaaatcttggctaaatggcactttaaaatctgtatatggtcattttggagaatcatgctgataaattcctgtgaattctttaaattagatttttatgtggatttattgtgctgaaaacacaagataacatatgagaatttatttgaagctcctctcctgattttggaatatcctgtaatctaaaaacaatttgggccaggcgtggtggctcacacctgtaatcccagcactttgggaggctgaggcgggcggatcacctgaggttgggagtttgagaccagcctgaccaacatggtgaaaccccatctctaccaaaaatacaaaattagctgggtgtggtggtgcatgcctgtaatcccagctactcagaggctgaggcaggagaatcacttgaacccaggaagtggaggttgcggtgagccaagattgtgctattgcacttcagcctgggcaacaagagtgaaactccatctcaaaagaaaaaaatattgaatttgatattatatacagctttaaaattatgtagctaatgtttatttaccataataggtatttaaataaacactgaagttaccagatagttagaaaatgatccttttgatggcaggtaaaaataaaggtgtacaaacaaggggaaataggtctggggttaaaatctaaataaacatttgcttataatagctttatgttgtcactgcctctctaaccaaggcagtacttaaactaccatgactgctagtcacaaatactagctagatacagaggaagttcaagttaaaagacacagccctttctcacaagcaacttggaatctggaaaagatttttggagagatggcaaatttgtggtcactgatgaaaaatatcttatgcaggttttgagaagctatttaccaaagaaccattgttgttcttgagtaaaattaattggattatggatgaagggtacaaatttatagtttctattaactccttacaagatggtgcatacaacaatctctcttgcatcgacatccgtgttaaagtgaatttcattagaagacacatttcttactaatttttagacattacttttcctgtgcacatgcaattcactccaactggccaaccatttgctttcctctagttaaaaaaatttttttagaaataatttttaattatgtaagacatatacaaatgcgttttcagataaaacaaaaatcccatttccccttcccactaccatcctgctatttttgtcagcttggtacgcatccttccaggtactttggtattgacacatatattggaacttactgaacttacaggtaagaggtgactgtgtgttttgttgttgcttttttcccatttaaataaatggaattcatattgtatgcattgcattactggaaaaaaactttacattgtcctagagacctttcagctttagtgcatatatgtgattgtttaaatttgtatttagataccttaaattaaaatgaatatttacatccttggttactcaggtactcagtagctacatgtgactaatcattaccatattggatagcatagataaagaacatttccataattgcaggaatttctattaatgctgatatatagctactttattctttttatacagtattttataatatggatgcaccataatttatgtaatcatttctctattgaagacatatttgcttatttctggtaattttctatcatcagcaatgttctgtttggaaatgtttccttagacactgagaagcagaattcctatatgaatgaatatggccggtctaaatttaaaaaattatttccagattgtcttctcagtgggtctcccagtttacatttttcaccagtggtgttggagagaatagttccccctaccattgctggcactgggtacataaactgtaaacgtatttgcacgccgtcaagtgcaatatttcattttatggtagagcgctctgatcactattgaggtcgaacatatctcttatatttactggtaatatttattcttgttctagcctttgacaaattttcttttattctatctcttttttgtattgattctatagaagatatttatgtatttttgatattaaatctttgtaatatatgttgcaactacaccccccctcacttgtcatttgtcttttgtttatggtatctttgattacttatggtgccttgaagacgttttaaaatttgaagtattctacttaataatcagtcttttacttcatgcttttgcattttattttttctttaagaagcctttttgtatccctaagttatatgcccacttttcctatatctttttataatacttttgtaaaggtttattttaccttacatttagatttctaatccatttccttctcttgttttcaatttgacaagctcttttaaggcctagcttaaacatttccttttcctctattcgtcttctctttaccaccttgattatggtctttttcactatcgttttgttttgttgtttttgttgttgttgttgtttgagacggagtctcgctctgtcgccaggctggagtgcgttggcgcgatctcagctcagatcttggctcacagcaacctccgactccctggttcatgccgttctcctgcctcagcctcccgagtagctgggattacaggcacgtgccaccacgcccagctaatttttgtatttttagtagagatggggtttcaccatgttgttcaggatggtctcgatctcctgacctcatgatccgcccacctcagcctcccaaagtgctgggattataggcgtgagccactaggattataggccaccgcgcccagcccactattgaagatacaaatatatcactctgtacaaatgctgcataacaggaatgtaatgcaggcctcaaatgcaagtcacataagtaatttcaaaattttgagtagccatatttaaaaaagtgaaaagaaacaggtgaaattaattttgacttttttttacttaatatgtctaaaattattgtcatatcaacatgtaataagtataaaatgttagtaatgagaatttttttcctagtgtgtttttatacttcaggacatttcaaactggactagtctcatatcaattgctcagtagccacatgaggctagtgtctactctgttgaatagtatacctctatacacatgtgtttatatgtttatcttccccattttactatcgtctcctcaaggagagaaatagttcatttgtgtttttatccaagttttattcaaactctcagtgttcagtattgtgatatgtttgggaaaagttaaaagctaaaatgtctttgggtgacatcaatggaagaataatttgcagaagagggagatgatgatactgttctgtttactagacataccgtccccttattattatgcttggtcctaggatccatgctttagaaaggcattgttatattagaaaaaactccgaaaaaagtgattagtggccgggcgcggtggctcacgcctgtaatcccagcactttgggaggccgagacgggcagatcacaaggtcaggagatcgagactatcctggctaacacagtgaaaccccgtctctactaaaaatacaaaaaattagccaggtgtggtggcgggcacctgtagtcccagttattcgggaggctgaggcaggagaatggtattaacctgggaggcagagcttgcagtgacccgagatcgtgccactgcactccagcctgggtgacagagcaagactccatctcaaaaaaaaaaaataaaaaccaaagtgattagtttgataaggtgtcattcagtcatgccatatgaggaatgactatagccttgatggtgcttggcttgggactgggaaagtacggatgggcatgtgtgagagagcataatcttcaaaggcttgaagggctgttaaaagcaggaatgagtctttgtaactctaggagtagaactaaggtcaataagtagaaataacaatgaccagatcttgggtgaacgttaggaaggaattcccaactatatgatgcctgaaaatgaattggtctatctcaccaccaaggaattggcctacgttggcggtgttctagcagattgccttttcatgatagatggcaaaagacctctagcctcatatggattagggggttagatagaatgacttccaaagatccttctgaccttgaggtactgtgattccatgagatcatacctgggaatatatttgagttctttagaaaaatgtgccaccaaattgcagaaaatttatgtgaagatatttgggtctggacacttggatttacttttatctctctttatgaggttccaaaacaatcacattagatttacacgttttctgtaagctttgtcactgaaaaaacttgatattataaaaatatttcaatgactgagtttattcaacattgttgactacctttagttactttctaatgtcttctggctgattcagagattctgggcttctcagaccttacttggaaaggtctgataagaccaaatttaaaatgctatgtatgtgatgattcagttctttagaagggttgccagtttgtggtgtacagtaaacacttggattactaaatattctagtgaagattagcacttttcatttgcatcttttttttttcttctgagattctcaaataccttaaagataagcagaaattcataatctacattcattctgaaaacttttatattactattcagcaagtgatctttaagattgagctaggaacttgtggccctggtgtgttattttcaaataactagaaacttacattttcaaatgatgatttttatctttgaagcaaggattttgattttgttttggttttatagcttattttcaaagttaagaaacgcaagaaagggtgttaatatatttcattcaggaaaggtcctggttggtaaaatatgtaaaagtacaaacttctgaattcaccatcatttcctgatggatttgtaaaaatttttctccccagtctaatgtatttgtttgtatactaacttccacacagggctatggaacacacctgatgaatcatttgaaagaatatcacataaagcatgacatcctgaacttcctcacatatgcagatgaatatgcaattggatactttaagaaacaggttggtttctcaccacgcaacactgttttgtcactccttttcttaatatgttctcaggtagcgttcttccaaataagtttctcccccagtgttttctacttataagaacaggcatttgttttacaagccttatgtcaaaaataagcttcagcctggattagagagtgtcactagcacatagtaagtattgaataactatttgttgagagaatgaatgaatgtcacctgtcagtgaggtataatattgcatcctaacattctaaaatatggtttctaataagaaattcccagtcctggaatttggtgggtagcattctctgtgaatgagaaaaacagattcagtttctggaaggcctccatttatgacagcagaaaggaaatcctggagtttataaaaacctgcaaacagtcctgattctacagcacatagtgggctaggagcttggctgtcatctttgcagttccttcctttctccgttcctcccttccttttttttttttgagacagggtctcactttggtgcctaggctgagactgcagtggtgcaatctcagttcactgcagccttgacctcctgggctcaggtgattctcccacctcagcctcccaagtagctgtgactacacccagctaattttttgtatttttagtagagacagggttttgtcgtgttacccaggctggtctcgagctcctggactcaagcaatccacccacctcggcctccctaagtgctgggattataggcgtgagccacctcaccaggcctctgtcctagcagtttcttatcagaagttttcagctcaggccaggtgcagtggcttatgcctgtaatcctagtactttgggaggccagggcaggaggattgctgtgctcaggagtttgaaacagcctgggcaacatagtgagaacttgtctctctttaaataagtcttaaaataagttttcagctcagctttttgaggactattctttgactgcatattatttttaatagtgatttataattcctaaacattttcatttacttttctgactataaaagtaatgtgtaatcattgtagaaaatgtaataaagcaaaagaaggaaagaaaaatggcttgtaattctgtcaccccaagaaatttactgttaatgctttgatttttttattttaaaattttttctgttatttttcctctcagctcatacctatgctgttaatgctttgacataaatctttttagtattttttctgtgtgtatataaacataaaagttggttcatactgtgtatataataattttggtggtttcctaggattttgttgtagaaatagaaaatatttaaccaatacatttttgactattggtgtttcttgtaggtaatgtgcatgtgtatgggtgtgtgtttgtgtacatgttttgccctcattgatggtaatttgcttagaataaatcaaggtttttgtaatgtgttgctaaatattttaaaaatttccatttttgtcagcagtgtataagggggtcaggaaaggagttggtaactgaaaaaaaatttaccacttttccagataataaattgtgtatgtttgaatttatttatgtgaagtttgatttatttttccatgtttatcaattctttgtatttgttccttttttggattgctaattcattttcttttgtccctttttctataaaaatgtttagttgtacattgatttgtgagaactattagtatataactatattaaccttggataatatttgtttcaacattgcttatggctttttctttaaatcttcagaatgttaaagatgttattacataaaatctattgacttgttttggtttggattttgtttgtttgtttgttttgagacagggtcttacactgtcaccaaggctggagtgctgtggcatgatcatagctcactgcagcctcaacctcctgggctcaggcgatcctcctgcctcagctacctgtgtaattgtgacctcaggtgcatgccaccatgcccagcaattttttttttttaatcatttgtagagatggtgaggggttgggagagaatcttgctatgttgcctgggctggtcttgaactcttggactcaagtgatcctcctgcctcagtctcccaaagtgctgagattataggcatgagccactgcacccagccagacttctttttttttttaaaaatgtgttcttatgtaattagaaagctttttgtgctctgaagacagataaataatctcctatttattatcttctcattgtttgagatgcattttaacttttatggtaaaactcactgagaacttaattggattgtttcactgaggtcttgagcatcagctttcctcagctgtaactgtagtgcaaagcataagatctcagctatggttcttaaatgacttgtctgtagtcctctttgaggatgatggcaataattacttggaaaataagtttttgttgaaagatgaggcagtgaactgctggcgatggtgctgaagttcaagaaattttctgcaaataactgaaatagatacttaaggcaaattatgtttatattataaatatattatttataattttgaatatatactctgaagcagtctgttattatggcttaaagtgtgtaaatgagtatattccaaagcattaatgtcattgaaacaaccacacattgtgactgtctggaatttttttgcctgcaaagaaaggatttcatttcctcagaaacattaagtttctaatcactttatttttttgaccatcttttctttgataatttagatcaatgttagttattgatttgctgagaatcctggggaccccctcaccacttttggagaaatttgcaacggtcatatttaattatgtaattcagtacaaaattaaacctaatttttacttaacacctgtttctgttttaaactttttaatatttcttgcattttattagggccatttaaaaaatgttgtcttgcttcctatttacacagttagatttctggtgtttttgaacttcatgggtggttttaagctaatcctcttcagaatagtacaatgagaacttcaaagaagcttgtcttgattcctcacacagtgcctggaacatagttagcactcagtagatatttggtgtatggtgttcatatgaatgaatttacttgcttttcagggtttctccaaagaaattaaaatacctaaaaccaaatatgttggctatatcaaggattatgaaggagccactttaatgggatgtgagctaaatccacggatcccgtacacagaattttctgtcatcattaaaaagcagaaggaggtaagcaggtggttgactcccttaccttctgtacaggccagtcttagctggggtgggttgcatttccttgggtgctgcgtgtatgtgtttactggatagcaaactctcggtttgctgtgggttatctagatttcttctctctctcttttttgacacagagtctctctgtcacctagactggagtgcagtggcactatctcactgtaacctctgcctcctgggcccaagcaatcctcgtacctcagcctcccgagtagctaagattacaggtgtgtgctaccatgcccagccaatttttcttatttttagtggagacagcgtttcaccatgttggccaggctggtctcgaactcctgacctcaagtgatccacctgcctcggcctcccaaattgttgggattacaggtgtgagccatcgctcctggccatagatttctttaaaggtatccttgatctgtttcctttctcggttaccatttctacaagagtcattactttttaaatttgtgtaaaatacaaaatatgtaaaatatggtgacatattttaacttcaccttcaagccattttgcattctggcctcaattattgttcccactcttatctctttactttcatctccaaatactccaagtgcatctatttactattctccaaagtgtctttgtccattagccaccccgttcactcagcacacacataaatcaaaccgtttcagggtgtgttccagttcctcttctgaacttctctagcaccagtttgatccacctatttgaatttcagttattcatcttacatagacatttaccttactgtatattaatctctgcttttacttggcaagttctgaaggcttatccttctaggtattaagtgatttgttatctggtattgaggtgactttttttatgcatatgaatgaaaagagaagcagtaaaagggaaaggttgacagagttgaatacataataatttcaaattttctaaggcagaaaaaaaaaacactcatgatgaaaagaacagaactggggagtacacaaaggccatttattgaaagaaagaactttgtgtgttaagtccaggatcacctcctggctgctcccagttgggtggagtttgcagctgtgtcatcccacgtcaattccacttgatacttctgttattcgtttagtgcacttttctctaacaaatagcttaggaggacatctgtcttatacccatctttgttttctggtttctactaacctccttaatcccagttcttagttttttgttaggcattatctacctaacagccctaaagctttttacacagtgtctggtgcatagtagttactcattaagtatttttcttttacttaaagtggctcagtcttgttcttgtgtttcctggggaagtgagcaaaggcttttttttttttttggaaaatacaaacaacttttgttgctttttgttcaaagatgtcagcctaagagagaattccaagtaggcacttggaagagttaataaagcacagcgggctcctctctctccctgtctctctgaagagctggctttcctcattgttctctctggagcttaatgagcaggtctggattcagcagcacatcgttccgcattagaggctgctggccaactaaagccatcaccccgctgtcagctgctctttcctcattcctcctcccagcagcactaattcatccccacggtgttagctgagagcaggattcccttggcagagtctgcaaattcacattgtacatgatctgttggcccttcaaacctacaggggaacgccagaagcgcagagctattttagatggctaacaaagcagtcaactttttagaagccaaggctccctccccattcttttttctcctctcctccccctctgcctccagccttccctcacacattccgttgaatgggtgatggaggtttggagatcttaacctagtttttaaaaaagctatctgaagtcacttcaataaaaatatatttggattcatgtagtatttttttccacagaattcagttgattttttataagtattatttgttccaactgtgaaaaacccctcaaggaaggtagggattcatggtggcagcaaagaaacagtgaatattctgaggcatttcctagcccctaaaagtatacaggagcagaataagttgtagttgtcattagtagagagagagagagaaaactagtatagttggacaggtggaccaagagtggagagttaagtgctactttgtgagtgttgactccaagggaaaggtaggatctgtaggggcctcatgtcacctgacagggctttgtgggacatttgttttgaactgggcagcctggtgatgaaatctgcattagcagaggctcagagtccaatggaaacagatttgtgggcacatgaacaggtaggaccattgttatgtcggtgatgaaggcactatttgagaaagcgcgaataggctatgagcaagcataattgggtatctatgtgcctgtgtgtgtgtgtgtgtgtacgtacatatacctatgtacatgtatgtgtggataggctgggtggtgggtggggggataagttcttaaatcttaatctacatgtgacaatacaaggaattggggttggagaagccaaagtaaggatggggagactcaatgcaatttttttataaggagacatgcaaagactgggtgatgtattggagatggggaactactccactgaaattttctgctttgggagaccctaaaactgacagcagtagatcataggactgagctgtggacttcaggagaagaagatgaggacatactttcatttggaaggcattgattttatcgtcatggtagggagttgaagatattttctagggaggtgaagttaatacactagaacacaatgaaaatatctcctttctgagatgcaagtcaaaaccacaatgtgatactatctcacaccagtcagaatggctattattaagaagttaaaaaaataacagatgttggcaaagctgtggagaaaagggaatgcttatacactcttggtgggaatgcaaattagttcagcccctgtggaaagccgtttggagatttctcaaagaattaaaaatagaattaccattccacacagcaatcctattactgagcatatacccgaaggaaaataaattgttcttacaaaaagatacatgtgcttttatgttcattgcagcgctattcacaataacaaagacatgaaatcaattcaggtgcccatcaaaggtagattggataaagaaaatgtagtacatatacaccatggaatattatgcagccataaaaaagaacaaaatcatgtcctttgcaacagtgtgggtttagctggggccattatcctaagcagattaacacaggaacagaaaacaaaatactgcatgttttctgttataagtgggagctgaacattggggatatatgctcacaaagatgggaacagtagacactggagtttccaaaagaggcaagagagggagaggagtaagggttgaaaaactacctgtcaggtactgtgctcactacttgggcagtgagatcattagaagcccaaacctcagcatcacacagtatacccataataccccctgtatctaaaatgaaaacaataaattaaaaaagatctcttctccatactgattactagaggtacagagagcttaggacgcctcccattcccattaacagtcacttctcaggagcccacaatctttaaggtgctacatgaggtgagtggaagccatctgtaggtcattgcatttgagagtcccttggtgaagagaaggaaactttcaaattgaaacagtcttcagcatattctctgaaggtgtcgatttaagagattgcccttgggattcttttttttttttttttttttttttttttttgagacagcgtctcactctgtcacccaggctggagtgcagtggcatgatcttggctcactgcaagctctgcctcctgggttcgcaccattctccttcctcagcctcccgagtagctgggactacaggcacccgccaccatgcccagctaattttttgtaatttttagtagagaaggggtttcactgtgttagccaggatggtctcgatctcctgacctcgtgatctgcccacctcggcctcccaaagtgctgggattacaggcgtgagccaccaagcccagccaggtttcttttttcttttttttttttaagatttggacttataataaataaatggacttaaaataaataaatggaaagcacccatctagatcagccttgtcaaaagtagcagtcactagccacatgtggctactgaggacttgatatgtggttagtcaaaattaaggcatgctgtaagtataaaatcctctgattttcatttctttctttttctttttttttttttaagaggaagtctcgctctgtcacccagactggagtgcaatggcacaaccttggttcactgcaacctccacctcccaggttcaagcaattctcctgtcccagcctcctgtgtaactgggattacaggcgtgcactaccatgcccagcccattttttgtatttttagtagaaatggggtttcaccgtgttggccaggctggtctcgagctcctcacctcaagtgatccacccacctcggcctcccaaagtgctgggattacaggtgtgagccactgcacctggccaatcctctgattttcaagagttcatatgaataaagcaatgtaaaatatcttacacttttttccaattgtatgttacaatgacattttagatataatgggttaaatgaaatacattattaaaatcaatttcacctgtttctttttgccttttaaaaatgcggctagtagaaaaatttaaattacatgcgtggcttgtattatgtctctattggacagcactgatctagatttactaggaatatacttttactagtcccattcattttatgaagttatttgtttaactgttaggattacatattcatgctgcagtatttaccagctatatgtttgaaatcaatcaggaagtagatttttttgttttcctttgtgaatgcaattagtgatttctattgttttgtttcgtttttccaaaatttcgttatgatatgtttaatttccggatgggatttttttaggttttttttttttttttttttttttattaaagggataacctcactgtcttggaagtagttacctcagcatattaataattattttacaaaacaaacaaaacatctctcaaaatttctcagtcagtgtgatggctcatgtcatggttgtgttgctttaatagatgatactttaaattgcattattcttttctttcttctcatgacagcctactattatagagctgcttttttgatgcagccagaataggttggaggtccagccttgaaaaatttaaatagtaaagctttaactactgtaggcttttgggactttctggggcccgtttacctgcttctctagtccgaagggaacagttcctagttatgggaagtgaagaggttctgtcacttgactgagtagtgaatgctcagggctgctttcctgtaattctggcagagcctcctcagagaagcagggcaaaataattggctcttatgctacagatgacaagtgggccctaggggctgtgtgttttctcaatattggcttttctggatgtcagggacaagtaactcaaagatgtttttgtgaatgtcactaaatagacatggtataatataatctgttcatttcttacttgttaaatagcattcacccctttctcccatcttatttcataaaaaagactgttttgttaggaaaacatttcattaggttgactgacttgaactgtatccatagacttctttccctaaacacatttccttcctgtgctttacagataattaaaaaactgattgaaagaaaacaggcacaaattcgaaaagtttaccctggactttcatgttttaaagatggagttcgacagattcctatagaaagcattcctggaattagtacgtatagaccttcttttaaaagcgaaattttttagtaatgccgtggtttgtgtttgaaacaatttccagaatgcagtaacttcgaaagctttattgccctgcccgtctctgtgttatctctagtcttttaagaaggcagcaaatgttacccttttatgtcttccctaccacccaatacaaacaaaccaaagggagcttagatgcccccttgtaatagctgttaatatccaccacttattaagagtctgccatttgtagcacagtgcgaattattacacatatgcaaccttgaaagcagggaatcctattttataaatggggaaatcgagttccaaagcagttagatcatttactgttaaagggcacatagccagtaacggtcagaattagaagcagcccagttctgatggccgaacaccttactgtttgcaccatgtctcattgccaccatggttgcagcctccaagatctgtgcttgactagtctccccaaacttctaaaaaatactatttgttatgtgtggtggaaatcatataccttgtttcatattccctattttacagtagttttcctaagggttcttgtctgtatgttagagttgagttgtgttgggttaaaccataccaaatagttgtttttataggtcaaaagccattgaatatcatttggcaattttgttcagttcaaatccaggttctttttagtatatttaagctttaataaacaaaatcaaacaagcaaaaattttccagaaaaaataagatgttatttggacaagatatatcactttattacatgtgccctctggcagatcttacttttatgctaaatccagaaattctacttccatgtattatctctattaatgacataatagcaaccatatcattgaatgcctacttgtgccacgcatttatctgtttttgtttttttttttgtacattaactactctcaacagggataaaaccacctaatttttagggttctgttttatagattgataaactgagaggcaacttactcttatttagggtgagttaccttttaaggaaagaacaggaaatcacatccagatctgtcagactccaggctgttttctatctgctacactaaactttcttgcattacaagcagggccttagccaaatagaacagagaccaggacagagtttgttctgacctaaaataacagcttaactcttttacagggtgatcagcccaaaatttgactttcagtttaaaaaatacacaggcccacagtactgtacatatttattttttatgctctccactgaaaggttggtgttcctgctttaaaacactaacatatggggcagcgttgttagtcttggaaatgttttatattgttagtggtataaggaagtaactaattgccattaatttcagtcgtctctcagaagtagacttttattgtcatgcctataatttcttgtttttgataagtattaactatgttattctcttgaccaaaagcacttctcattcagtgtttcactttgttgacgtataggagagacaggctggaaaccgagtggaaaagagaaaaggtaagtatgacgggcaagaggatgttaatggaagtgatttttttttttccccaccaagcaacttaaagaaaaacggcaaactaattgtaatcactaacacaacagttggtgggttttgagtttcctaaaacattctggaatggttccaatttcaggtttttgtaagaatgagctgaatagtaatcagctggcaatagggtaaaactctaatcattgctccttgtttccctttttcctttcaagtaaagagcccagagaccctgaccagctttacagcacgctcaagagcatcctccagcaggtgaaggtgggtgtcctctttattcacctcatgcaaatattttgaaatgatttcccacatggaatttccatattagataccttacttttttctttacccaagagccatcaaagcgcttggcccttcatggaacctgtgaagagaacagaagctccaggatattatgaagttataaggttccccatgggtaataccattaacattttctaagtatagatttaaaactctggatggcggtgtgggggacaaatggttgctgaggttgatttgtactcctctgcttagggtaggaagtgtatgacgggtggtgggattccatgcaccgtggcgggtcagtgatggcagagaagtgggtggctgtgttcattagagacattctgcagctgtcgtttagagcccacatgagcttaacgacactagacgcagaaaatccacggtaactgcagacagcactagatttgaaagctggcactttagatataactttgcttatattctaactctttggtgcaaatagaaaaacatcagcttatcctcttgatatgctttgcgtctgtcgtaaataggtattcctttgaataattattcaggataataatgaaagaagttagattaaactacttgactgctgtactttcagagggagaaattctacttaccacaattcttgattttccatgcccttgatgggtactgttaatgtcactgtatatactctttattttacgctttgtctcatatccaaaatcaaacaaaaaaggatgtcttcagaaatgtagaattgtgcagtttggtgctgtgcccacaccactctaaaattaatgattaattgaatcatttgaggtcgctcaaattaaactaatttggcattgtgtgggtgacaaccagttgaaatgttttctttttatcagctatgtggccatatttttggagagagccagagtcttctgtctcttttctacctgtaatctattccaggtgctaagaactgtgaaagtccagcttgggtaatgtagtgagaccctgtctctacaaaaagtaaaaaattagccaggtgcagtggcacacgcctgaggccccagctacttgggaggctgaggttggaggatcacttgagcctgggagtttgaggctgtagtgagctgtgattgcaccactgcacttcagcctgggcactggagggagaccgtatctcaaaaaaaaaaaaaaaaaaaaaaaaattgtggaagtgttaaaaatgtgaaaaggaagagtgaaagggacgcattagctccttgaaaactgagttatttacaggtgttttctatagcatttaaatgtttcacatgaatattttatatatttgtagtaatgatttcagtagcctacaccctttaaagtgaacacacatctatatgcttttctttctctcttctctctgacttaccactatttatttcagtacaagaaaataaagggtatggttgactcagtctagaattctgaatggaaggctgatttgggaatcaatattgtccactatgtgcaaaatatgttaaaactctttgtgtccatttccaaccataaattaactgatttttgcatcctcttcctctggaccatctcagcttcttttgggaaacccccatgggaagctgtgtgactttggggccctttcagcccctgtgcacatgcactctgatgacgtgcagcgataggtctagcagatctcgtcgatcatagcctacttgcagcctgctttctgaaagtgttttgcttggtcccacccgtgaaggttgtgaacttctccagttggataccacctgtatgcatagctgagtctcacaaggggggaaactgacctaattgagcaaggccagtgatgggctgaaatgtgtgctggacaaagttaaagctataaatggtgttcttcagtagggcagtattttttttcttggtattgttcagatgctgagtaaaatatttagtcttgtccccaagattatcttgtatttgaagacaagattgacaaatcagtaattttacattttcccacgatttccttatttgatttttctaataacattacttttctttccccatattctgaaaaactgtttctctcatatggatgggatctaacctgttttacttagggagtcacacactggacatcagctgtatagtctggcccaagcatgacttcttgttacccatggatggctaggcagggttttgctgcttacccagaattcccaagttaaggggaaaggacatgaaaactgaataatttaatggtgtctctatatttggtaccaccaatatttagtcaccttttttaacccacctcattttgtcaattgaaaaaactctacgaaggccagaggaagaagaatgctatctatagctttagaatagaaaggaagtattcagaattggttatagttattcagaaaagtccagacaccgccataattcttgctttgtttctgctgcattttaggctctctccatcttttcttacccatctcctaaaaaagttcgaaaagcttttggacaaacttctttgtgtcgtgtcatccttttactccccctccccctttttggggggtacatgtttcttccttttaaaacattatacatattatattgggcagcatatcttaagtggtagacatttaggtggaaaagtgaaaggaatgtaaacatctacttttacttagggccaatttcattgtttttttcttctttaaatgagagaacattttgatctgttcagtcacacttggatgggacatttagtgtgagatttgatgagtctttgtgtttcttagcgcttttagatttttatctctctccaaactgttttagagaagaaagaaaagttgaaagttgaatttacagatgtgatgacatacactctaaccaagataggctttattcaagagataggcagaagcagcttttttccatttcttctttgatgcttttgtggtggatttaggatattgatgcaaatgaattccttcccatttggggatattgtacgtacatttacttaccttattaaatgatgatcccaatgtatttggttataggtttctttccccctggaaattttataacatacttataatttgggatattggtagtcagaagtggggttttttttttcccatttgacttatttttccacacatagttaatacaattatagcttttaacaataaagccagacttcaagacaaccagggaaccataaatagacaaatgttagcgtctattctaatctgcatagaattccttaaattagtcctgacagtgaggattgaagaaaccctactttagttttatcagtttagatggagtactgttttcacctgtaaaatactacaatttaaagcaagtagctatattgggaaatattctttgcaatagtctcacaaggcttacttgctttagaaaatagattattaaatgaagtttgttattcttatttcattgatggagcttgaagcaaattcatttgaatcattttacatgcaagggcactggtgtgttcacagatgtatttattatcagtttctctatatgacaccaaaacaactgtgagtttagtgaaacaaatgcagtctgattgttttaagtaattaaatgattgaatacaaacgttccacctgctctactccatatagatagagcctcttctgtataattctgactgaatagctaacagtagtcagttcatcatacttattgttgctaatctacttagcttccttgtgctgaataggggattgaaccagatgactaataatggtccctttaatgctaaaatggctgtgattttacatttttaaaaaacccacaaaagaatgaacttaagatttaagaactgttttccttggtcataagaatttctcttaaataaaagcattgggatgataaaaatgtaatcaaaccaacaacatagattcctttcccagtcccagttttgtcagctggtgtttaaagggagtcaaagattgctaatatttttttttcctgtgcagatctgaaaaccatgagtgaacgcctcaagaataggtactacgtgtctaagaaattattcatggcagacttacagcgagtctttaccaattgcaaagagtacaacccccctgagagtgaatactacaaatgtgccaatatcctggagaaattcttcttcagtaaaattaaggaagctggattaattgacaagtgattttttttcccctctgcttcttagaaactcaccaagcagtgtgcctaaagcaaggtggtttagttttttacaaagaattggacatgatgtattgaagagacttgtaaatgtaataattagcacttttgaaaaaacaaaaaacctccttttagcttttcagatatgtatttaaattgaagtcataggacatttttattttatggaatagattttaatctatttactactattaaggtaaattttctatggcatgtccattagctatttcatgatagatgattaggggtttcctcaaaacctgtgtgtgaggaaattgcacacagtagcaaaatttggggaaatccataacattttcagaccatgaatgaatgtttccatttttttctaatggaatgtgagagtttacttttattttattctgaaggactttaaggaagggatacatgattttaaaaaagcctgtaagaggtgaaatatgtgatgtttgaagtctctttatagactttttatatatattttttaaaacactcatctagatgaggtgctttgagcagttctgaaaaatgcagttccaggaaagcaactgctttggttcctaaggaagaaattctaaataatgcaaacttttaaaataagcatctaggtttttgataattctgtctacttacaacaaacttgttagtacataaccactattttaataattattttctctacacaaatgtgtaatatcatatttgactttgcttatgcaggccataagttccaaaagataatttccctgcccacaaaggcataaacttgaaaacacatgagattgaatcaacatgctttaataggaaaagatgtatggtctatatatgtatcaatctggtgaatcctcgttctaataaaggttctttttcttttctatgatacacacagccacgctgataatatgcaaatgaacattttcctttatgtctctccagataatgtttattgtctgaggtaaattaaattcccaccagggtttgctgtcagtattttaacacccacattagtatatgcgtccagggtcataaccccctaaaatccatcatgcaaccttattaatctgtcttgggattccagtttagtgcttggatttatttcctgattacactacatagaaaagtgagacatctgccattcccaactctgggaaaaccaactaatatacaaccatataaatgaaggccatcttgatggtctcaacactaatttttatgatgcaaatttatacactgatttttgtaaaggacaaagttttaaaagcgtatttaacttgatgttttctatcagcataaataaaatggtcatgaatagtcattaaaaacagttgccagtgataatctgcatgaaggaaaaagaaccctgcaaatggctattgagttggaagtattgtttttgatatgtaagagatattcagaatgctcacactgaaaatgcctcaactttttaaagtgtaagaaaccaccatgagtggtgtctagatttctaatgaagaatcatgatacagtttggattaagtatcttggactggttttaaacagtgctttgtaccggatctgctgaagcatctgtccagctggtatcctgtgaaagtttgttattttctgagtagacattcttatagagtattgtctttaaaatcagattgtctcttctatattgaaagcatttttatgttttctaatttaaaaattaatattttcttatagatattgtgcaataaagctgaagtagaatgtgtggtttttgcaaatgctttaacagctgataaaaattttacatttgtaaaattaatatattgtactggtacaaaatagttttaaattatattttaaaaagcttccaatcttgtggtgtgttttattcattcagtaggctgaggttaacagaacaaattatgatctggttgatgaccatcaattgaatccttaaaccttagatcttaagcattctgttgcatttgggggaggtttcataaaaaatccataggtcatcagtaagagattttcaggagagacacttactctgtcttttgagttatccactgcatcttacccactcacccgctaaacaataacaaaaaagattcattgaaagaagagtgttgttggtttagaaattaaaagatttttgtttttatactttgcatctgtgaaatatatatgatgagagaaaaatacagccgatttttaaacatctcccatatgagcttctaatgtgattcaaaatgatgtctgtaggaaagaatactatatccttttggggtttgagaggacccaaccaagagaacccctcttccctactgaaatctaaaccaactgagaagttaaaaaaaaaaaaaaaaggcatatgatggccaaagtattacctttaatactagtaaaatggatattggagaatgtggcttccttttatctgtggaaaatgagctttctaaggctgaaacccagaatgtgattgaccagctgctctgtaccactgttctgtaccccagaatgtattgacaagctgctccgtcccagactaatggggcagggactttcccattaagcttagtgcaggccaagagcagtggtgccctctcaaggcaggccgatgctgaagaggcccaggtgacagcgggatatgtcaacctgtgtccataatctatggtaagtatgttcttacttaactccttaattaggcaagtccctcccaggggaagaatgaatgaggagacagaaggaagccaggagatgacgtatgtcctctttcaaggaagaaaacttctgtaatggagaataagtctacttcaatcaataattaaaaattggtcatatttattagaagcaaatggtgagagggagactttgaggttttcattttacctggacgaacaatttatattttcagaaactaagaagtagaaacaagatcagactgaggtactgtggaccagttaattatttgtcacccctttaagctaatattctttagactaaccctcagtgtttatttaaaaggattctaagtgccgcacaaggaagggtaactggtggcagctcttgtcgttagagctattctgctctatcccttaactagcattctcctcttagcaaagtgaaaatgccaaagaaaagcaatcagctattctggaatatcaaaggtcagaaatggttgcaagttcttacttaagaggtagtaattaggttgatacttttttcatctgttgaaatataggtttacaattcttgaccattcagacattttttcctggcagaaaaaaggtatctgtgtagggggtagtggagggtggacagggaaggtggtggcagggactgaaatagatggttctgagtcttaaagctgctggtattaaagtggtatttactttctcctttgggtgtatcagtgctatcaataagtgatgatgaagattgacaggatgaaaacaatgttactaatgtctcaggtaaagagctgaaaatgaatttaaagagacaaaaagagcaaatgaaagatttccaggtatactctggaggaagagcttcaacaaagtaaaaaaaagatgctataaggaagtgaggaaacaaccataagcattatgaaaggtcctcttttaatgtattttatgtatatatttatgtatttatatataaatatgtaaattcatatatatataaatacataaatatacaaatatatatatttatatatttatttatgggaacatctttacttgtggaaaaaggaagctaacaatgacaaagctagagattttctttgggtttattaaaaagcagtattatttcaacaaagcagagaaaaattaaaagtcaagcttcctgctccctcttcttattgggaa

SEQ ID NO: 14767 - DNA, 13018 bp, Human
  misc_feature (1)...(13018): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggccctgagctggggagacccccacggggtagggcgtgggggccacgggcccacctcctccccatctcctctgtctccctgtctctgtctctctctccctcccccaccctctccccagtcctaccccctcctcacccctcctcccccagcactgcctctgtcactctcgcccacgtggatgtggaggaagagggggcgggagcaaggggcgggcacccttcccttcaacctgacctgggacagtttcccttccgctcacctccgcctgagcagtggagaaggcggcactctggtggggctgctccaggcatgcagatcccacaggcgccctggccagtcgtctgggcggtgctacaactgggctggcggccaggatggttcttaggtaggtggggtcggcggtcaggtgtcccagagccaggggtctggagggaccttccaccctcagtccctggcaggtcggggggtgctgaggcgggcctggccctggcagcccaggggtcccggagcgaggggtctggagggacctttcactctcagtccctggcaggtcggggggtgctgtggcaggcccagccttggcccccagctctgccccttaccctgagctgtgtggctttgggcagctcgaactcctgggttcctctctgggccccaactcctcccctggcccaagtcccctctttgctcctgggcaggcaggacctctgtcccctctcagccggtccttggggctgcgtgtttctgtagaatgacgggtcaggctggccagaaccccaaaccttggccgtggggagtctgcgtggcggctctgccttgcccaggcatccttggtcctcactcgagttttcctaaggatgggatgagccccatgtgggactaaccttggctttacgacgtcaaagtttagatgagctggtgatatttttctcattatatccaaagtgtacctgttcgagtgaggacagttcttctgtctccaggatccctcctgggtggggattgtgcccgcctgggtctctgcccagattccagggctctccccgagccctgttcagaccatccgtgggggaggccttggcctcactctcccggatcgaggagagagggagcctcttcctgggctgcccgtgaccctgggccctctgtgtacactgtgaccacagcccgctcctggaccctctgtgcccggctggccctctgtgcccagccagcctgcacctggggatgccaaggcctggggagggtggtttcacccaggccaagcctaagacagtccctctgggccctgctgggtaccggggtgtgacaccactgggaggacaagatgaggggcacccctggggccgccctgacaccccctcgaggctcctgccccgggggtcctggtgccccttcactgtggcaggcgactgggggttccccacctcggcccctctcccggggcctgctccccggcacctgaggcagcatccttgtcagggccgtgccttcctgcctcagcgccacctcttaaggttggcccgtgggtcactcaggactcagaactggagattctgggcaaaaggcaaagagcaaagggccaaaaggcatcccagggagacgactgcgggggaaccagagggcagaggggcgctcgtcacaggggagggggagctgagggaggcaggaggggagccgagcctctccccccgtgtcccggctcttcaggcacgccctcgggacgccaccctccccgacccaggcgggaaagataagagcaaggtgtccgcagcctgacactcgtgcctcaggtgcccgcgcttgtgccggacaagactctcacaggtggcatgcctcggtttccccactggtaacagcacagggcactcagcaaggcgcagtgggcatgactggggtcctgtgggtcctgacccagatgtggccaccccggccgcagtggtcttcattccaggatgcctcttttccctcctgatctattcactgcgttcgccattcggtcattcccggggccaccactcccacctcaggtgtgtgcttcccttgtgttttatgagatatccccaacccggctgcttattggccccgtccgagggcaggagcataaataagagcctctgctttggcgtgggaccactgtgagctccagtcagcgctgccactgctgagctctgggccttcgacaggacttggccccttactgacttctccgtgtgctttgggtcatgggtgaggacgcctcctggcaaggctgcgtcctgaggattaaatcgggtcatctgtgaaaactacccagcccagcccctgacacttttttgtttgtttcttttagtgacagggtcttgctctgtcacccaggctggagtgcagtggtgtgatctcggctcactcgacctccggggctcaagcaattctcccacctctgcctccagagtagctgggactataggcacgtgccaccctgccaggctaatttcttccattttttttagagacagggtctcgctatgttccccaggctgggctcaaatggtcctcccacctcagcctccccaagtactgggattacaggcataagccactgcatctggcctccatgacacatatttttaaagtctgatttttaaagtcaaacttttgaagtcagattttaaacggactattttgaaaaatatacaaaaacgtttaaaaacaatgaatatccctcacctagaatcaataactaagaatattgacacatttgctttggggactgggcggctggagctgccatgacaaagctccgccgaccgagtggcttttaaacagagcctgccctctcgccgactgagggctggacgtgcaggatggagctccgcagggtcggctcccctgtgctctgaggggctctgctcagcctctcccggctgtggcttaaaaacagagcctgtcctcccgccgtggggggctggacatgcaggaccgaggggccacagggtcggctccctgtgctccgagagggctctgctcagcttctcctggctggggggttttgtggccaccctctgtgttcctgggttcagaagcatcccccaggctctgccttcatctctgcacgggtgactctgtacaggaagccaggcctgctggtcaatggccacccagccctgtgccctcatcttacctagtcccagctgccgtcaccctattcctaataaggccgccttctgaggtcatggggttaggacttccacataggaatctgtggggacacggttcggcccacagcccttcccacctccgcacacacacacgactgtgaggagttggaagacctcactcctcacccctgccaggtcctctagggacaagctcgctgtcctcatcccagcacagcccgtgggacggtttccttgtccctaatgggaccacggtcagagatgccgggtctggtctgggccagcaggttcctccgcccggggcaggcagccttcttctgtgcgcttctggaaagcaatgtcctgtaatgcggtctctctgcgggagcacccccaccgccacctcacaggcctgttccacagccccgggatgggctctgtctccctcctgaccctgcatagggcacagccctctctcatcaacccacgatcctacgtggatccgagagggagcacctggggaaacaatggaatcccatagaaacaccccaaatctaacttgatccaggaccagccagtggtcacttctgaatattcaccttcctagtagacactaccagccaagggaggccaggaagccttcctggaggaggtggcctgaggactggggtgaggcaggccctgcgtgggggtcgccacccagcacccccacactgggtgggagccagtctctgagactggctgggggaggtgggagagggggctgcttgaactgcagacaccgaggtctagcccccaccccacccagccagttggtggaggcaggggaggccgaggggcccagctggacctgctccccggggtggattccaaaataggggggttggggggggcggaacaggagcccagggtcctggcttgaggcccagtggctgagggctggtgcaagccagacaggaaaagggttgagcctgtcagcgccagcacagatcaagtcaggagcaggtccctccaccaatgtgtgcaaataaatagcagctaagtttccagttacaagaacaatgcacagatggtcccagggacattgcggtgtggacacgcagcggccattgtcctgtcgccagcacctcgccctacagctggggggtcccttagcacttcctagccatgcagggtccctgctcacagtacccgtgatgacttctgttcctcacctgcctgtctgtcccgacagctgcatggcagccctggcctgggagatggagaccccgaggggctgcctgcggtggtggggcccctgggtccccactgcattcccagaaacccagagggcagggcatttcccctgctctgtgccgagtccacccagccccagcctaggcccagtaagggctgcagcccaccctgtcccaggctgcctcccaggagccctcttggccctgatgccagaagcccatcttcctccattcaggcaggtctctgagtgccctggcctggctgcctgctggccctgagagtcacactaccccacagccctccttggtcaaaatccactctggagtggctggaagattccccgggcccacgccgcacacgcctatgcagggagcttcccctggccggccggcagacaagggcggtctcagagagggggctcacctcagcagccccttgtgtagctggccctcgcccctgccacctctgggaacaccaccaggaagctgggggacaggcacgcaggtgaaggaggcgagcgcttgtcagccgggaggccatgggcacagagggaacagggacaccctgggtggcctcaaggtcacttcaaacccctcactcgtcccctgggagggtgcccagtgaggttggcactaggagttggtcctggtcacatgacagacccacccacctctggtgtccagccagcacgccgtgggccagcctggctgcagggacacgagggcagcagccccctcctcctctgagctggttgctccttgagtcatcaccaccgcctgccacggaggccgcctgtcccaggaagcagagggaccgcagctgtggcaaccagggcctggtctctgtgtcacctcgctggggggccgtgcccaggcctgagacggaactgagtgacagtgcactgggtctgacagtgtggggctggcgccatgtttggggaaccctgtggcatgggacctgtgggtgagccgggaaaatcaccccgttgcatggcatctcgggcctggatcttaagcgcctgtgttggtgcctccgcctggcggaagagccgcgacccccacgttgccatgcgggtatcccaagccctgaccctggcaggcatatgtttcaggaggtccttgtcttgggagcccagggtcgggggccccgtgtctgtccacatccgagtcaatggcccatctcgtctctgaagcatctttgctgtgagctctagtccccactgtcttgctggaaaatgtggaggccccactgcccactgcccagggcagcaatgcccataccacgtggtcccagctccgagcttgtcctgaaaagggggcaaagactggaccctgagcctgccaaggggccacactcctcccagggctggggtctccatgggcagccccccacccacccagaccagttacactcccctgtgccagagcagtgcagacaggaccaggccaggatgcccaagggtcaggggctggggatgggtagcccccaaacagccctttctgggggaactggcctcaacggggaagggggtgaaggctcttagtaggaaatcagggagacccaagtcagagccaggtgctgtgcagaagctgcagcctcacgtagaaggaagaggctctgcagtggaggccagtgcccatccccgggtggcagaggccccagcagagacttctcaatgacattccagctggggtggcccttccagagcccttgnnnnnnnnnnnnnnnnnnnntggccggggaggctttgtggggccacccagccccttcctcacctctctccatctctcagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacaggtgcggcctcggaggccccggggcaggggtgagctgagccggtcctggggtgggtgtcccctcctgcacaggatcaggagctccagggtcgtagggcagggaccccccagctccagtccagggctctgtcctgcacctggggaatggtgaccggcatctctgtcctctagctctggaagcaccccagcccctctagtctgccctcacccctgaccctgaccctccaccctgaccccgtcctaacccctgacctttgtgcccttccagagagaagggcagaagtgcccacagcccaccccagcccctcacccaggccagccggccagttccaaaccctggtggttggtgtcgtgggcggcctgctgggcagcctggtgctgctagtctgggtcctggccgtcatctgctcccgggccgcacgaggtaacgtcatcccagcccctcggcctgccctgccctaaccctgctggcggccctcactcccgcctccccttcctccacccttccctcaccccacccaacctcccccatctccccgccaggctaagtccctgatgaaggcccctggactaagaccccccacctaggagcacggctcagggtcggcctggtgaccccaagtgtgtttctctgcagggacaataggagccaggcgcaccggccagcccctggtgagtctcactcttttcctgcatgatccactgtgccttccttcctgggtgggcagaggtggaaggacaggctgggaccacacggcctgcaggactcacattctattatagccaggaccccacctccccagcccccaggcagcaacctcaatccctaaagccatgatctggggccccagcccacctgcggtctccgggggtgcccggcccatgtgtgtgcctgcctgcggtctccaggggtgcctggcccacgcgtgtgcccgcctgcggtctctgggggtgcccggcccacatatgtgcctgcctgcggtctccaggtgtgcccggcccatgcgtgtgcccacctgcgagggcgtggggtgggcttggtcatttcttatcttacattggagacaggagagcttgaaaagtcacattttggaatcctaaatctgcaagaatgccagggacatttcagagggggacattgagccagagaggaggggtggtgtccccagatcacacagagggcagtggtgggacagctcagggtaagcagctcgtagtggggggcccaggttcggtgccggtactgcagccaggctgtggagccgcgggcctccttcctgcggtgggccgtggggctgactccctctccctttctcctcaaagaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagccgacggccctcggagtgcccagccactgaggcctgaggatggacactgctcttggcccctctgaccggcttccttggccaccagtgttctgcagaccctccaccatgagcccgggtcagcgcatttcctcaggagaagcaggcagggtgcaggccattgcaggccgtccaggggctgagctgcctgggggcgaccggggctccagcctgcacctgcaccaggcacagccccaccacaggactcatgtctcaatgcccacagtgagcccaggcagcaggtgtcaccgtcccctacagggagggccagatgcagtcactgcttcaggtcctgccagcacagagctgcctgcgtccagctccctgaatctctgctgctgctgctgctgctgctgctgctgcctgcggcccggggctgaaggcgccgtggccctgcctgacgccccggagcctcctgcctgaacttgggggctggttggagatggccttggagcagccaaggtgcccctggcagtggcatcccgaaacgccctggacgcagggcccaagactgggcacaggagtgggaggtacatggggctggggactccccaggagttatctgctccctgcaggcctagagaagtttcagggaaggtcagaagagctcctggctgtggtgggcagggcaggaaacccctccacctttacacatgcccaggcagcacctcaggccctttgtggggcagggaagctgaggcagtaagcgggcaggcagagctggaggcctttcaggcccagccagcactctggcctcctgccgccgcattccaccccagcccctcacaccactcgggagagggacatcctacggtcccaaggtcaggagggcagggctggggttgactcaggcccctcccagctgtggccacctgggtgttgggagggcagaagtgcaggcacctagggccccccatgtgcccaccctgggagctctccttggaacccattcctgaaattatttaaaggggttggccgggctcccaccagggcctgggtgggaaggtacaggcgttcccccggggcctagtacccccgccgtggcctatccactcctcacatccacacactgcacccccactcctggggcagggccaccagcatccaggcggccagcaggcacctgagtggctgggacaagggatcccccttccctgtggttctattatattataattataattaaatatgagagcatgctaaggagttctgtcctgtctggtggctgtgggggcagtgggcaggagggagggaggcctccagggagggacaaggcggcagccaggctgaggctgtgtgtggagggtgctggtggctcccctggatcctggcctgagtcaggccttcccctcgctgtcccagaaacacacaggccctcctcgccctgtttgccccactcacatgtagagccctccggtgaaaaattcctccaacatcacggggctggggacaccatcttccccaagcccaggccttttaggggggtcccacggccccctggccccaggcttcctggccaggcatgggtgtccctgagtgactgtgcctgctccatagcccccgtgtccccatgcctaccagtccctccgggcaggggtggtacctggtgccagggcgtccacagcggggtgggagggctgccctgggctatgagggacacagcatctgcgggtccctccccaagtacacagggtgggggcagcgggggaggcggggtcacgtctgctggagccctatcaccctgctgcggtccttggcagctagcagcagggacggtgcagggaaaggagccctgccaggccctcgggcaccgcagccaaacacccactgacaccccggggctcattctctgcttgccatcctggagcccagtcctggaccccatgcctgtgtcagggacaggcacagagacctcgcagctctgggaactcccggtgagatccggcagatcaggcctggcagggaacgctgcccgggggctctgcacatgatgtgggtttccatccgcaaaacccgataggtcccatggaaaatgaccacaggcaatgagaaagccatagagtgctgcctgtgagatcagcgtccagaactcacagctctcaaacacccactcacagcgcagcgcgccagcgtccagaattcacggctctcattcatccattgacagcgcagcgcgccagcatccagaactcaaggctctcaaacacccattcacagctcagcgcgccagcatccagaactcacggctctcattcatccattgacagcgcagcgcgctagcatccagaactcacgtctctcattcatccactgacagcgcagcgcgccagcatccagaactcaaggctctcaaacacccattcacagcgcagcgcgccagcatccagaactcacggctctcattcatccattgacagcgcagcgcaccagcatccagaactcaaggctctcatacacccattcacagcgcagcgcgccagcatccagaactcaaggctttcattcatccattgacagcgcagcgcgccagcgtccagaactcacgtctctcattcatccactgacagcgcagcacgccagcatccagaactcaaggctctcaaacacccattcacagcgcagcgcgccagcatccagaactcaaggctctcattcatccattgacagcgcagcgcgccagcgtccagaactcacgtctctcattcatccactgacagcgcagcgcgccagcatccagaactcaaggctctcaaacacccattcacagcgcagcgcgccagcatccagaactcaaggctctcattcatccattgacagcgcagcgcgccagcgtccagaactcacgtctctcattcatccactgacagcgcggcgcgccagcatccagaactcaaggctctcaaacacccattcacagcgcagcgcgccagcatccagaactcaaggctttcattcatccattgacagcgcagcgcgccagcatccagaactcaaggctctcaaacacccattcacagcgcagcgcgccagcatccagaactcaaggctctcaaacacccattcacagcgcagcgcgccagcatccagaactcaaggctctcattcatccattgacagcgcagcgcgccagcatccagaactcaaggctctcaaacacccattcacagcgcagcgcgccagcatccagaactcaaggctctc

SEQ ID NO: 14768 - DNA, 67581 bp, Human
  misc_feature (1)...(67581): n = A,T,C or G
aaatttcggttacttagttcttcttgttcagcctttatttccctattttatgacaacagaaggaaaaaatgagtataaaatttaaagcaaaacaaaacaacaaccaaacccaagttaacttttccctactttgaaattcgaaacaaatgaagtgtaacttgtcttaattcagatcatgatctgaaagatgacatttatctgtgacaagggggagggagaaaaagaagcagtgaattgaggagcttctcctttgtgttttgacaagcaaaaatacttttttttttttttgagacagaatcttgctctgttttccaggatggagtgcagtggcacgatcttggctcactgcaacctctgcctcctgggttcaagcaattttcatgcctcagcctcccgagtagctgagattacaggtgcatgccaccacgcccagcttatttttgtatttttagtaaagacagggttttgccatgttgcccaggctggtcttgaactcctgacctcaggtgagctcgtcgtctcggccccccaaagtgctggggttacagatgtgaaccacagcacccggcccaaaaataccgtgaatttctagaatgttacgcaccatatttaattattcaaaatgttcccaaaatattttttaaaaacttctggtacatttattattttatatcattgttaaatatcctatttaattagtgtgaatgattacaaattgactgacaaattctttaaaaatattactgcagttggccgggcgtggtcgctcacgcctgtaatcccagcactttgggaggccgaggcaggtggatcacgaggtcaggagattgagaacatcctggctaacacggtgaaaccctgtctctactaaaaatacaaaaaattagccggacgtggtggcgggtacctgtagtcccagctactcaggagactgaggcaggagaatggcgtgaacccgggaggtggagcttgcagtgagccgagactgcgccactgcactccagcctgggcgacagagcgagactccgtctcaaaaaaaaaaaaaaaaaattactgcagtaattgctgtagaacctagagttcaaatgagacctttgtcagagaacatgaccccaaagtagttctgtggaactttgcgtaggttacttggtattttgcatagattattgggccattattcttgtgggtggacctgcccacaagatagttggacaacatgtaaatagttattaaatctgtttgagtgcatttccactcggtttttcatgtgcgtgttcaaacatcaaggtaaagtccttttaaggccatccatacagaaaaggcttcagggttctaaaggaccttaaaaattgtttaatcatgcatgcagcaatttttttgaatctcttccgtatgtccctgcagtttcctcttgtacacactgtcttttgaggtgactgaaaatgttctttattataaattcttacttgaattgatggcaagataggactttactaattggtttattacctcaattcatgatattacttgtaatatagttttctaaattagtcttaagcttatttaaagctaacagctgtttgataaggatatttgtatagctctggtcttattatatcattgtttcttaggaaatatgaaatatttaaagaattttaataattctttcatagagttcttcatatgtatagtcttttcatcagaaacacactaaagcactatttgcatttcctagaaactcatgtgtcacagttactttgtgtttttaactaggtggttaattgaatttattgttaagtctattatttaatgagtctaaccaaaccttaatatctattattaagtttaatagtttaaaataatttaaaaatactttgagtttatggaatgaaaacactgtttcaagtttgtgtgttggttagaaatattttgaattactagatgtgtcattttaaaaatgtggtatgtactagtaaattttgtaaaatattttatcttttaggcgaggattaaatccaccacacagggtgaaatctatctccatgacaacattcacacaacaggaaattgaattcttacaaaaacatggaaatgaagtaagtggttttttttttttttgcaatttttgacttttttgttggcagtcattttaatgagatttaataagttatttaaaacgttgaatttcacggtctaaataagttatttttgtattttatatttagatattttaaaatgtactcatttaataatgtatttggaattaatgtttactacataaacactttaccgtaaatctgaggtgaaatgtgtgtatttaaaagtcatcagtcttgaatataaaaggcgtttcggaggacacccattattacagttattgttagtcttcgcttcaaaagtcaaaaaagaggaagagaattcattttgtgatgttgtgttaaacttgttagagtgttgtgtgatcagctttcacttgaagtcctctatttttcgtaaatttttaactttggacgtgtaggtgatgtgtaatgtttagcaggtgctcagtagggaggaggttagtagttctcagtggcagctaagtgtcatggggagccagatggtataaagatttggatggaagctttttttcttcttgcctttaatgggcttccagtaattctattctgtttgcttgtttgcttttagctctgtgttttgctattagtaaaagtttttaaaatttttctaatatttttaaaattaataaaattaacaaagagagtgggcatttttttataatcctgcaataaggatgagccagttaacccaagctgattaataatagctattattatttgacagaaaagtctcattttctagaaaggataagtagtactttagtggtactcttctggttgcatctttgatatccttaataaacataaagtaagttaaatattaaaattttattagttttaatcttctccttggacccttagaaaatatatgcaagcattttacactctgcctttcttcctaatactctgaaagtaataccttaaaattgtttgcctacttgtgatgtccacttgcttttggttctaaaatagtgaggaaatataaattcacagctatgaaatatttttaaatatttcatattaaattatttaaagaagagagcacattttgaagtctccagattttgccgatgacaaattattttgagtattcagattccagactaatgtgagtacattataagaacatgtaaagctggatgaaaaggtaggaggcttttaatgaagagtaagcatagaataatatatatattgattaaaatacaatttgaactacttgtgtaaagtttacaagtaggattaacttaacattgcacacttgaagttactttcttagaatgttggcttagtgtgcaaaattttggaaattagaatggaatcagaaataaagaatattattctatctttagattaaaaatatgacagtaggtaaaaacagagtagcaaaactgtgataacagcagtcaattgaagaagtgaaaatataacaatatgtgagataaggttaggtggagactggtccaaaacaataccaagattgaaggagtatatatttttttaattgtggtgggaacattgatctaccctcttaacaaatttttagatgtgcagtattctatggttaattatagacatagtgctgtatagcagatctctagaaattaatcatcttgtataactgaaactttataccagttgaattacagctcctcattttatcttctgcccctgttgccccgattctactctctgcttctatgggtttgactattttagatacctcatataaatggaattacacaatatttgtacttctgtgattggcatatttagtgtaatgtcctcaagattcatccttattgtcatgtatggcaggatttctgaaggaatattttttaaggctatagcattatggtaaatttagagtatataaaaagaattagttaatttttaggaactcactgtatcaaaaagtagaagcaaaatgtaaatgttataagtgactgaaatgtatttatgaatcttaagtcctacaaagaggtttgcaagttgatagaccactcaaagcacttaccatgacaatcactgtcactgtgctgggtattagggatgtggttatagatgtgttacaccggcttagtggacaaagggctcacagttggtgtgacagatacataacagataattgcaacatggtattagataaataatgataagaataagaagtatcagcagtagtatggaaaaagggaatcagtattttggtggaaaggagaggattgggaagacccgacagaacagataacacatttgttggtttttgagggtaactagaacctaagctggtagtggaagtcactgaagatggagcaaacagtacaaaaagaaaaagggaaacttgcaataggttgctaggaaatatactaaccttgtaaatgcttgttaaggaagacaaacataccttcttatagtataccaaagaacatcttagaaccaaaataatggacaggtatgtttggttctttacagtattaacagtatctgtgttcttaaaattttgagaggtgtgtagagggtgatgaagatacgaagtgtgggacagttggtacagctttataaccaaatctttatggatttcacgtgcaagtgttctattatcagtttatcttttttaaacctttaaatggtaaatatcacttgcatagggaatagtaccagaacgtaagtttacatttcaaaataagttgccatattctctcgtcaccttttaatagtttggaaagggccatattcagtcacataagttttggattaaaaaggctctatcatacatcttgtgcatgaatgagttcatgcctgaagatgagtatttccaaaattaaaagatcagaaagtatattggctttggcagcagccttggatctttgatccccaccagggagttttagtgagctgtggggcatgtttggttgttgtcactattggaagatgttgctggcttaagcaggcaagcaccatgaatgatgaatgacttgtaatgtgttgaacagaattaacctgcatgccatatgctatgaatgttcctccagacatttatatgtgggaaacatctgtgtatggtcttctgcatatataatttaattctgtcttaatacttgcattgtagttgaacatcctattgccaaagaaagtcatgctccaagcccagaatcagagtgagaggggctaccaagttacagggcaaagggcatggatacaatcacacaactgatggcaatacgaattgtattttagtcatcaataaagtatatctgtattggtagctgtggtaagcaaataatgttattactatttatagatatgcatagagaccatacttacagagtagatcattagtttctacagatgtggtttacaaatttcttgactattactttagtgtttatagacttctacagtgtgtttggtggaggagatatgtatatcattaagttacagcacataatatgccagatgctagtaaaatatttcgcattggagcactttgtatttatttgctgaagtaatttttgtcatttttttcagaaccagaatatttcacaaaaagtttccatgtatttcttttgtatcatacagttactttaaaaaaaaacctgtagtgatcttggcactgtagctcccctgtaatcccagcactttgggaggtggaggtgggaggatcccttgaggccaggaattcgagatcaacctaggcaacaaagcgagatcccatctctccaaaaatttaaaaattagccaggcgtggtggtacacatctgtagtcccggctacccaggaggctgaggtgggagcattgcttgagccctggagttcaaggctgcagtaagtcatgatcatgcaactgcacaccagcctcggtgaccaagcgagatactgtctcaaaaaaaaaaaaaaaaaaatctatagtgattttctgtatgtcctcatttgtgatgtcatgggcaaattatggttttctagttaaaggaagttggattaacttctgattataaagttaacggaaggtggactggtgaacactgctgtaagtagataattcaatggagaagaaaatttagaaataattttattttgaaatatgtatagtttatgttttctagttgtaagttaaccttcctaatatgtttgaagactaaaagtaaaagcattactactggccaagtgcagtggctcatgcttgtaatcccagctgtttgggaggctgaggcgaatggaacagttgaggccaggagttcaagaccagcctggccaacgtggcgaaactctgtctctactaaaaatatatatatattaaaaaaaaaaattagccaggcatggtggtgtgtgcctgtaatcccaggtacttgggagactgaggtgggagaatcacttgaacctgggaggtggaggttacagtgagattgtgccactgcacttcagcctgggcaacagagtgagactgtctcaaaaaaaaaaaaaagaaaaaaaaagaagacattactattaatgctccacaggcatggtctatgtgtaggagtaaaatcaggcattgcatgccagtatttgattatctctatactggattaaaaacaaaacaaaatgattgctttgaaaacccatgcaataacgtacacttttcccttgttaacattcatgattgattcatttttgaagcagagatttattaataaattacctactgtgggagaatggcgtgaacctgggtggtggagcttgcagtgagccgagattgcgccactgcactccagcttgggcgatagagcgagactccgtctcaaaaaaaaaaaaaaaaataaaatagcctgctgtgtgccaggaactgtccttaggtcctagggatacaaaaagggagatgattcctgtcctccccttgcagtcttctacatgcaggagacataataaaagtacagtggtcttgtgctgaaagctcagatttggactatgcaggttgtgaaccttgggcaagaagctttttagccttaatttctattggtagtaactataatacctgtgtataaaaatgctaggattttttgaattaggccaacttgtgaaaattcccagcgtatttcttgtcagatagtatttatttattgaatctgaatctaaagtggtagaagttataagaagaattatcaatttttattttcattcctggtttggatggtttctgtagggggatttttcagttttcatagcatactgtcatgtcatttacattaatattcgggttatgtatttaaactcttggagcattttaacttcgattttctgctgagtttaataataatgaaaattgatagttattttagtaacaacatattgccatgtagagtggcagagttaagttatatactcattaattcaggatttacagctattctgttgcctatggcaggggttggcaaactgcttgtagtggccagatagtaaatattgtaggctttgtgggccacctgtattctctgttgcatatccttgtttgaaatttcacccccctcttcccccccccaccccacacacacaattctttagtgtaaaaaccatctttagattaaggcagtataaaaacaggctagtgatgacccagtttggtctgcagattgaagatgtatagaactcttaacgtttcagcttgcaatgtaaatctttttatgacctgacttcttaatgtaatgacgttattgccagcagaaatgttttaactacaatgatctttgttttgttttccacatgtgctatctgtattctaattttcttgccattttaccaatgctggcttttatttttgcttgacttttctcttctaatcccatcagtctttcaggagtttttatacctcagatactaacacccccatatgtattttaaactgtttaaaaaataacattcactgtaagatttacaaaaaaaaattttttttgttattgctcttagtttcttctgtattggtcttactgccctcaagacattatagacatctctgtggcataatcttgcatacgtcttaattatacctaaagcagtgaaaatgcacaagcatatatagccaaatgagtttctttcttgtttttgttttttttttttttttttttttggggacggagtcttactctgtcgcctaggctggagtgcagtggtgcaatcttggctcactgcaacctccacctcccagattcaagtgattctcctgcctcagcctcccaagtagctgggattacaggcatgtaccaccatgcctggctaatttgctaggactcaaaaaaatccgtggtttagtttgattaccactaatttatgaaccttgttaccttggggaaaccacttttccctgaccttcattttcctttgtaatctgtgggaaatatctgttttgcctatttcatgaggttgatttgaaggtagtatataggaaaacattttgaaaattgatgtattatatagatgtaagatcatggttttattttattttttaaaattaaaaaaaaatttttttccccaggtttggtaacttgcccaagatcgtgcttttatgggcaaagatacttttccagttgattcctaaacacagaaaataagtatcacataggaacatggcatgctttgaattgaatttaggggtggagataaatttttgcagaatttcagtcagtatgatggtattaataaatgaaaacattcactaataatacattgaaaaacattttaaactacaaaattaattatttgagggaatagcttcctagagggatatctcaggtttaaaaccatccaattaaaatattaaagcacactattgttattatttaagggatatttatttagtgtctgcatatttatgcacgtctggccttttaagcattttgaaaggaaggtatggtgctatggctcttctaaatattagctgaatctagtcagtagtaacttagtaaagttgaaaatatttagagtatattatttgatgttaactgttggctttcagagaaatacactaacaaaaatgtagaaaatgtagacatgtctttgtgttgaacatatcataatccgtgggtctttttgaatgacagaaaacccagagatttatagaagaagctagatgttgtttgtaactactctgagagtttacttaactttttttacattacatattccaggttacagtgtatttctttctagctgtttgccttaccattctagcttcctgtaatctcttagcttgtttttttcttgccattgtgtgttatcttctaaaaaatcttacttgactcgaattaaaacaatataaatcattagatgcttttgtttcttttttaaagagtttttttgtggagttattcatgcctttagacaagtagataatgacaaacttccatcaacacatggctgtctttttattatttttaagcaaatgcgagacataaaatttcatctgtaaactcaactctcatgttatctgtaaatttcaaggactttaaaatatatatggcaacagtgctatttttgtccctatgacaattaacagtaatctagtcatctggtcagtgttttaagttttctgttgttcatcagtatcttacttttcttttttttttcttaatggtttgtttgaatgaggatccaggtaatatccacacatcgagtggttaaaatgggctttaaaactttgtattgcttataaaggattggaggctttggctgggcaccatgcctcatgtttgtaatcccagcactttgggaggctgaggcaggcagatcacttgaggccaggagttcgagtctagcttgggcaacatggcaaaaccccatctctactaaaaatacaaaaatttgctgggcgtggtggcgtgtgcctgtaatcccaactactctggaggccaaggcacaagaatcacttgaacccagcaggcagaggttgtagtgagccaagatggcaccactgtactccagcctgggtgacagagtgagactctgtctcaaaaaaaaaaaaaaaggaagaaaaaaagggattggaggctagatggatcacagtgacacctacaaagattggactggaatggacctgtattagtagtatgtggcatagattcaggcagaggtttgtgttaggggcctcaggccaggtagttattctggagctggataatctataacctggggcccctgccggcttaaagtccctgggaaacatagcagctcaggtgacttcagtgccttatgggacacggacgcagcccgagtgctacctggtacacatctgagttgtagtccttttcctgtgtctttttcattgctctggcatcagctgctactcagtctccttaaaattgatgttgggttcttactgcaggacaagaagcctgtttgtctgtcaggacggcagctgacattcattttggcaacagagtatgccatgtggttatggggtacgttatgagctggtaagaagaaaacaaacaggccctccagcctcataggtttttgaggaattggtaatgatgtttaaggtttgggtagtagtagccaaaggccatgcctgcaagaacttcttgttgatttgggtgatattttttggtcagtctcttactggaccatgactcccactacttccccaaggacaatctcatactggcctgtgatcctaggttctttccaaggatggagtgtctgtgagcagttatcttttgataggagaacttgtcctgctttgtgccatctaatggcagcatagtgtcataggtcttatggcaggtgagcagtggttcaccagcttgtctgcctgcagggagcctggtttggctatctgctacattgtctctcagaacctgctgtcctaggtagctacagcaagcactctggacttgggtagagaatgctcaggagccatagcacaatggccagatctgcctgttttcgtcccctcctccaacattattatggaaaattccaaatacataaaagttgaaaaattatacaggtacaataaacattgtgctatatttgcctcagcagatatctgtatccattcatcagtccatctgatatttcaaagtaagctcaaaacattagttcacattacttgtataaactgcaatatatctatcttttttatttttaaattaaattaaattaaaaaaaaaattttttttttgagacagagtttcgctcttgttgcccaggctggagtgcagtggcatgatcttggctcactgcaaccactgcctcccaggttcaagtgattctcctgccttagcctcctgagtagctgggattacaggcgctcgccaccacgcccagctaattttttgtgtttttagtagagacgagggttcatcatattggccaggctggtcttgaactcctgatctcaggtgatccacctacctcagcctctcaaagtgctgggattacaggcgtgagccaccgtgcccagcctaattttttttgacagagtcttggtcttgtcgctcaggctggagtagtgtgatcttggctaactgcaacttccacctcctggattcaagagattctcctgcttcagcctccagagtagctggggctacaggcacccaccaccttgctgggctagtttttgtatttttagtagagatggggttttgccatgttggccaggatggtcttgaactcctgacctcaggtgatctgtccaccttggcctcctaaagtgttgggattataggcatgagccattgggcctaacccagtatatctatcattaattagaattcagtattcgttcaattttttgaggtataatttacatacagtgaaacttaagaatcttaagtgtacttttggatgagttttgatcattgcttccaatttggtaatccaaagccctatacaaatatacacataaacatcattacagacagtcactggacacttcttcctattcagtccttccctgaattttttgagacagggtctcaacttctgtcactcccaggctggagtgcagtggctggatcacggcttactgcagccttgacttcctgggctcaggtgattcttccacctcagcctcctgagcagctgggaccataggcatacaccaccacgcgtggcccatttttttatttttagtagagacggagtctacttctgaggcactgttttgtttttttattcacattcatataaagtaagttaaaatgtgatttttaaaataaccctccttccttttttattttttttgaggtagggtcttactctgttgtccaggctggagtgccagtggtgcgattacagctcactgcagccttgaccacctgtgcttaagcagttctcccaccttaacctcccaagtagctgggactacaggtgcgtgccaccatgcctggctaatactgtttatttttgtagagacgagatctcactgtgttgcccaagttggtctcaaactcctgactaaagcgatccacctgtcttggcctcccaaagtgcgaggattacaggcctgagcccacagtgcccaaccaaagtaaaccttcttttggagagttatggcacgtggatggcttgtacttttttcctgtttattaccaagtattggcttctattctatgaataaattataatttgttcattcttctttgtcagatatatccttagtaaatattttctcccagtctgtggttttttgttttttgtttttaattttttgagacagagtctcactctgttgcccagactggagtacagtgacgcgatcttggctcactgcaacctccgccttctgggttcagttggttcttgtgccccagcctcccgagtagctaggaccacaagcgcacaccaccagtcccagctaattttttgtaatttagtagagatgaggttttgccatgtaggccaggcagatctggaactcctgacctcaggtgatccacctgcctcggcctcccaaagtgctgggattacaggcatgagccaccatgcctggccctcatttattttctttttgatatcttttggcaagcggaagttttgtcattttgatgaaatacaatttattagttttttgttttatagtgaatggttcctcttctctgtcttaaaaaatctgcttcctctcaaatcatgaggataatcttatttattttagaagctttacatttacatctgtgatccatctcaaattaattttagtgtatggtgtgatagggattgagtttcatatttttacatgaatatatacacttctagctctattgttgaaaacacttttctttcctcggtgttgctttggagtctttgtcaaaaatgaaatgaccaggcagggcatggtggttcacgtctgtaatcctagcactttgggaggcagaggtgggcagatggcttgagcccaggagttcaagaccaacctgggcaacatggtgagaccctgtctctacaaaaaatacaaaagttagccaggcatggtggtgtgcacctgtattcccagctagttgggaggctgaggtggggggatcacctgagctttggggaggttttaggctgcagtgagctgtgattgcaccactgcattctagcctgggcaacaaagtgagaagttgtctcaattaaaaaaaaaaaaaaaagaaatgaccgtataattacgggttatatgctctctattatatagtgtcatttgtgtatttgttaacccttatgccatacaacactgtcttttggttactctgctttcctagtaaatcttgaagtcaggtagtacaaatccttcagttttctgtttttaaagattgcgttagatattctgggtcaggggttgaccaactaaagcctgtgggccaaatttggcctgttgcctgtttttatatggtctacctgattgagctaccattgtgagacatggagaccaagctggattttctctcccttccttccctcatttctccctccactgttggcagctttgggcaccaagtggtggaatctgggagttgatgactcagtcacctttgaccagctgcccaaattgagatgactgggctctttgggaagttggaaaggcacaccaggatctgagtgtcactgtggtggagagtgaaaatgaccacagtgcagattatctgtttgtcatattggttttgataaattgtacttttcagggaatttgctcatttcatctaagttgtcatatttattgacataaagttattcataatagtcttgttctcttaatgtgtatgggatctataattactttgctcttttattatttccttctgtttactctgggttatttcctcatttttagcttactaaaggtgggacctgaggtcattgattctacagcttgctctttgaatacagagttagaggaaagataatgttattaagacattaataaagaagggaaaatgtatttactgtttattaagtggaagtagattgtgttcagtaggctgaggaggaggaagaggaggagggagggactggtcttgctgtcttggagataacagactggagaggtggaggggaggcggaagaggcagggacacttggtgtaaattttttttttttttttttgagatagggtctcaacttccgtcactcccgggctggagtgcggtggctggatcatggcttactgcagccttgacttcctgggctcaggtgactctcccacctcagcctcccaagcacctgggaccacaggcatacaccaccacgcctggctcatttttgtattttgagtagagatagagcttcactatgttgcccaggctggtctctaacttttgggcccaaatgatccgcctgccttggcctcccagagtgctggggttatgggcttgagccactgtgcccagccaacttggtgtaacttttattgaaaaaatttgtgtttaagcggacatgcacagttcaaactcatattgtcaactattaacattttaaagtgatcattttccctctaagctctacttaactgtgctatacgaatgttgatgtattttatcatttggttcaaaatgttttctaattgcccttgtgggccttctttgacccattgatttatttagaagtagtggtttaatttttacatatttgaggttttcctaggtccttttctgtaattgattgctgagttaattctgtatcatcagtgaacatttttgatatattttcactgctttcctttttattgagatctctttatggtccagcacgtgttctgtcttggtgagtgtacagtgtgtacttgaaaggagtgtgttttctgaagttgttgggtgtagtgttctataaatgacaattatagctctgtgattgatggtgtttagatgttgtggatccacgttactgatttcgtctagttaagcaactgcagatagaattggacagctggtgtggatttacatatttttttctgtaataaatacatcattttttgctgcatgtattttgaaactttattattggtgctgttatataattattatgtcttcttgattatgccaccattatgtaatatcttttttatgtttgataatactcttttttgaaatttactttatctcatacttatattgttttttctttgtagtgatgggtagttgtgaaacactttatttttgttttcagaatgtgactgtgatgcacctggtatatgctttgtgtatgtgtatgtatttatcctacttgtggttgatgatgatcttgaatctgtacatttttcatttaccaaattgggaaaattttatcattttccttccaaatattttttctgcctcattctctctcagctctccttctgagattccaattgcatggatgttaggcattttgatactgttctgcagtttccagaggctcttaatttttttccctccatctttttactttccagattggacaatttctctcttatcctaagctcactcttctgttatctctaagctctaatttttaactttagatattgtcttttccatctctagcatttgtattttttctgttatttctagagtttccatttctctgctcagattttgttcatttttatttattgcaaggatgttttcttatatgatatggtctttttattttgttttttttgtttgtttgtttgtttttgagacggagtcttattctgtcgtccaggctggagtgcagtggcacaatcttggctcagtgcaacctccgcctcccaggttcaagtgattctctgcctcagcctcccgagtagctgggattacaggcacccgccaccatgcctggctaatttttgtatttttagtagagacagggtttcagtttcactgtcttggccaggctggtcttgaactcctaatctcgtgatccacctgccttggccttccaaaatgctgggattacaggcatgagccactgcacccagcctgtaatatgtttttgaatataagtatactagctattttaagtcattgcctgcttattctaaaatctttatcattgcagaatctgtcgctgtttgatttttcttttgattatgggtcataatttcctgtttctttgtatatgtagtgcctctggattctgttttgttccttcataaactattggttttaattgttttgttttttactttagcaaattctgctgctcccatgatgagtgccagctgaaatctgctcagttctttaattgaactgtttgaagtcagccccatgcacacataggtcaggagtgagccagagacttgggaaaagtggatatgcaagttttgtggtacctattttctttctctggccatctctcttctgggatttagccctcactttccagttgctatggctgtggtgaacctcttgtcttcttgtactttaagctttaaggcttgtgtatttctgtttgagttttagcagccctgcatgactgctttcaagtgatgttccttaaaaaaaaaaaaaaaaaaaaaaaagcacataggcacatacctagtgctgtttctttcctcttcagcttgtttgtggttgctctgtagtgtcttaatagactttgtccagagtttatagttgttatctgctggagagttggggttttaacctgaggctttttgccactactggtggaaatctacactgctcgcccttttaagtctttttttatcctctaagtttcctctccagtcactcattcttattctctgccctcctgctaaccaagtcatttattccaccttctggattttgctaatgccatccacgtagtgtcaacgttcctctgttctcccagttacctataaaccggtggttggctgtagtagtttcttaagattcaggcttaatttcaggaatgggaaagatccactatttcataggttgtgtggtgtttttttaatcgaaaaccactttaaaagttttaatttttggtcatgttagcagctaatgctcagtgcctacatccactaattagcagttgtaaaatggtgatagtctaactcagtagttttccaagtacagtttgggacttgtaagggatccttgagaccttttcagaggttctttaaagttaaaaaaaaaaatttaataatactgagactcagtttgctgtttttttactcctgttttcatgggtatacagagttttccagaagctacataacataaaaatgcggaagcagatgagaaatcagctggctcctacctaacaaggcattaatgaagtttacaaaaattacaacagtaatcccagcacttttgggaggccgaggcaggtggatccacgaggtcaggagatcgagaccatcttggctaacatggtgaaatcctgtctctactaaaaatactaacaaattagctgggcgtggtggcacatgcctgtagtcccagctgcttgggaggctgaggcaggagaatggcatgaacccgggaggcggagcttgcagtgagccgagatggcgccactgcactgcagcctggacgacagagcgagactcctgtctcaaaaaaaaaaaaaaaaaaaaaaaaaaaaaagcgccttttcactaattttttttgttttggaaaaagctgtttttataaataaaagttatttacattaagaatgcaatagttttattcttcttttaagaacattaaaactatttataaatatcagtagatatggtgcaccaccatttgtggtcttcaatattgaactcttcaaaatagtttcataacatttccaacagcaagcaattaggttttttttaaattactatgaatttatttatttgatatgtttcactcagttattcttgctgatgcccaaattttcccctctttgttcaatgaggtaatctgtttttgaaacctatttaaaacttctgcaaatcttgtttttacctagaagagctttgcctgaatgttcctttttttttttttaattaacctgtgagccacccgtgtattcagaaatgttgaaagaaaactgtttcttccccacctcttggtttatttacatagaatattgtacaaatgtggtttacttcaggggcttgttttgaatttgtgctaattctctctgttccttggccaatgactacattctaaacctcggtcagctgcctcacaaatgcatgccttcagtcaccaggacaacaagacaatagagtatcagtacaaatagatcactatgattgagtcctagattgaactaaataatggatgagtgtatttgttttaagaggtggctggtattgatgatatccttaaaccatagataatccacaaacaattcttacttcatatcaagacaaaatataaagttcttaatcatttctgaaggttatatgaccaaacaagctagccctcttctgctactcccttgctcaactccttgtttgttccaggtgtattctggaaaatgtaaaaaatgtaaagctttttctgtgtgtacatctatatgtgaggtagggaggcaagaacacacctttggttaatttttccttgaaaccttgcatatcagattcataatatctttgggagtgagaatgctttgctttaagaggcgtcacaaagtaagtttagaacaattggaatggaaacactgttgggattttttttttttttctttttaggaaataattctaaagctcatccaaaagaacagaaaagtaaaactagttgggaataatttgtaaaattatttactgtttgtaaatagtcaataattaaagcaacctgaaactagtgcaaggataggcacggatctgtagattagatcctgagatatactgtaaccttcatatattataaatgtggatgatcttgtaaaacaaaagaatttcagcattcagtgtggaagttggttattcaatgaatggaaaattaactagaatgttacctgacatgatacaccaaaatttcagaaaaattttagcattaaaatgtaagtcataaaggaagccataaacatgtagaaaacagtctcaaaagatctacctgcaaaatgtttattaatcccaagggggacaaacagtgactttaaatggataaagatacattttaaccaaataatccaagtatacaccagtactgggacaaattgatgttgtgtatctttcttcataatgatacactgggaaggacacgtcacttacatagtatcttccccaaaatacgtaactttaatttaatcatgaggaagcccagaggaagagacataccaccaaacagctggcctgtactcttcaaagatatcatagtcatgaaagacagaaagagtaaagaatgttccacattaaaagagacaagacagttaatggattctggacaaggaaaaccttttctttttgctataaaggccattattaagattactgactaatctttagatcagataatataaaatattaatgtcttgattttgataattgtgctatggttatgtaaaagaacgtacttatttttaggaaatatacatttaggggtaaaaggcttgttatgtcaccaatttaaatggttcattaaaaaaattatttttctcaagagaatgataaagcaaatgttaccgttggagacttggtaaagggtatgtgggatgtgtttccactatcaacttttctgtaaaataaattattttgtaattaaaaaaccaagcagaactaaattgtaatgtttaaggatgtatacatggtgggggtgggtaacagtaaaacacaaagagtgattactatagaaaatacagccaaatagccaactacatatttagcatttgaatgcagaagaactttatagactgaaagcaatggaagaagtcacaaagtaaaaactgatatatttaactagataaaacaaggaaactcgtgaaaggcagagtaaataaaattaaaaggcagagcccttgttctgtgccaggcaccataccatacagggtaatttacttatgttatcttagtttgagatagttgggcagatgataatcttccttgaaactactgtgacttcactaataataagtcttaaatttataaagctctttgtaatttacaaagttcattcataaataacctgtgtgttgaggggggtagggagggggtgcttactgtactcatgctccttactgaaagaagagaaggcttattgccctgggaaaaccacgaaacacagcaccacacatacacacacacacatgcacacgcacacacatccacacccctgattgtaccaggaatggacacctaaccctggggctagtgacttatcaggtcctgtttcttcagaaattgaattaaggttcacagaggctgtattcaaaacaacgagtcatctgaactgaaaaattgtatgtagtgggctctgtgcaggctgacaagtaaacaaacaaaaagtagtactttagagaagcaagagtggagacaagacatagtatgagaagcaaaatgataaactatgtacttggtggaggggtgagttgagagggggcttaggagataggcactcagactgcccaggtcccagatagtttcctgtttgcattcctggttcccatgaagtatttgttttattttggtggagtgctttggtgtatgctgtctgcaaatctgtttttctccaagctaatatagctgggtttcgattcttttcatcctatctagaacacagttctgatgttagagaccttaagtgaaataaggtatgggtatgtgagctgtgtgtgctgccctttactaagtccttatggtagatgtctgaattagagttgttgctctccttcacaacgcagatacttgcaagtaagttttcttactatccattgcattttatttctctctagtattctaaatatttgcttcttttttttcctttgtgagatttcctaatcccttttcaaatgttttatcatttctgtttctttgtacttagtagttacttagaaaacaagtgttaaatacctattaatctttcaccaaaacttattctggtactttttctcctatattatcaagtgaatcagtatgtataataaattggctctcagatagtccttgctgttgggaagttcttcctccaggggaaagtttttgcccatctctctatgttattccctgtgcacattctaatatgtttttgtttgtgcaggcatcattcagtttatgtattgtttagatatgcctctaaaacaggtttttattatcctatttaaattgttactagtcttggatgctgggatggtagcatagtccatggttgtaggtatgttaggggttggcacactttttctgtgagagtcagatagtaaatattttaggctttatgggtgccataaggtctttgttgcagttaatgctgatgttgtagctgaaagtagtcatagacaatacgtaagcaagtgggtgtgactgtgttctaagaaaactttatctacacacataggccccagatttagcccagtttgctgatccctggctgtatatgacgtgagaatttggatcagtgaatttattatttctacctaaataagttggggaactaaatgttctaggtcagtgtgtatattttagatggaacaaaagaaaaaagagaatttctattgtgcatacatttgagggctgttaaaggaagttgctttcactcatacaccaggtattaagtgcttactgtgtgtcaggtaccaagcatacaaatagtgttgaatcagagaggaggttcctgcctcatgacatagcatttaaaaattatgagataaaggtagtgaaaataatgtgagagtgcgtatctgcgatttggtagaggggttattgtccctttggattgggtggttagggaagactttctgaggaggccagtaggctggaaagagtttagaaattagtttggagggctaatcaggggtcacattctgttaagcctaataggctgtgatgaagaatttgatttttacgttaaggaagctgttataaggtagtttgtgcttaaataaattacttttaaagaaaccctaggacaaaataaacaagtcggatttcatatcgcctaagtctgatactaccttacctgtccatttatgtggctggttcacaaaggcactatgcctcagagatctcacatacagcttgtgtgtgcctatttttagttactcagttgcataagttctaattcttgctagcacattttataaaaccaaatgttaagatagagtatactgtaaagttcctaaaaaagatgtatgtaaatgcaaaaccatcagtttctcttgtataaagcacatgtggatagtgtttttgtttgtgcaggcatcattcagtttatgtattgtttagatatgtgtcagtgagaaatactaatcagctggtggtctagcaatacagtcaaagtaatgtaggctggatccgtgtaggaaatgttaataatgtacttaataatgtacttgtttttccagtattttacttgagtcatggcatatatttgagattatttctctgagtatggactttttctccctcgtttattccttttagggcaaaataatatgttggtaatagaattttgtataggtccacggtacctgtttagagagcttctaatggtatttactgtttgttaatatttatttttgttcagtttttctacttccaaaaagtggatattgattacttgttcatcaaattttcagtttttaaactattctgttatttgttcctgtgttttatgggcagaattattaagtgctgtgattatatcttacatacaaaaggaggcaggattacctagaggattactccatctctactaatagagaaaggacaaaaaagaaagtatgaaatctagttggatgtatgtagattggcttagtgaaaaaagattctctaaattccagatcctctgtcctttccttattcttttatctttctatatagaggttataagcagagtcatgccatgtggtttattctttttatcctttttatgaaaataaggttttctccaaataaaggtgaatatccatttcaacaagtttccactccaatttgctgtccccctcaaggattactgatataatactgattcttacctttccttttatatatgagtaattgggaatgagtatggaggtttcctatttttgttattcataactgagtttgttaaattgctagccctgtatatatttattatcatgagttggctgctgtgctggatagctgctatctgcacttctcactccagtcttttccctgctctggctccaagcagctggtctgtctggatatacaaatgggcttcttgtccctgctttctagttgggttcagctggtggggaacattttcagctgattgaaggaaaggaggagagagaggttaggatttttacttttcatgacttcttcctgtgggatttctgtagcctggccgcatccttccattgaagtttccagttcctatcaggcagctgacatttttctttcttcccctgctttactgccaatgggtagtgatatgccctgctgttactaaccctgggatataacactctcacttgtgatttccttacaacccacctatgcttcgtaacagtctccttattaaacttccttcaaattatccaaattgactgtgccatccatttctatagtaactgactgataaaatatgctttaacatgttttagattctgtcagtgtctgttatgattccaattatagagtggattaggactaagggaaaaaattatcaattttatgaatttattctgttgtctggtgtgattttatttttagttcttccataatatctggctttgagtattgccagtttattgaacacttaatatggcacagcccattatttgaagcattatggggaatccaaaagtaaatgagacacatgctccgtgattctactactaggcagtttggaatgagtttcctgtgagagctacaaaatgctagaagttcagaggagggagagtgctctgtcaagaccactatgattgtgtctgcagcaggaatgaagggagatctacagcttcctgtattttcctggtaagaccacccttcccagtcattgcttattttatcactccatagcccatcactgcaaaccacttaagagaccaggcccaaaagtaatataactaatacaattttttttgttgttttttgagacagtcttgctctgtcacccaggctggagtacagtggcacgatctcagctcactgcaccttctgcctcccgggctcaagcaattctcctgcctcagccttctgagtagctggaattacaggtgcatgccaccatgcccggcttatttttttgtgtgtgttcttagtagagacggggtttcaccatttcgtccaggctggtctttacctcctgaccccgcaaagtgctgggattatagacgtgagccactgcacctggccaaactaatactatttaaagtttatatacctgttcccagtacaaaacatatattaatttacttaactctaaacctccctatgaaataggttatattattatttgcattttacagataaatgttaacttgctcaagtcaaatagcagcatacagagttggaattcaaactcatgcagtctgattcccttgtccaagctcattaactaccataaccatcacattattctacaattagaattgattattcacctcccccaaaagagaccatcaaaaccaattccattgttgcatataattccttgttttaggtgtcattcttgctcctcagtgctgtttttagcccctcacccccacttttaatgtcaatagattttatcacttgctgcatcttcttgttgcagtcataccagtcggtctccctcattcagtatttatttatttatttagagacagggtctcactgtatgacacccaggatggagtagagtggtatgatcaagggtgactgcaacctctacttgccaggctcaggtgattctctcacctcagcctcccgagtagctgggactacacatgcaccaccatgctcagtgaatttttatattttttgtagagactgtattttgccatgttgcccaggctggtcttgaattcctgggctcaagcaatccatccgtttgggcctcgcaaagtgctgggattacaggagtgagccatcgtattcagccccctcattcattttaggtactgtttttattctcactagtgttaatcattttggcaattccagtatccacgtagatatctgcatggccctctgaattccttgacctccagtgatccttcatactactttagaccttttattgattgataactgtatcacctcccagatttcagtttcaagcatccagctctctgaccaccactgattctctcttcctggcttactctaatactggagccaacaattttgggacaatcatcagcatctctattccttcatttcactaaatccctttgttatccgtcttcctcctgatgtctttatttttcttagcttagattccatggtctgttaatataatcacctttttccaacttctgtcatattctgcttgattaaaccaatattctacctacttttacctaaatagccagataaagctggagaaaaaaagccttcggactagtttcactttatatattgatggccacaagtcttcagtgcttcctagtcagttcattctctcccttttttcccaaccttgaaacccccttttttcagttgatggtgtttattttagtaaaaaaccaaaacaagcagaaaagagactttatactctatcagcaaatctagatgcctgaaatagcaatgttagtagaatgttgggagcagaatgcaacctttcagggactaaactgtgagtaggtcataaggaattagagattgatgttttcccaggtgtgtcactgaaacactgtctgtgttaaatgaatcttaccccgtaataggcttactggctaaatttgggagatgctgaaagctgtgtatagtttgaatctctctttccctctctctctggtgttctgatacagaggcaaggaaagatgaataaaattacaggtagaaagtaagtttccatctggtggcctagatgttactaaagcattggttttcaaactttagcccacttcagaataacctggaggacttgataaaacagattgctgggttctacctagagggactgatttcacatgtcttgggttgctcctgaaaatttgcatttccaacaagttcttagttgacactgatgttgcttgctgatttacggaactgggaatcacatattgagagttacttcacttgagtaagaattcaactgtcaagagtgtcaagattggttaggattttgatctataaatataggaaatagctgctgtggggcaatataataggaaattagagccgattaataactttgagggactttgacagtgagacagtttgaatttgtagaggactcaagcagctatttttaatgacttttttctctagcagtgtgaccttccagagagcaggaacagaaccacagcagttagtaaacaattttgagggaatcctgcaggctgcttatgtcaaatagtttatcatcaagcactccatctttgctttgcgttacgagtgccaagatggcagctctatgatctgtctgcccttagcccatctgcttcattttatttatttatttgtatgcttattatttattcatttattgattttagttttaaaagtggtatgtggcagaggttttggaatatagtaaagtgtccatcaaatacagtcaatagtttcatggctttgggtaaataactaccctgtctcttgttttctcatttgggaagttttaaaatagaagaatgaaaaacttccaggcctccctttatgaatgtaactgataaatctttaaaaatcttaaagaattacattttgggagaatcattagttaggtttctgcctgaggagagtcccatgtagttctttgtaagtggctaaatattggacaagctgggtctcttaaaggtctgtagtatttctggcagtaagttgtactaatgttcctggatgtctgtacttctcaggcgttgccagtgaaatgttttcataatggattgtgccttactctagttctcactcgttttaactgtcacttccctaaatgactttatagtatctgtactgagcctggaataggaaggaaccacaagaaatatatatatagacagacagacacggagtctcactctgtcgtcaggctggagtgcagtggcgcaatctcggctcactgcaacctctgactcccgggttcaagcgattctcctgcttcagcttctggagtagctggggttacaggcatgcgccaccatgcccagctatttgttttttctgtatttttagtagaggtggggtttcaccatgttggccatgatggtctcgatctcctgacctcatgatccgcctgccttggcctcccatagtgctgggattacaggcgtgagccaccacgcccgacccacaagaaatgttttgaaacagatttggggacatgaataggaaaggagaagggcaagtcctttctcctaaccttttctcttatttctcccatacccagttcagtgagcaggtaagattgagaagtacgcttttccttccctgatttcttaaatacttgtcagggtttttgaaaccagatactatgctcttttcatagtgtcgtaattgcttattctttagaataatgtattttggaaactcgtggacttgtttttgataattttgctgaggaatagttgataacttggatatttaaactgataacgtgtacatacttaaagtgtacaatttgatgagttttgacatttgtatgtatcatgaaaccactaccacaataacaagatagcatatattttcattgtgcaaccctttgtaatgaatccactgatctgcttttcatcgctgtagactggtttacattaaaaatttaaatgaatggaaatatgcagtatatacgttttggtgggggggtgcacatgtttctttcagcataatcttgaggtttattcatgtttcttgtattaatggttttctccttttaattgctgaataatgttcttctttggatattctcccatttgtttattcacttgtttatgaacaattgggtgatttccagtttggggttattatcagtaaagctgctacaaatatttatgtacagtctgagtgtggaaaagtgcttttatttttcttgaataaatacctagaagtagaatggctacatcatatgctaggtctatgtttaactcttgagaaactgccaaatgttttccaaagtgcttacaccattttacattctaaagaattccggttgttccacattgttaccaacacatgatgcagtcacactttgttttcagcttttctagtagtatatgcatgtctgtcttgtggagtctcagtgtctttttttttttttttttttttttaaagacagagttttgctcttgtcgcccaggctggagtgcaatgacatgatcttggctcactgcaacctccccttcctgggttcaagccattcttctggactcagcctcctgagtagctggggattacagggcatgcaccactacgcctggctaatttttttgtatttttagtagagatggggtttcaccattttggccagtctagtcccgaactcctgacctcaggtgatccgcctgcacccggcctcagtgtcattttaatttgcattttatgcatgactaatgatagtgggctgctgatatctttggtgaagtgtttgttcagaccttttgcccctgctttaaacaagtgttggctgggcatggtggctcgcgcctgtaatcccagcactttgggaggctgaggcgggcagatcgcttgagctcatgagttcgagaccagcctgggcaacatggtgaaacaccatctctacaaaaaatacaaaaaattagccacctgtggtgctgcactcctgtagtcccagcttactcaggaggctgaagtgggaggatggcttgagcctgggaggcaataagctgagattgcaccactgcactccatcctgggtgatagagacagaccttttctcaaacaaacaaaaaccaaaacaagtgttgggttatctgtcttttataattgagttgtaggaattctttatatattccagtttcaagttcttatacattttacaaatacttttgatcagttggtgtcttgatttttgtactttttaagtttttttgaagaatagttttttattttgatgaagtctgctttatcagtttttctctttatagttctttttgtgctattttatttcatttctcttttggtttttctgaaagttaaatatctcagattctcattttttagctattggaccaaaaatgcataggagacagctataaagctaatagtgtgtttgccttatatttgtgtttattgttacaattttaaagtgtttatgattctagtatttttgtttgttctttttggttttttagacttgctaaagggcctgtgaaatagccattggttcagttcctttgttttgtaagggaactgagcaggttacatgactttgctaatggtgaagtttatgattatgccaagactgaaaagaccccaggtcctctgaaatcccacttcactcttcatttcccctttttaatgattttgttgctaaaattttactgcatactgcaacatattaaaaataaatttagttcctgtttattagtatcctcattgaaagcatattattaaaattattatgtagattagcttcctgaaagaatcatagtatccccttaaaatttcattaagtgaagatgttgaatttaacatatatttttttaattctttccaaaggtctgtaaacagatttggctaggattatttgatgatagatcttcagcaattccagacttcagggatccacaaaaagtgaaagagtttctacaagaaaagtatgaaaagaaaagatggtgagtgaagagtttgtatgtagaataaagcctccccaaatcacatattaactatgggtaaggttagtctgacacaatgaaggataaaagacagacagtgagaactagataggtatataattcattatcccttggctttttgttggtttggtttctgaaaacctttacttctactttatcttaactcatctgttcctggcagcaggctttttgttgtaataattaccaggaaagttagggattcttccttctaatcattccctatctctgttagcttctttaaatatgttttgccctacaaagcctccgttcttaaaaatcattaatttagcaagtatttactgagtcatatctttttttaatttattgagtttcatcttctgtatactaggcactatgctaaagctctggtgtagtaatccatctacttaattgtctgttgtagcctttgctcaaaatattttttcttttgacctaagaaatcagtttactttctggttaagaagggagcatttacttttccctaactaaatctatcagatgttaatttttaaaaattaattccaacaggttgtacatatagctagtaagccccttgctatggaatagggactatatctataaagctagtgttcagctactgagggttcttcatttttagctatatgagcacaatttaagttactaagactcattaactatgaacttttggttatttctttaatagtattgcatagtggatactttcatcttgggaggttaacaagatggggcagagagtcaaaatagagggaataaataatggggaagtaacgagcttcttgtttgcttgaggaactctgtttcaacccaagagaatctgttcagagcctgttttggtcctgagggaacatttgttgtggtttacagcagaggtctttaccttcattcaggagcacattagctctgacttgcatgctctatcaaaatttgtattcttactactttccaaaatagactacatttttcttttttttttggagactgagttttgcttttgtcacctaggctggagtgcaatggtgcgatctcggctcactgcaacccccgcctcctgggttcaagcaattctcatgcctcagcctcccaagtagctgggattacaggcacccaccaccacgcctggctaattttttgcatttttagtagagacagggtttcgccatgttggccaggctggtcttgaactcctgacctcaggtgatccacctgcctcagcctcccaaagtgctgggattacagttgtgagccactgtgcccggcctaaaatagactactttttgcaaggcaagattagtcagggctatattcagctgtactagaagacatcaagtatgaaaatagattaaaatacaccagtaaaatttaagttcaggaaagaagaaaatactagaaggtgggttggtagtaaaaatatggtagcataaatgattcttttaaaatgaaaggtataattatccttttatcattttggttctgaatttcctagacattctaccctgtaggaaagactgttctccttacatagccctaacctagttttgttttctcagccgtgttacttttaccaattcagaaagtgagtttggttagggattagtttatggtcagctctagctatcaacagaaaagtgagtgtgagtaacagttggtagaattaaaatcatagatccttacccccacatttataacagtaatgtattattcattcaaactataacgcaaatacctagaaacctcaaataattacagtttatgttattttttttctttcctgagaaacaggataataagagttatacaaatagagacttcaagtggtgggacaggtgaccatcattaagagggccaggacctgtatgtttttaatccagactgctgcacacctgtaacatacagctagcaagcagtgaaattggtttctaacatggaataagcactatccagatgcagcatctctaaaaatactcactgtaactatacttaaaacagtgatgatggtgttacccaaagggattttgaaactgttcttttgaccagttctcaaaatcactttctgtgttatactagaagacatcaggtatgaaaatagattaaaatacaccagtaaaatttaagttcgggaaagaagaaaatcctagaaggtgggttgatagtaaaaatatggtagcatattactttgccaggtgagtcttttgaaccaataactatcatttgattttatcctttgataagacttggctatactgaagaatttgtattagtagtatgctaaattatgggaaaatataacttcttgtattcattctcatacatcttttatctctcccatttacttgaaagcagttgtttgtgattattatgtagtttagtgacagtgaacacttagttaacacgtataccaggaattgttctcagtgctttacaaatgttaacttgtttaaacctaggcaactctgcctctccattttataaatgaaaaaaatggaagcacaaagagttgaagtattaatagtttgcccaaggtttcacagccatttagtggtagagctgggatttgaactcttgtctctggaacaggtgctcttaagcatggttttccttctttcctcacctacttcatatggggaataagaaggagggtaggacaaaacccagaattacaaagagcaaaagctctcacataatcccacacctagaggtcaggattgcctatgtttggacattattatatccttgctacctctcctttcttgactcgcctcctcacataaatcatgtgtttatatgactggaatcaaatctgaaagacctgtgaagtttcctctttccatgtcaaagcagagtagctatgagtattgtattatcgtaaattttttttccttgatagatgttgggtttgtttcccagtttttgtgaaattataaagagaggactgtggttaacatccatgtgtacatgcatctgtatacgcttaccaattcttaaggatgtttctggaagtggcacttctggtgcacaaagcacacctatttatatattttagtaggtagcaataaaaaattgtaaagttcacacttagctcataggtgaataaaaccttaatttgcatttttgtcaggttaaaagtgttttcatttttgtgtctcctgtcttctgtgaattgcttcttttgttcatttaaaatgggatgatcttattcttacagatgtaataagcctttatattttaggctgttaactgtaatattacaaatgttttcctacctcatctttcttcaaatgttatttagatcttaagataattttaaaaattatagtatgaactattcatggtgatgactaattgtaggtcctctgtttaaaaaaagcagttatttcttatattgtacttaatatcttagaaaaaccataaataagtaattgaaacaagttttgtggttagtcttctcttttctctgagtatttcaaatatttaatgggtgtagtcttaagctgtcgttccttttttaaaaaatatgcaaagttattctgtgtgagagggttttcagataagattaatggtgaaacaatcttgtacaaagttagaattaagcttatcattttttgatatagaattacctacatttttttttagttaactgttttttacatgttttaggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcaggtgagtagtctttgaatctttgtagggaattcgacttaaagagggcttgagtatcaagaatttgagaattgtttaagacagcagcataatcttgtatgccagtagcattatgttccaatggtttgttatacattaagaaattgttggttaagtggttgaaatgtatatatacttgttctttttgctattgctaatatgagtttctttgacttctctgcaactttgtaaaggtgagttatacaggaatgttgctatagctatatatatgtgtgtgtgtgtatacatgtatatatcatgtgttatacaatttgtaaaacatgaatctatggtgaccatcagagttagaatgtatagtctctttgatacacttttctaggaagggatttctttagtagtagagttttcccacatgtgtgattgtgaagcatgttgatcattgaaacacaagggactttgcattataccttattcttaaaaatgaacaaaatgggaatatttttcataagttgctaccctaaagtttgtcttctacactttattatagttgatggggctgtgacagatctgttactgtgtggcattgcagcctctatcctatacaagaaatggttcagaggcgtagtactgtggattaaatcctgccctttttgatgacacatactaagacatttagataaatttctctgttttcacaaaagattgagtgaaaaatgagaaaggttaactcagcatactgtaactcttcgtatgtataagtgtgttttaagtttgcagatagttttgtataaagattttgcagatccgactggaatatctttatagttaatatgtggtttgtagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcaggtaagtgttttttcccaacagcttttgctggggatgcatataaaacaccaagaaacatcaattctttatcacactttgaggatcagtaaacattttttgttgaaaatgttttgtcacttgtaactgttgagctgtaatatgtaaccatataattgtgttgctttttaatcacagaagagattatatttaatgtcggttggcatgacctctttccgtggaaaaatggggaaaggatgtaatgtctattttttattcctttatgaaattgaaaatattcaaaagtaattggatactctaacgtttatgtgctaatcactcatggctaatcttgtttcatttgtcattccactcactgtcatattattttgaagcaaattttagacatagtattagtttatccttaaatattgtgtatatcaatctataaaacatactttttttgttaaatataaccacattagtagcatcattccctaaataatagtagtaataataattcattaggattcaaatgttcattatagttcagatttttccatacacatacatacgtacatatgtacatacatgcatatatacatacatacagtttgtttgaatcagattttcaacaaggtccacagactgcaattgtgagacatgtctcttaggtctcttagttcataagatttttcctgtattccttctttttcctcctctgtaattagtgaagaaatttgcttatttgtcctatacagttttcagtagtctgaattagttgattgcaccactatggtgccctgtaacaagttcctatgttctatttcttgttattaggttgttggatccagagacttaatcagttacaggttcttcctattaggaggatgggtggctggggatattcttactacttgggatttaagaggcatgtaattttggattgtgtttttataatgttagctcttggtgctcagtacccgagtccattgcataaaaataatgatgttctgaatttattccttcacttattagctgaaatactatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaactcctgaccttaagtgatctaccccaccttggcctcccaaagtgctgggattacaggcatgagccactgtgcccagcctctttttttttttttttttttttgagatggagtctcactcccttgttcacactggtgtgcagtggcacaatcttggcttaccgcaacctctgcctcccgggttcagccaattctcctgcctcagcctcctgagtaactgggatcacaggcgcccgccaccactcccggctgttttttgtgttttttagtaaagatggggtttcaccatgttgaccaggctggtctcgaactcctgacctcaggtgttccacctgccttggcctcccaaagtactgggattacaggtgtgagccactctgcccggccctaaagatacttttttgatagaactcttgtggtctttgaatggccttttctcccttccttattctcagatttaacatatttgttacaaacatgtttaatgcatgtcaccagaaattgggatttatggagttttattttgttaacaagcatgcaaaccttgcagaggtacttaggttaggtaatatttaaaaattgattattgaagtatagatttggtcacttgtatctctccttaattgtaatagcaatagtctgatagggaagtggcataatgtagtgaaaagaacctgggctttggagttgggacaacctgggttcagatgctggctttcttgcttattatctgtgtaactttgggcaaattacctaacatttctaagttttctattctataaattgtctttgataagtggcaaggttcaagtgagatgatgcatttaagtggtttaccatctaaaaggtacaataaacattgtttgtcttctctcttttatacacacttcatatatatgtacatacgtatacacatatacacttatgtatgtatgtttgtatgtttacatgcatttaagaaaaaggatcatactttatgacaagtttttatgctgttttaatgtttcagtcttagttaagattccacaaatggtttagattcatttcctaacagcttggtgatttcttgagtctttacagttgcttctttatgcttaaacagtgtaaaagcatacatagtatttgtgttggaaatgcgtatggaatctattttggatgccagtaagctgtgatgtttatatcatggaaagtttaccagtctgcattttgagtgattaaataagtatcaaaccaaatgtagaacattaatttaggaatttagtcattttatagctttattttgataatttaaaactttgctttatattattttggcacatgtgtatgaggtattggctaaagcttactcttttatttgtcatagattatgtaagttaaattatggacaagaaaaattcaagactgtatctttgtaaaagatgtatttcacaattttatgagcataacagaatccagtgctgatagaatggacttcctgtttgtattttagaacttactttgccttattttacttacctgtgagattgtgatggtttttcgttttctttcaatttgatgacctggcttctttttggataatgataatatgaagtatattatacataatcacactccaaaatatgctgtttgggatagtttgaaaaattgtagaaaaacttctctccagccacatttctttctagcaagcaataagggaaccttttgttttaaatattaataaaaacattttctaaggacatgctttagaaggaaactggcgtaatttttatatgtctcatttgtgtatttgctttaaaaaggagtcctaggatgacatggatctcttttttcaggaaaggttgtactgagaaggataagaaattttgggtttcttttgcttaagttgttggagttgtggtagatttcccttctcctgtgttacctgagctgcaaaatcccagaaaacatggagaacctctttccccgtaaccctccagataagaagcgatttcccccctgaccagataaggaccccaactctcttttttcacctcttgcgtttgagtgctggtaaaaagagttggtgggagagccaataaatagagtaaaacttgtgtaatttatgaatatattctggttttatctccattttaggattattgaaatgtaatgcaaaattactgataaccaccaaattcttttgtaaatttgcaacttatttcttgttccctttgtttttctctctttaaatgcagtttgtgagtcttcacaggtaatgttggacttttctttgtagccctattggccaaaaatggttagacaagtcactgcaactctacagactaatttgtaccatggttgcactaatactttcaacagctcccttaaaatgcactttgaaaacaatagccatcatttaattgtaggatatgcagtaaaggaaaagaatcttatattttgatcagattgatagaaagtggttaatcttaactgttttgttccttgtctgaagaaagaatgaaatagctacatgtaggctgtgagtcaggctgcctgagaggagttgttttttagtctgaagttcttaattacaaatgactgctcagattaccttttttttctttactttatttgacttttggtttcattacaggagaataaaatgtatatgtctgttacaagaagaaactactgaattactcatttatttttccttctactatggttgataccatcttttgacgttttgccttggagtagtttttagttaaatactaggtcatggtttaactgaaatgtctttttccagagcctttccaagcattcagaatccttagttttccatatatagttcagaaagtcattgattgccaatttcttctcatcctgatattcttgttaattttaaaaaaaattaggtgaaaattttatcctgaacagtttgatacgactgatggaaccattaatggcaaatgataattattcacatatgccagtctggttcattagcattgttttgtagggaaactttttcttttgtagataatttagtgtgacttaaaagccagaagcctttagtcttcatgtgagcattcaggctgaggtatagtatttgtggatgtgtgttgctgggtggggtcattattgggttcagaaaaagtcatcttctacagaaagacgcatgaagctagaaataaaattcacctactgaatttggttattttgcctgatgataaacatcatatcccaaaacctgtgcactgtaaactgtaattgatttttgtcacattctatactgtaggatctaaacccaactgccttgcaactcaggtaacacaaatgagtagtataatgttgtgtttaaagaactatggtgccctttttaaaggggatgttctaatctgttaccacatggaaataggggtttaggatactagatatattgattttttttttttaataagagaagctagaagtctttttgtttattgtgaagtgccctctttttaaatgttgggaattcatgggaaataatgttaaatactatacagatgaaacaaagcatatctgtcagatgaatttgctgagggctgctagtttgcgtcctatgatctatcttcctgtctcatgaatatgtgtttttctttgaagaggaatgacaactattagcaagactcaggctcattaatttggggtcttaagttccacactaagttgactcctttgtactttttgaaatacgattattcaagaaacagctttaccattgtgttacattctgcttagcttggatttctttgtacagagattgcctgagtgtccagacagtaatttttgtattactgaatttattagtgttgaatttgcaaagttgtgttttccaaagtttcattctgcagcacttataatcgattgttgaagatagtgaatagatcagtacctagaagtaaaaatggatacaagtactacaaagtcctgtcttgcctatttaataggtattctattaatgtttggggctctgaattatatgctataatttctatgctagcattcattgtttcttaaattttaatgagtttaaaattgcaggcttctaatagaatatgaatatcttcaatttatttggtgatcttgtcctttttttaaatttttatatatgaccatggtgagacatttgtaaacttaaaaaaagctctattaattaaaccatttttgtattattattttaagtatttcagttattattcagattcacatagttgattaccatttttaatcagtgaatttttccaggatgttttctacatctttgtctgctttcctataactcagtactgtaactcagtactctgaaatagtttcctttgttaatagagtcacttttatagtactgtgcttgaggtcatatacagagtattgtgtccaaatttatcattgcacaaagtgtttttggaaattcttggttactccttagtaaattacctgtaattgggttaaatgctggtagggtttaaaatctgattgctaagtgaattctctataaagtgagttttgatacatagaaacttttcatataattcttaaactcatgtgtcatgtattttcatttatagttttcatattcattaacatatgttgttccttaccatttacagctcagaattctgcaaatgcagattttgcaaactttgatgcatttggacagtctagtggttcgagtaattttggaggtttccccacagcaagtcactctccttttcagccccaaactacaggtagagcttctccagcattgtgcttaaatgtttactttacaaaacaaaactctctaaatgtagttttgaaaaattagtctaaacttaaattctgtaattatctgactttaaaatggttctatcttcaaaagctctggggaaacctgaactctttatttttttctatgttcatttgtttttctgcattatttggtatattgtctgtttgacaacatccattctcctccttttcctgcgcatgaatcttccttatatctaccatgcacacaggacagaggcatgacactactataagtatttctctctctctgtctcttttttttttttttttggcaatcctcctgcctcaggatggaatacaggcacatgccaccactcccagctaaattttttttttttttttggtagcagctgggtctcactatgttgcccaggctggtcttgaactcctggcctcaagttatcctcctgccttgacctcccacagtgctgggattacaggtgtgagccactgtgcccagccagtactataagttttttaaggttcatagaatccattgatttaggctgacattatacctcttaataaaggaagctggttgcttctgtagagctaaaaatgtaagtaattttcggggcaacaagcctgagaaaaatttttatatgtttattagacaagagtagattaatgatcacttcagtcaaacttggaaatagttttctgtgcaggaattggtgtttaaacattgaatactctttccataaattgtgctgttttcgtaaactcatggaacccttatttagatttttggctgattacttttctttcaacttttaactctgtgtattgtcttaaagccttttctttcaattttcttttttgttttttctttaactttcatcatttacataatttctggctgtccagcatttagaatgctttcatctagctgcagttttggtgaatttacttcagcttttcctcttcaggctacccacagtaagttctgttgtcaagtaggcatcttatactaatttgtatatttttgctatacttcaagggtttttccagttatagattgttaataattctttagtgataatccttcataaaaatctcttccaactctatttattaaactcagagttagagaacacaatagtagacaatcaaagagttacttggtttaataataatttgaaataatattctttatataaattttgaaagtttagtatgtactttgtttgccagctccttgtaacaggtcacaatattttacatacaaacatatattacttacctttaattgaaaccaccatgatttaactcttgaaagaaatttgatcagtgtatattttttttagaatgtataaaaacctgcttgatagaaagtgttcgtgtttttttaatagaagttcatgcattctgttttaaaattatctgtagttgtcttttctatcactttaatatataactgtgtatatatactgttttgatttctgaaactaaagtttagaaataaagaactaatatcccaaaaatgtaggatcaaaagcatagaatgaaatatactggttttagtcttttgatagtactttaaggaggtctctataatagagaacagattttaaagatggaacaggatatatataatagtggccattaggtgaattgtggtttataaagtcaaaaattgctataatgtattatgtactgtaattttaatgccttgaactatatggtacggcatgattttacagtggacatcttgatattgtatacacattaaactattatgtggaattaaatagtagctcttcaagtgaagtaagtataaatgtcaacgaccatcttttaaggaattttggatcaccgtaacacattttacacattgttaatcgctacccctgggattgtttaaactgtttcgtcatggagccacaaaagtttgaaatcctcctagtaagatactttgcatcttgtttgcagtctgttcagggagaactagtgaaaggctgtagtatatttggactagaaagtaactgaatctcaaaccaggtagtgtggagataccccctccatgaattacattcttcattccagggtaggtaatacacagaaacatgttactttacctgttgccaaggcctttgaaaaatctacttttacaaaattggaaaacgtcacttgtagtcaaaagccattgccagtcattgattttaatgttgtaagattgcttataggacatttaatttaggaagaaatgatcatacagtctatgagagggtactaggaaaagcttagaaatttcaagtgctctgtttattctgttacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcggacaaatatgcagcacttgctaatttagacaatatcttcagtgccgggcaaggtatcaagctttaagcaaaacaaatacaaatttgtgttaaacagtgctcttaatttggttgtatttattaaaatctgaacatgctacacttttctcagttgttgtatagaaattttgtctgcactgtcattttgagtaaaatgttcacttgacacattttagacctgaaatatcaactacaaaactgaagacatagggactgatttgtaaactttcagtcttactagttgagaaaaattttattttgtcctagaaggcgtgctttacttttctttggctataaagagccaagaaaccccattggcagagctgaatggaggattatttggtggtttctgtaatatatttacttcgaacaattttccgttaacatcttggtgggttttttatatttaaaaaaaaaaattcatgaattttacagtatagtcttgtatccagttttatcttaaggctagtagcctctacaaatgcatgtggcactggtgaatagcaggtgtgtgttgctaaatggaattctccattctgatctctgggcctgttttcctcctctccaaaatgaggataattctaagcattaaactcatggagttgtgttctaagtattattgcatgttaaggcatatagaacagtgcctagcacatagtaagtcctcaataaatgtttcccgttattaccatctctaatttttttgtggagaatgctggggaaatgatgctattgatagactgttcacattaggtctagcattatatgaatttatatgttcatgtgaacaagatccacccgtcttggagatgttaacgtaagagcacttgagagtttctttcttatgcataatccagacaaatttttttggtacagagtgttaatttttgttaagagacatattctgtctttatcacagtggtatgtataacaactaatcctgtccagtatggtccaggttatttattagattaatgatttggaatcctgcttaactctaaatccattttaagtttacccgtgtttcatggcaaatgtggttgataagttgaaagtgtaactttaaatttttggtgtaacttgattttgttcgttcccaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcaggtaccttgtcttagctagccctcctgctttgtgttttatcttttttttccaactttgaataatcaattaaaaaatgactgtttcaaggtataattttaaaattcttggatatttttgtaaatttgaggaatttgaatttaaatgctaattaaaatataatccttgaataattgccataattttatcttttcattgaatcagacgttttgttatgttctgtccttgaacactaaaccgtatttgagagcatgtacacatctcaaaatggacagttccttacagattgtactcagcagagaatccatttagtagtcaaataatatactttaaaaatagtttttagtcatgatgattaaacagtgaaagtcccatattataggcttagttgtaaatacagatttttagaagtgtttgcaccaaagcccaaaatcaattctgtatctcttcagtgtcatcctcatatttacaaataagcacatctgctgttatgttcatatatatctgttagaattcttggcagtaggaagtctaacacattttaggacattacacttgtaaaaaacttttctagtctttattttagagttgcggaaatagtctcagaaatacaagagatttacctataacaatgttttattcatctctgttttccaatcctgtggattgtatttactaatttctttagttatcctggtagcttattttcctttagcatcttttctagaaagaaatgttaggattgtaacacttccggaaacataaagtctggaaacatactttatatataatacatgatttattgatattacattacagtacatcaggggttcacaaactgtggtccatggaatgtttggggtacctgagaccctttcatggggtctgtgaggttaaaactttctttataataattctgagagattgtttaccttttcattaattgatatttgcattgatggtgtgaaaacaatggcaagtaaaacttgctggtgtctttttatttttttttaatactttaagttctagggtacatgtgcacaacgtgcaggtttgttacataggtatacatgtgccatgttggtttgctgcacccatcaactcatcatttacattaggtatttctcctaatgctatccctcccccagccccccacccccgacaggcccccaagtgtgatgtttcccaccctgtgtccatgtgttgttcttgttgttcaactcacacctatgagtgaaaacatgcagtgtttggttttctgtccttgtgatatagtttgcttagaataatggtttttgctggtgttttaacatgaatattaagatagtggcaccaaactgtactagtcgttacaatagtcatattccttcccactacacattcagttttacttgtattttttatttttttatgatgattcttaatgaagcagtaacaattgtttattttattacatctttacacttaaatgtcttaattttctttgtgttgatactgatgctgtgatacacgatatgttcattattttatggctaccctgtaaatcgttactttcttttttttttaagaaaaaaaatgaactctttcaatatttgttctcagcaatgtttttggaacagtgccagtggttgcttctgcacagacacagcctgcttcatcaagtgtgcctgctccatttggaggtatgtgcttctggtatatacactggtttttacaaagaacccaaatatatattgtgtagcattttcttaggagtcaaagcaatgatttgttatcagaatccttgagttttctgtcttgataaatatagtgaaataatttaaatcttaaatacaaaatgtattaggattttatagtgtattttataattttttaaagctacgccttccacaaatccatttgttgctgctgctggtccttctgtggcatcttctacaaacccatttcagaccaatgccagaggagcaacaggtaagaaaaagagacagtggaacagtaagttttggggaagacatttatcaacaaagacaccatgtgaagaacaccagaaaatggggcctctttcttagtgaagtgaatggcaatggatagaagagtttgtccataaagacaaattctagctgaaagttcataaaatcctggaatttaacagttgagagggaccttagaaattatctagtgtctgccctttccagttaaagctttcatttttcaggtagggaagcccagacatggagatgagactccacagaacgtttatgacagagataggacttgaacagagcaatttagatgtatttggtggtctggtttcagaattactggttgtcactcatgcagtcttaatggaaccattttatgagaagtttttattttccctatgagattgcatcagatgactttactacatgaattcttaattattaggtctttttctagtgaatatctctttcaggtgttaacattttttaagttgtggaaacttgattcagtcgtgggtataatactgaatattttctcttttgataattttttcccttaattctctttgttgtctccattttattttttgattcatactgtaagccattcacatctttctcatgttatacctctgatttttgtcgtattaccttaaacaccagagatatttgccagtatcttggaatgtcagcaggtgcatttggtatggctgggtatccattaaatctagagtttgtatgctttgtttttgtgtatatgtcacaataatttagaactaaagcctaaactccagttatagcaaatgttgatatgaactcttgagagattaggtacttgtaacattttaatcaaaccattaagaattactagtttttagtaaatctctttgtcattgacaagattaagaatcacagtattaggagtttgagctgtaactattttcttttcacataaatgtcttcacttatactctgttggtaagtagcataatagatgtttgataagtattggaatttcacacaaaatttaactttaaaaaaagtttaattcaagtgtacctaatgaatgattgttttaaatttccatttgtacaatttatcaggtgtgtgatatgtgcagtgtttctgtttcttagcatactgttttgattttgtggactgagtttgtaaaatgtctcatgatacaatgggtttttgtacattgcctcatttaatccactcagctgtcatcaaataaatattttaattgtgtgacagctgagggaacaggcccagaaaagttaattgaacatattttgagtacagccagccaaacttgtgttcgaattctgatttatagttacttgcaggttgaccataagaaagccttttgaattttgttcttttaatgaatggggtaagaatgatagggggatgttcaaacatttattgtgataaagttgttcacaagatgctattgagatatttatagatattataacttcacttaagaactgatgaatggaaactcaaattatgttttgactgagcctaatcatgttgacctgacttctctgagccttcatgttgtccctctctatagaatgtgaacaatattctcttgctggcaggtttgttgtaaaattagatgatgcacatttaccctgtatggtctttgcgttacagcatatgctcagtaaatcagacctattattttcctttcatgattgtacctctgagttggttctatcattagagttaagggcctttttttgcttattttatttagagtatgcaagttttgtaaaagttgaagttctacataggatataaaataatataaaatgtacaacgtatgtgcagatgatataagataattctagtattaagtaacaaaaatttattagaaaggtaaaacgacagtgtccacaaatgtttatttcaaggtaatacattttttccattataagtcattttgaatttatcacgttggtcacctttattagattattattgaattgaccaaatcacaagcattaactgcatatgtttctattgaagctgaaatataaacaatacttcgacagatgcactacgcttaagaatttccagtgttttataccatcaaagttaatattatttaagaattttttgttgccttcaaatacattaacactggccaggcacagtggctcatgcctgtaatcccagcactttgggaggccaaggcgggtggatcacctgaggccaagagtttgagaccagcctggccaacatggtaagaccctgtctctactaaaaatgcaaaaattagccaggtgcggtggtacgtgcctgtagtcccagctacttgggaggctgaggcaggagaatcgcttgaaccagggaaatggagtttgcagtgagctgagatcatgccactggactccagcctgggcgacagagcaagactttgtttcaaaaaaaacaaaaaacacatgttaacactgtgaaattatattttgaggtaccctttgatcctagcactttgggatgccgaggtaggtgggttgcttgaagcccaggagttttgagagcagcctgggcaacatggcgaaccccgtttctacaaaaaataaatggtggcagacacctggagtccttcctagctactcaggaggctgaggtgggaggattacctgagcctaggaggtcgaaattacagtgaactgtgattgcgccaccacacttcagcctagctgacagagtgagacttctagctcacaaaaaaaaaaaaaaaaaaaaggaggtacccttattgcataatagttctatgtgaaattcggaaagttttatcagtatatttctctttttgtttgttggtttgttttagacagattctcactctgtcacccagactggagtgcagtggcttaatctttgctcactgcagcctctacctcccggattcaagcgattctcatgactcagcctcctgagtagctgggattacaggtgcgtgccaccatacccggctaatttttgtatttttagtagagatggggttttgccatgttgaccagactggtcttgaactcctggcctcaaatgatctgcctgcctcggcctcccaaagtgctgggattacaggtgtgagcgactgcacttggatcattcttaaaatgatgtttaaataatcattttttctggatttataaaactttggggctttagttttttttttttttactttaagttctagagtacatgtgcataacatgcaggtttgttacatatgtatacatgtaccatgttggtgtgctgcacccattaactcgtcatttacattaggtatgtctcctaatggtatccctcccccactctacccgaccccaagacaggcgccggtgtgtgatgttccccaccttgtgtccaagtgttctcattgttcagttcccacctatgagttagaacatgtggtgtttggttttctgtccttgcgatagtttgctcagaatgatggtttccagcttcatccgtgtgcctacaaaggacatgaactcatccttttttatggctgcatagtattccatggtgtatatgtaccacattttcttaatccagtctgtcattgatggacatttgggttggttccacgtctttgctatcgtgaatagtgccgcagtaaacgtacgtgtgcatgtgtctttatagcagcatgatttataatcctttgggtatatacccagtaatgggatggttgggtcaaatggtatttctagttctagatccctggggaatcgccacactgtcttccacaatggttgaactagtttacactcccaccagcagtgtaaaagtgttcctgtttctccacatcctctccagcatctgttgtttcctgactttttaatgatcaccattctaacttgtgtgagatagtatctcattgtagttttggtttgcatttctctgatggccagtgatgaagagcatttcttcatgtgtctgttggctgcataaatgttgtcttttgagaagtgtctgttcatatccttcgcccactttttgatagggttgtttgattttttttcttgtaaatttaagttctttgtagattctggatattagccctttgtcagatgggtagattgcagaaattttctcccattctgtaggttgcctgttcactctgatggtggtttcttttgctgtgcagaagctctttggtttaattagatctcatttgtctattttggcttttgttgccattgcttttggtgttttagtcacgaagtccttgcccattcctgtgtcctgaatggtattgcctaggtattcttctagggtttttatggttttaggtctaacacttaagtctttaatccatcttgaattaatttttgtacaaggtgtaaggaagggatccaatttcagctttctacatgtggctagccagttttcccagcaccgtttcttaaatagtgaatccttttcccatttcttgtttttgtcaggtttgtcaaagatcagatggttgtagatgtgtggtattatttctgagggctctgttctgttccattggtctatatatttgttttggtaccagtaccatgctgttttggttactgtagccttgtagtatagttttaaagtcaggtagcgtgatgtctccaactttgttctttttgcttaggattgtctaggcaatgcaggctcttttttggttccatatgaactttcaagtagttttttccaattctgtgaagaaagtcattggtagcttgatggggatggcattgaatctataaattaccttgggcagtatggccattttcacgatattgattcttcctatccatgagcatggaatgttcttccatttgtttgtgtcctcttttatttcattgagcagtggtttgtagttctccttgaagaggtccttcacatcccttgtaagttagattcctaagtattttattctctttgtagcaattgtgaatgggagttcactcatgatttggctctctgtctgttattggtgtataggaatacttgtgatttttgcacattgattttgtatcctgagactttgggctgagatgagggggttttcgaaatatacaatcatgtcatctgcaaacagggacaatttgacttcctcttttcctaattgaatacccgttatttttttctcttgcctgattgccctggccagaagttccaacactatgttgaataggagtggtgagagagggcatacctgtcatgtgccagttttcaaagggaatgcttccagtttttgcccattcagtatgatattggctgtgggttcgtcataaatagctcttattattttgaggtatgttccatcaatacctagtttattgggagtttttagcatgaagggctgttgaattttgtcaaaggccttttctgcatctattgagatactcgtggttttagcctttggttctgtgtatatgatggattatgtttattgatttgcatatgttgaaccagccttgcatcccaggggtgaagccagcttgatcatggtggataagctttttgatgtgctgctggatttggtttgccagtattttattgaggatttttacatcgatgttcatcagggatattggtctaaaattctctttttttgttgtgcctttgccaggctttggtatcaggatgatgctggcctcataaaatgagttagggaggattccctctttttctattgattggaagtttcagaaggaatggaaccagctcctctttgtacctctggtagaatttggctgtcaatctgtctggtcctggactttttttggttggtagactgctattgcctcaatttcagagcctgttattggtctattcagggattcaacttcatcctggtttagtcttgagagggtgtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtggcgcgatcttggctcactgcaggctccgcctcctgggttcacgccattctcctgcctcagccttcccagtagcttggactacaggcacccaccaccacacccggctaattttttgtatttttagtagagacgggatttcaccttgttagccaggatggtgtcgatctcctgacctcgtcatctgcctgtcttggcctcccaaagtcagtctgtgtcttttaattggggcatttagcccatttacatttaaggttaatattgttatgtgtgaatttgatcctgtcattatgatgttagctggttattttgctcattagttgatgcagtttcttcctagcatcgatggtctttacagtttggcatgtttttgcagtgactggtaccggttgttctttctatgtttagtacttccttcaggagctcttgtaaggcaggcctggtggtgacagaatctctcagcatttgcttgtctgtaaaggattttatttctccttcacttatgaagcttagtttggctggatatgaaattctgggttgaaaattcttttttttaagaatgttgaatattggccaccactcttttctggcttgtagagtttctgctgagagatcccctgttagtctaatgggcttccttttgtgggtagcccgacctttctctctggctgcccttaacattttttccttcatttcaagcttggtgaatctgacaattatgtatcttggcgttgctgttctcagggattatctttgtggtgttctctgtatttcctgaatttgaaggttggcttgccttgctatattggggaagttctcctggataatatcctgcagagtgttttccaacttggttccattctccccgtcactttcaggtataccaatcagacgtagatttggtcttttcacatagtcccgtagttcttggaggctttgtttgtttctttttactcttttttctctaaacgtctcttctcactttatttcattcatttgatgttcagtcactggtaccctttcttccacttgattgaatcagctactgaagcttgtgtatgcttcacatagttcttgtgccatggttttcagctccatcaggtcatttaagatcttccctacgctgtttattttggtttgccattcgtctaatctttcttcaaggtttttagcttccttgcgataggtttgaacatcctcctttagctcggagaagtttgttattaccgatcttctcaagcctacttctgtcagttcgtctaaagtcattctctgtccagctttgttccattgctggcgaggagctgcagtcctttggaggagaagaggcactctggtttttagaattttcagcctttctgctctggtttctccccatctttgtggttttatctacctttggtctttgatgatggtgacctacagatggggttttggtgtgggtgtccttttttttgatgttgatgctactcctttctttttgttacttttccttcaaacagtcaggaccctcagctgcaggtctgttggagtttgctggtggtccactccagaccctgtttgcctgggtatcaccagcggaggctgcagaacagcaaatattgcaaaacagcaaatgttgctgcctgatccttcctctggaagcttcgtctcagaggggcacctggctgtatgaggtgtcaatcggcccctactgggaggtgtctcccagttaggctactgcgggggtcagggacccacttgaggaggcagtctggccattctcagatctcagactccatgctgggagaaccattgctctctacaaagctgtcagacagagacgtttaagtctccagaagtttctgctgccttttttcagctatgccctgcccccagtggtggagtttatagaggcaggcaggccttgttgagctgcagtgggttccacctagttcaagcttcctggccactttgtttaccaagtcaagcctcagtaatggcgggcgcccctcccccagccttgctgccgcctcgcagttcaatcaagactgctgtgctagcagtgagcaaggctccatgggtgtgggacctgctgagccaggcgcgggatataatcttctggtgtgccgtttgctaagacctttggcaaagtgcagtattagggcgggagtgtcccgattttccaggtaccgtctgtcacagcttctgttggctaggaaagggaattccctgaccccttgcacttcccgggtgaggtgatgccccgccttgcttcggcccacactccgtgggctacacccactgtccaaccagtcccagtgagatgaacccagtacctcagttggaaatgcagaaatcacccttcttctgcgtcactcacgctgggagctgtagactggagctgttcctattctgccatcttggaactcccttctggggctgtagctttttaaaaaactgtaatattacatagtaactctcattaggagattagcctattgtggcctaattttcagattctatgatatttagtgtttttcccccctcagagcccttaaatctaattaatagaggttaaaataatttttaaatagtaggaaatttttataactcttaggtctctcctttgtcactgaatggatagtcattatttcctaccatttattttaatgaatgaatggtttcaaagattttttttccctaaggaaaggtacttaccaaaatgcagagcttattggatggcatctggccctcagatctttgtttattacctaggtggaaaccaatttgctaagattaatgaatttgccttaaaggttcaaaattcagtaatggctgatctgatattaatacccagaatgcttctgaaccaacactgtttttgttccagtacagttgcctccatatttatacttcagtttcacattgatgaaacatacacaaattaacattatgcactattccttatatctaaatacttagtaggctcacttcacttgcctagcatactcaggaagtgaggattaatacaaaaaagggttggaggtagctgagcaaaagcaaagaaaaaaccctaagtagaaagttaccttgggctgtgaaggatatattttgtttatagaattgctgctgatttgctctccttgtgctctttccctctcaatttactcttaatatttggacatctctaatatttaataatctacaattggtattttaaaaaggagccagaaatgaaaattgttgccaatgtggtaatcaaaacaagaaagacaggaaagttgtaaaaattaacacaacagaaaaattaagcttaatagcagtctggagaaaatatttgcaaatcctacatctgataagggacttgtattcagaatgtgcaaagaactcgtaacgactaaataataaaaagacaccccaattaaaaagtgagcaaaatatttgaatagacatttctctaagaaggtatacagatggccaataaaagaaaagacagtgatgaacaatgtaaggaggtagagaaaatagaaacctcgtatattgcttgtgggaatataaaatggtacaaccccttggaaaacattttggcagttcctcaaaatggtcatcatggagttaccatataacctaacagagtgccactattaggaatataccaaagaggaatgaaaacatagatctgcacaaaaatttgtacacaaatgttcataccatcagtatttatcatcgctaagaagtagaaacaacccaagtgcccgtcaactgatgaaaccaaatgtcgaatagtcatacaatgacaaattacttgataataaaaagtgatgaagcattgatacatgctacaacatggatgaaccttgaaaacattctgctgagcagaagaaactcgtcacaaaaggccacatatttgtggtggccatttgtatgaaatgtccagaattggaaagaaaaagtagatcaatgattgccagggggtagggttttagtagtggtggggcagcatgggaagtgacagctgataggtatcacatttcttttgagggggatgaaaatattctaaaattagattctgatggtggttgtacatacctgtgaatatatttaaagaatcattgaattctgtaagtgaatgaattgtgtgtagtatgtgaactatatttcagaaagctgtaaaaagtctaaaaaaagtttagagcagttcaggaccagagcttggggggcatctttgttgcagactgaggtatagtgattaatattggttaacagtcactgttggctaaaagtcagtttttgccagtgcgttttgtgaaacatgtctcctgtaatgttgttagcaaaattctgtggaaaagtgttctatgtctaaatacatatgagaaatgctggaataaacacagtttaatcaatgtcattaatgcaagactgctctgagcctgtaaagtgctttaagataaagtagataaggccgggtgcagttgctcacgcctgtaatcccagcactttgggaggccgaggcaggcggatcacgaggtcaggagatcgagaccatcctggctaacacggtgaaaccccgtctctactaaaaatacaaaaaattagctgggcatggtggtgggcacctgtagtcccagctacttgggaggctgaggcaggagaatggcgtgaacccgggaggtggagcttgcagtgagccgagatcacaccactgcactccatcctgggcgacagagcgagactccgtctcaaaaagaaaaaaaagaaagtagataaatataagggccacattaatttttcacaggcccttctccctcagttaaccttttttttttttgtatttggaacacagtgacacttttttaagttagcaagaaagttacattcattgagtatttattgcaaagcactctaattcgttgttacatttattcttcacagcagctttgtgaagtatagatactattgtctctatccctccacctcatttgcaaatgaggaaactgaagcttataaaataaagtaacatcatgcagccagaaaatgacagaaccacaactcagaaccattcaattttttaatcattcttatgccaatttaaaaagtattctaattttaaatccatggaaatatattttagacacaatcttcagattgttaaaccgaacaaacaaaaggtactagtatttaacaatttaagtttactttctattaactttatatgtaacctgtctgtcctcaaacatgccaggtgagtaagatctgtacaagatgcctttttcttttttctctcttcttttcagccattgtattttaacctgtaaataccgcttacctttctcttgaactagaatatttaataatttttcccttgtaatacttaattagttcatttgagttatttgtgtatttctagttaatgtgctgatttgtaaataaaacaatctagcattgttcatgcactctctcccaagacttggttttgatcctaaatgtagatgctggataatctcatatgatcctatgaatagcgtatttagatgtagcttatgatgcctacaaagcattttttaatgactgtaaaaaagttgatgcctatttgtttaaaaaattgatttcatcactgtttcttaatttgttatttattattctaatctcccctttattttaaacagtataaatattacaggtcatgaagatggttgaaattaaaagtcttattttgtgaatgtgtttttgttatgtattatgctacccccttagcaacagtacactcgaattttataactttttaatgaaacaagtatacttttattttaacaatagttatctataaattaattgacgttggtctctttatggctttccataaggcctttctggagcaatgcattctcaagtgtttcctcacgctcattttggtaggtggccacaattaatatctagatttgtgtggcaatttgtctacctgcttgtggaagcttctgctagtgttctggatccctgcatgtggaattaagtttttttccatgttttaaaatggagtgggcatggatgtgtggcattgggattacattgtatttaaaattacatggaaatgtttttagtgatttatgtgtaaatgctgaaaagcattactgcttacctacatggtcatattagaatgttaatagccattttgattctttttcttgagtttgaattcatggtactttgagtgacgcctttttgatataccaaaccattttactgcattattccatggagtttggttttgcttaactgtattcaagttttgcttttaagtgctctcttaaagtgatttgtcaaagttacgtcggtgcattgtctgttatgaagccctcctgttacccttgcagtgtgcttattattctttaattcacctgcttcccaatggcctgtttttcctttttttcgcatcagtaataaaaaagtaattttttaatattctaattaggttcattgagcagaattgcattgttacaaacatacgactacagggattactttgggcaacatctattacttgtttttcagctttttaaaaataaaagacattccgtgtaatattttttagtatttaatttctgtgccttaaatcaatgaacaaattggtaaatttgttaaaatcaggaaatttagtgaattttcatggtattttgattgcatcatgctaagaatatttcattatgtaattactaatagtctatattcaaagcaacattattggctcttattttactgagacccttcctaaaacacatagttggaggttttgtttttaatattcactagtaataaataacatactgtaagtgaatagtaaagagggaaatgatggcagcattccacatatgtagcagttgttcacacacatttctcccgatgtggtaatactctgtccaccaagtaataccagcgaggcatggcaagccaaggaagaatacagtagcattgaacactttggccatttattctgcattcttctaggaatgcttatttcacttctaatctttatggatttcacactaatttcgatagctcagttgccctaaccttccttcagtctcgcaaagctgtcttcatttaccttccataagagggtgggagtcgtgtgtgtgtgtgtgtatggaattgatttaataggaaaatatccttttaattgtgttagtgttgttaagagaatctctcttctctggctgtagttacaaagctgcataggttctgagtggtctgcctgtaactaactatttgtcctataagtcctgttctttttagcgaactattcttcagcggtttaaaatttttttttgcaggaacacatattatgttatgacagatacttcaggagataaaattttggctgttattttactgcatataacaaaacaaaactaaaaacaaaaatgtatactagtatacatattaattgcatgatctttaaaacacaagactactgtttagacttgaatttataatttgagaaattgtcttgggatttcaaacaacagctttagtagttagtttcattctggtcattgtgttttagaagaataaaatttctacaagttacgttaaactgtgtagcactaaaactcattaactttgttggaattttggaattaaccctgcctttaatgtacatcttagtatttttcaaggtaaatgatgtctttttacatttacaatgttgtgagaaactaaacatatcctgttgtatgtaactgatcagcccttctcttctgtcagcggcaacctttggcactgcatccatgagcatgcccacaggattcggcactcctgctccctacagtcttcccaccagctttagtggcagctttcagcagcctgcctttccagcccaagcagctttccctcaacagacagctttttctcaacagcccaatggtaagatctaacatttggcgagctgtaagttcattttatgtatcctttttatatcataatgttgtgtgcttgggcaggaagacttttctaaagaatactatagtattatctactgagtgtttacacaaaaataaaagcctttggtgatttggacctcagaaagctaagtgattttacaagtttttgtgagcaggttacaatttatgggaaatcagtgactatgtaaagagcatcccgtcattctcagaatttctattgcctttttctgattatttcgtcttacatgttctaatatacctcttgattttaaaaggagaatttatagacctagaatgttgggatttttttttcctttcaggacagaaatgtgtacctttttgtgtgtgaaatagactacttttctaatttggtaactatactgtagttagagtttgttatttgattttagaaagagacaagaagattaactcgacatttttacgtatttcatttgcttcagtttgaagtgcatagatttgaagattcttgaatcacaactatgtggtttcttttttctttttttttttttttaagtaagtggttatttaaaaatctgaaatatgggctgggcgtggtggcttacgcctgtaatcccagcactttgggaggctgaagtgggcggatcatctgagctcgggagttcaggaccagcctgaccaacatagagaaaccccgtctctactaaaaatacaaaattagccaggcgtggtggcacatgcctgtaatcccagctgttcaggaaggccgaggcaggagaattgcttgaacccgggaggcggaggttgtggtgagccgagatcgccattgcactccagcttgggtgacaagagcgaaattccatctcaaaaaaaaaaaaaaaaaaaaaatctgaaatatggaccctggaagagccataaataataaaaatatttcctacaaaatactgtgatgtttacatagaaatcattgtgttgtctgcacagcctgttccaaatagtcacaagctcgtctagtaatgaaattctataaattttagttattgagacaagttagaatgaaagagctgaatgaaagttctcttggccaggtgtgatggctcacgcctataatcccagccctttgggaggccaagacaggtggatcagtcgagtccaggagattgagaccagcctgggcaatgtagtgaaaccctgtctacaaaaaatacaaaaattagctgggcgtgctggcgtgtgcctgtagttccagctactcgggaaactgaggtggaaggatcacctgagccctggaggttgaggctgcagtgagccatgatcatgctactggactctggcctgggtaatagagtgagatcatgtctcaaaaaaaaaaaaaaaaaaggttattttaagacatgctacagtaagtttgtctttggtatctgaaagagcttgaggcctaacaacttaactttaacattttatttttgctgctctggtaggaatgtctctgaaagttattatgaggctttataagcatcagattgtctcttgaaggtatgggttataattggtggttctattttaacaaggtgcaggttttgcagcatttggacaaacaaagccagtagtaaccccttttggtcaagttgcagctgctggagtatctagtaatccttttatggtaagcaaaatttaaaattaaatactttataagttgttaaatcttattttaaaattaggaatagcaggatgttaatattcctagatggtatttggtgttatatgagtgacatcataagattgtacaaattgacacagagccattatgtgtgatccttttctgaccttttaaaaaattagttgcaaatcaaagcattgatagtttttaaaaaattagttgcaaatcaaagcattgacagtagatcagctattttataatatgaaacttatctgctttcttgtcaaaataacactttatgagaggccctaggaattagtgaacataaaagagaggtcttaagagtcagaagttttgtttgaatcacacgtgcttttctaagaccattctaagattcttcttagaatctattacaagaactgtttgaagtactggatatgaaagacgtagcacagttcatgacacatagtagtttgatatagcttattgccaataacaaatattattgccaataatttaaaaaataattcttaaccaaaaagtctaattaaaaaaattaaattcagtttaatgtttttatattttgtacatgcactacttttgtctctttatttatttgtcttatgttttcctttagactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaatatgctattgtttttgtgttcttgctgcaatgcctttaccaaagtggccttaaatatgagtagtgaattgagaacatcttgaattcttaaaagacttcttagtgactttttataaaaaggccatgtagaaaatttattaaaactactatgactgctacattcaggaatatgccagtggtaaagcatttaaatgtagcttgtcagatttaccataatcctactaatttctttgcagcttattaattttgtgaaatttgtatatatgaagaatttgcatgtatgtgtatttacaaatttttctaagtatcttgaattctcagactgcaaaaggcctattttaactattgatttttttttaaaaaaattgtctttgaatgtattggaagtagacatgcattaactgtgacattattgcacctcagtttttttctttctttttttgggcaaactgatattatctataggatatttgtttatgtttgttttttgggggaaagaaactggaactcagtgttaccttaaagttacggaatactttgttttaaaggaaaagataataagtttagttatatctttttgttaatattcaaatgaacttgtttaagtatctatgtacagtaatgcctcattcatctagaggtaatctggcagtcttgtgaaaaccgaacacaactcagaaacttggaatcgttttttttaaaaatgcctctgagcaacccatataagtcacaaagtctgtgtgttagagcttatgcatttgtttttatgagagattttaataaatttaattatttgcttgtccagactatagcatattagctgtttagaagggatggcttgaaaggaaggagactgaaaaacactctgagagcatacactgtccaaggccattagtgtaaggaccgctacccagcctagaggacatcactatactacatcatctgatgattattctttattatgcctctaggtaattaagtaaaggtgaaattgcatacacagatatgtagtacatattttaaaagttttatcttaaattgattaaaactttttaaaaagctttggtattaaaagaggtaaacatcagtttcctcaaacattttattcatgttgaatgcctttttgcaatgatgactgagttgttatcatagtattttaaaacctgtatagtgttttagacttgttaaaacattgctgtctagtgtacatctagctaaaagtgtggtttatctaaaccgttttaataagcaagatgactgggaaatctctgccccttttctgagcagtatgcctcttcttttagaattaaatgaatgctgcacaggtccagatgtgtgttgatgtagacttgaaatgtctccacattttggaggacttcctcagcccttttcattgagggaaaatatatttgaatttctgttttagattgtatcgggtcccagttgattcatgtgtacaaagttatgctacctaattacagaccattacccaaatatcctaccaggctttccatctgaatagtaaattaaacagttgttatcaaaatgattttaaagactatttctttttctgggtaactattgaagtttgtaattaaatgggggctcttactgactttaaattagcgcttataaaataaaaatgtttagttcaagaagagacccaagctgggtatggtggtgtgagagcctgtgagtcctagctacctggaggtgaggtgggaacatcacttgagcccaggagttggaggctgcagtgcgctacgatcacaccactgcacaccagcctggggatagagtgagatcccatctctaaaaaatgaaaaaaagaagagaggtagctttaaagtggtttttctcatgatattcactgtttattattaaagaaaatcagctttcgttagacttttacatttagatttattctagttttatatagaccatcaaaattatgttgagtactaaaaaggagaaaaaatcctggaaggtaacaaggctgaagaccttcaaa

SEQ ID NO: 14769 - DNA, 12727 bp, Human
  misc_feature (1)...(12727): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnttcaagctattctcctgcctcagcctcctgagtagctgggtactacaggcacgtgccaccatgcccagctaaatttttttgtatttttagtagagacggggtttcaccatgttgcccaggatggtctcaatctcttgacctcatgatctacccgcctcagcctccaaaagtgctgggattacaggcgtgagccaccacgcccagccacaagaagtaactcttaggagctcagggattagcaccaaacaatgaaattctagttgaatccctaagattccaattcatcattagcacaaaggttaataacatgccctgttcttttaggattatttttaatatcaaaatatatacatatatgtgtatatgttttcattattttagaaaataaattaaggattccaaattctcactgagggttttgttaatacaggatttgaactagctagcatgcacctataacaattctaggctatacaccaacaactttcaaaagcagctttctcatggtatttaaatgagggctggaagagatgtgaaagtcaggattttaatatcagagggaaatctgtctttgaagtttaatctacaataaatgtttatttcctagtaactggaagcttaaatgtcaaatgagactttgaagatattttttaggaagtgagaattcgccccaccctcatttacaaaaagttttagaaaacccgtgtgacctctattttattattatctcccttttgggaagcttcagtttaactcctggaaaccaggactgtgccagaattgcttcactgaaattattgctcctacattccaaatccatggggggaaaaatagttattttttttttcctctgtggtcatgatcacatgtgggaaagttagtcatatgtcaatgtagtaatttgaaatctaaataccttttgtttatttatttattttagacagagtcttactctgtcacccaggctggattgcagtggcatgatttcagctcattgcaaactctgcctccagggttcaagtgattctcctgcctcagcctcctgagtagctgggattgcaggtgcccgccaccatgctggctaatttttgtatttttagtagagctggagtttcaccatgttggccaggctggtctctaactcctgacctcaagtgatccacccccttcagcctcccaaagtgctgggattacaggagtgcgccactgtccccagccctaaataccttttacctttgttaaagagaaccacacaaaagtgctaaccctaattactgtcaattatttcaatttcttgaactctgtaagtctatatagatattttcacccaaagcttctcaagtaaattatgtcagatgttgaagactttagagtggagattggaaataagactaagattactaaaggttcataataaagactaaaactgggtagggcaagaaaaaagactaaaactttcaatgtaacacatctgatactcatcactgaaaaagacttacagcaaaaactgagaaaagaaaggcaaatagagaggccagtgtattcccagagaatttatttcatccttttccatccctgcatgttgtactgagtgactaggttaatgtatcatttctccttacactgctgtggttaggaacctttctggcccctctgcagaatacagtgtctggcgtgtagttgatgctaattaaaagtatggtgactaagtgaccgaaagaatagcaagtgaaaagaaaagccaaaagaagacacgcttgagaaaaggatagatccacattcaggtcgatcacacaattttgtgaaagcaatatatttatctttcagaattacccgagacctgggtttttaagagagggtgttgatattttcctgcatgcaaagtcattatgtttgattgccttcaatgtttttttcaggggctgtggctgcctttgcagtgggttatgtgaaagtcaactgggaccttctgggagagctggctctggtggtcttctcagttgtcaatgccggttctttatttctcatgcattacacagccaatatctgggcgtgctatgctggctatttgatattcaagtccagctatatgcttcttataaccatagcagtgtaagttttaccaaccactcctaaaactgaactgtattcctctctcttctgtctttctaaactttctctaagaacttcagaaggattttagtcaattgcaatattaaatgttgactgctttatattaaattagacacaactaagccaacttttcatttaactatttgctctctgaatattgctacaatataccttaagtcatcaagggaaaaaactctgtaggtttatagaccaaaagcagtgatacattgtcaggtttttctttttgttttattttgtttgagagatggcctggctctcttgcccaggctggagagcagtggtgcgatcacgatcaggactcaatgcagccttgacttcccaggctcaggtgagtccccaacctcaacctcctgagtagctgggatgacaagcatgtgccaccatgcctagctaatttttcgtattttgtagagatggggtttcaccatgttgctcaggctggtcccaaactcctgggctcaagcgatccacctgccctggcttcccaaagtgctggaattacaggtgtgagccactacatctggcatcattgtcaggatttgatttgtttatttccagcaactttctacataaagtgtgatgtgatctgctttcaaatggttaggtttagatttcattcctactttcatttgtttgcttgagaaattctaagcacatacttttatgacacaaaagattctcaggaaagttattaaaaagttggatactaaaaaaagtagatgcaaagataacaagaaacctttagctgcagtcgtgtatggaaccaagcagtttttcttttcttttgttctttttgagacagggtctcacccaggcaggagtgcagtggtgcaatcatagcacaccacaatcttgatctcctgggctcaagcagtcctcccacctcagcctcctgagtagctgaaactactggtgcacaccaccatgcctggctaaatttttaattttcatttttgtagagacagagtgtcactgtgttccccaggctggtctcaaactcctgggctcaagtaatcctctggcctcagcttcccaaagtggtaggattacaggtgtgagccaccacgccagatctagttttcagtcattttctaaaaataatttctgggatttagaatttcccgtcatttttgcttctacttttttctcagagatctctttaagaaaatgattaaaaaaccattcggtttcatataaaagtacagctaaagctgactacagaaaatatgctttgctattaaccaaaaaaaatgagaaacatttgaatttcaaattgcatgaaagaagtggagacaaaagcttcatcaagttttgctttcaatttgtgaagaatgttttataaacaatttacaacacagaaatatgagcactctgggaaaaaatcatcaaaggaaaaaacaattagttggtatgtttattttcttcatggaaatgtcttaatttaatcagaatcatgtatcttaggttgcttttttttaaatgtgaagattttgttaaagtaggattatatcatttctttgcattaaaaaaaaatattcacggctgggcacagtggctcccgcctgtaatcccagcactttgggaggccaaagcaggtggatcacctgaggtcaggagttcgagaccagcctggccaatatgattaaaccccgtatctactaaaaatacaaaaattagctgggcatggtggtgagaacctgtaatccctgctactggggaggctgaggcaggagaatcccttgaacctgggaggcagaggttgcacattctcatcagcatttattgcttgttttttggataaaagccattcaaattgaagtgagataatatctcattgtagttttgatttataattctcttatcaatgatgttgagcaccttttcatatacctgtttgccattcgcatgcctttaaagaaacatctgttcagatttttgcccatttttaatctgattattagactttttttccctgtagagttgtttgaactccttatatattctggtttttaatcccttgtcacatgggtagtttgcaaatttgtttttccattctgtgggtggcctctttccttggctgtgcaggagctttttaacttgatgtgatcccgtttgtccatttttgctttggttgcctgtgtttgtggggtactcaagaaatctttgcccactccaacgtcccagagagtttccccaatgttttcttgtagttgtttcataatttgaggtcttagatttaagtcattaatccatttttacttgattttgtatatagtgagagataggggtctactttcattcattcttctgcatacggatattcagttttcccagcaccatttgttgaagagactgtcttttccccaatgtatgttcctggcatctttggtgaaaatgagtttactgtaggtgtgtgggttcactattgggtttctgggttcactcttctgttccattggtctacatgtctgcttttatgccagaactatgctgttttggttactatagctctatagtgtaattcaaagtcaggcaatgtgattcctccagtttttttttgttgttgttgttgttgtttcattttgttttgttttgcttaggatagctttgactattctgggtcttctgtggtttcatataaattttagaattgctttttctatttctgtgaagaatatccttggcattttaatagggattgcattgaatctgtaaattgctttggatagtatgggcattttaacaatattgattcctccagtccatgaatatggaatatcattccattttgtgtgtgtgtgtcctcttcaatttcttgtatcagtgttttatagttttcattgcaaagatctttcacttctttagttaattcttaggtattttatctgtagctattgtaaataggattactttcttgatttcttttccagattgttctgtttgcatatagaaatgttatggagttttgtatgttgattttatgtcctgcaaatatactgaacttatttatcagttctaatagtttattggtaagagtctttaagttttcctaaatgtaagatcatatcgtctgcaagcaaggataatttgacttgatcctttccaatgtggatgccctttatttctttctcttgtctgattgctctagagaagacttccagtgctatgttgaatagcagtggtaaaagtaggcatccttgtcgtgttccaaatcttagagagtaaagcatttcagctttttcccattcaatctggtactagctgtaggtctgtcatatatggcttttattatgttgactatgttccttctatacccagttttttgagggtatttagccagaaggaatgttgaattgtatcacatactttgtttagcatcaattgaatgatcatagtttttgtccttcattctgtcgatgtgatttatcacactgattgatttacatatgttaaatgatccttgcatccctgggataaatcccacttagtcatgatagattatctttctaatgtattattgaattcagtttgctagtattttgttgagaatttttgcatcaatattcatcagagattggcctgtagttgttttttgtttttaatgtgtctggtttggtgttagggtaacactggccttgtagaatgagtttggaagtattccctcctctgttttttagaatagtttggttaggattggaattagttctttgatagaattcagcagtgaagccattgggtcctgggcttttctttagtgggaggctttttattatgacttcaatcttattacttattattggtcttctcaggttttggatttcttcatggttcaatcggataggttgtttgtatataggaatttatccatttcttctagattttccaatttattggcatatacttgctcatagtagccactgatgatcctttaaatttctgcagtattggttgtaatgtttccttttacatctctagttttatttacttgggacttctctctttttcttagtctggctaaaggtttgtcagttttatcttttctaaaacccaactttttgttcattgacattttgtattgttttcttcatttcaatttcatttctttctgatctgatatttattatttcctttcttctactaattttgggttaagtttactcttacttttctagttctttatgacgcatcattaagttatttatttcagatgactttttttttcttcttttctttaagagacagggtcttactatgttctccaggctgaactgcactggcgtgataatctctactcactgcaacttctgcctcctgggctcaagtgatcctcctgcctcagactcctgagaagctgggatcacaaacatgcaccaccacacctggctaatttttgtgtatttttggtagagacagggtttcaccatactgcccaggctggtctagaactctggagctcaagtgattcatctgcctcagcctcgcagagtgctggaattatacacatgggccaccacacccggcctctcttcttttttttatgtaggcacttgtaactataaacttccctcttaatactgctttcactgtgtcctataggttttggcatgttgtgtttccattatcatttatttcaagaaatttttcagtttctctcaatttcttcattgacccactggtcattcaggggcatattgtttaatttccatgtgtttctatggtttccaaaattcctcttgttgttgatttctagttttattctattgtggtcagagacgatgtttgatattaattatttcaaatttttgaatatgttttaagagttgttttgtaacctaacatggtttatccttgacaatgatccatatgctgagaacaatgtgtattctgtggccattggatgaaaagttctgtaaatatctattaggtccattttttctatagtgcagattaagtctgatgtttctttattgattttctctctggaagatctgtccagtgctgaaagtggggttttaaagtctccaactattactgtattggattctcttatctccttctagctctaatacttgctttatatatgggtgctccatacgttaaaaaaaatttacaattttttttttttttttttttttttttttgagatggagtctcggtctgtcacccaggctggagtgcagtggcacgatctcagctcactgcaagctccacctcccgggttcacaccattctcctgcctcagcctcccgagtagctgggactacaggcgcctgccatcatgcccagctaattttttgtatttttagtagagacggggtttcatcgtgttagccaggatggccttgatctcctgacctcatgatctgcccacctcggcctcccaaagtgctgggattacaggcatgagccaccgcgcctggccgtatttacaatttttatattctcttgctgaattgacccttttatcattgtttaatgacctgtgtctcttacagtttctgtcttgaaatgtattttctctgctatatgtatagctacaagtcctctttttttgtttgtttccattggcatggcatatctttgtccatcccttcattttcagtctatgtatgtctctataggtaaaatgtctttcttgtaggcaacaggtcattgggtctttttaaaaatccattcaaccactctcttttgaagagtttagattgataagtaaggacttactcctgttattttgttatttcttttctggttttgcagtgtttttccttttctttcttccttttagtgaaggtgattttctctggtgatataatttaatttcttttttactttttgggtatccattgcatgtttttcaatttgagattaccatgaggcttgcaatactatcttataacccattattttaagctgataacaacttaagactatttgcataaacaaacaagcaaaaagaaaactaataaaaactctacagtgtagctttgtcctcctgctttttaactttttgttgtttctctttatatcttattgtactatttgtcttgaaaatttgtagttactatttttgattggttcatcttttagtctttctacttatgagagtagtttacataccccagttacagtgtgataatattctgtgttgttctatgtacctattattacaagtgagttttgtgcctttacatgttttcttattgcgcatgaacgtccttttcttagagatggaagtactcccttcagcatttcttgtaggacaggtctggtgttgatgaaatccctcagcttctatttgtctgggatggtctttatttctccttcgggtttgatattttcactggatatactattctagggtaaaagtttttctccttcagcactttaaatatgtcatgccactccctggttctaaaatttctactgaaaagactgctgccagacattggagctctcttgtatgttatttatttcctttctcttgctccttttagaatcctttctttatccttaacctttgggagtttgattattaaatacctctaagtagtcttctttgggttaaatctgcttggtgttctgtaaccttgtccttggatattgatctctttaggtttgggaagctctctgatattatccctttgaataaactttctacctctatctatttctttacctcctctttaaggccaataacttagattttcctttttgaggctgttttctaggtattgtaggtgtgcctcattcttcttttttctgttgtctcctgactgtatttttaaatagcttgtcttcaagcttgctaattatttcttctgcttgatcagttctgctggtatgagattctgatgcattctcagtatgtcaattgcatttttcaaccacagcatttctgcttgattctttttaattatttcaatctctttattaaatttatctgacagaattctgaattccttctttgtgttatcttgaatttctttgcgttttcttaacacagctattttgaattctgtgtctaaaaggtcgtatatgtttctccaggattggtccctggtgccttatttagtttgtttggtgagaacgttttcctggatgatcttgatgcttatggatgttcatcagtgtcagggtattgaagagttgtatttattgtagtctttgctgtctgggcttttttgtacctgtcctccgtgggaaggctttccaggtattcagaaggatttgggtgttgtgatctaaactgtatctacattagggagcaccccaagcccagtaacactgtggttctagcagactcttagagctactgctttggtggtcttggataagatccagaagaattctctggattaccagacagagacacttgttcttttcctttactttcttccagacagtctctctctctctttgctggactacctggagctggaggtgggtgacacaaatacccctgtggccaatatgttctatctttttaagacttccatccatgtatattatagttaaaatgcttatttatgtttaatgatagatttcagattgcagttaatctgaatgtggaacgctatgccttggtatttggaatcaacacctttattgccttggtgattcagaccatcatgactgtgattgtagtagatcagagagggctcaacttgccagtcagcattcaggtaagctgcaatacttctgttttcaactaggtaacctcaaaaatttctcaaccttacaacaagcaatatttaaatttcttgagttccttggttaagcaattaaaaaatacataattccttcattatcatattataacacaccaagtaggttttgagcaataattgcaactagaacaacatttacatggataaggcaggtaagaagtaacctcaatgcttaaatttattcttggagacattgaatgtagcattgcaccagcctccaaacaaagacatagagacaggtcaatgagttttagtgtttttttgggtttgttttgttttgttttttactattgatgatagtaactatgattttaacccaagcaacctgctctaaagccaagactcttagtcaccgtattgcttacaccttcttacttgatcttgatttcttacttgataggagagtattgttcaacctaaatgacccatattaaaaacctgggtctcagttaccccataatccaagcaaaccaacagtattaggatgtattatcattgacatagatggtcatattttatatgtggctaattatttgtttttctccagtttttagtttatgggagctattttgcagtaattgctggaattttcctaatgagaagcatgtatattacctactcaaccaaatcccagaaggatgtacagagccctgctccaagtgagaatccagatgtgtctcacccagaggaagagagtaatatcatcatgtcaacaaaactctaacctcatcgcaacaaacgcaacagtggctttcaaagttatgcaataataaggaaagattttgagatgggtggcatatgttttgccataacttgacatgctttgcaaatctggattccaatggacctttcaaaaccacaacaaaacctcagttttagatgagttctctatgtgaccaattttactggatgcaattgacaggacccgtcatcataattaaacaacccatattggggaccccctgtgactagtagcagctggaaaattctggtttttatcacttgtaaagacatgcagatggcgtggaaccaaaccatgagaaaactccagccatcctggagttgatattcaccatttgtgaggagaaatactaactggactgaccctattgctaggcttaaatacttatttgatcttaccaaagaagtcaacacatgggacctttgtgtcacatgaaccattttctttcctcttctattaagtgtatttctgtttaagttacagttctctaagagaattacaatgtttgtcccatttctaagggcttctcttcaactctaataacagcattattcacgttatgatttgatagtattattatttaatttttttatgattattttccattttgtgctctgagttttgctgttgaaagtctccctcaagaatagcttcagatcctcttgtgtatttgcagaatacacaaggtcatttcccagtggcctgggagaggcagtgagccttctctccaccaccatagacaggtgttaatgcatctatgggccaggtgcagtggctcactcctgtaatccgagcaatttgggaggccaaggtgggagttttgcttgaggccagaggttcaagaccagcctgggcaacacagtgacacctgactctactaaaaaattaaaaaattagctgggcagcgtggtgtgtgcctgtagtctcagctacttgggaggccatggtgggaggatgggttgagcacaggagtcagaggctacagtgagctatgattgcaccattgcactccagcctgggcaacagagtaagactctcatccccctcctcccaaaaaagagcacctgtgtggtgtctgtctaaaataggaaaacttaaaggaggtttctagaagtattagaaataagaaaacactgatggggggagtggaataaaacacctgattttgttttgttttggtttttgagacagtctcgctctctcacccaggctggaatgcaatggcgtgatcttggctcactgcaaacttcacctcctgagttcaagccattctcctacctcagcctcccaagtagctgggactatgggtgcacaccaccacgcctggctaatttttgtatttttagtggagatggggtttcacaatgttggccaggctggtctcaaactcctgacttcaggtgatctgtctgcctcggcctcccaaagagctgagattacaggcgtgagccaccatgcctggccaaaacacctgatttttaaatggtagcaattgtgctaaataaaatgtgtaaaaattttaaagagttgttaacattttttgatgaattctgctgaaaattatctgaacatacctgtttttcgaaacttcaagaaacttcaataagggatgcattgagcagtctgacagtgagaataaagaatgctgagtcaagatttatattaaggctggaagctgtggctcacacctgtaatcccagcattttgggaggctgaagtgagaggttaatttgagggtaggggtatgagaccatcttggccaatatagcaagaccctgtgtctaaaacaaacaaaaaaatttttaattggattttgatatggtttggatctgtgtccccaccaaatctcacgttgaagtgtaatccccaatgttagaggtggggccggctgggaggcgactggatcatgggtgtgaagccttcatgaatggtttggcaccgtcccctcagtgctggtctcatgacagtgagttatcgtgagatctggtagtttaaaagtgtgtagcacctccccact

SEQ ID NO: 14770 - DNA, 7654 bp, Human
tgtcacccaggctggagtgcagtggcacaatcatagctgcctgcagcctcaaattcctgggctcaagagatcctcccgcctcaggaggcaggaggatggtcttcttcttcaggagtccctgtctgcccaggggcagctgtcactggaatcttttagctgccaggaatgaggtgatggctgaagagcccaccactaagaaaatggttagtcacccctttgacaatgcttcctttgtgccatgcctgctctgagcactttgcaaatgttgactcatataaacttcaaagccctcatgatgtgggcacaactgctatcctcattcctcattgtgcagatgaggaagctaaggccagcaaaggcctagtaactaacccaaggttacccagccgggaaatgctggagctgggaatgaagcccagctgtctggttccagagccagtgttacatggctctgacctcccaggcagttcttccaggaacctcccccacttccctgggcccttcccaggtggaacccctttctgagcctccttttcccatcagctctgtccttgacagaggcaccccagactttcagagccaaacgcgatcgtgttgcctacaattgaggaaacagaggccttgaaaggtgtgtgacacacctatgtccccccaaattataaaggtagttggggaagaaaaagaagcacgtgtgtaagaacggggaatatttatgaggttctcactgcgttccaggcactggggacccagtgcagacaggacctggcccctgcccaggtggcgatgtcagactgggagggaagacacattgaaagccaagagacaagataaatttcaaatttagcggcaagtgatcttgagagggcagtaaagggaagaaggcgggactgggaggaccttgggagatgcgcttccgtccagatcctcaccttgctttaggaggtgagaacagaggcagtcttccgtcccaaaatccttctccccacggttgggagaatagcgctggtgggttttttgttcattttactttattttacttattttatttatttatgagacggagtctcgctctgttgccgaggctggagtgcaacggccggatctcggctcactgcaacctccgcctccccgattcaagctattctcaggcctcaatctcctgagtagctgggattacaggttcgtgccaccaacgcccgggtaatttttatatttttagcagagatggggtttcaccatgttggccaggctggtctcgaactcctgacctcaagtgatccgcccgcctcggcctcccaaaatgctgggattacaggcgtgagccaccgcgcccggcctgtttgttaatcttaaatagaaacggagtctccttatgttgcctaggctggtctccaactcctaggctcaagagatcctcctgtcttggcctcaggaagtgatgggattacaggcatgaggctccgcgcccggcctgataggttctcttattgccatgttgtagatagaagggggcccctgggttaggcagacacaggttaggtagttcgtccggcgtcaccgggcgggagcccaccgcaggccccacgagacaagggcgagcaggttcatcgcctcccggggaaaggactgggtagtcccaggccccaccccttcctggaacagcaagttcgctgtgggtcccgacctactgacccaggcggagggcgggacgcagggtagctggggccgcgtagagagggaaagaaggtcgcgattggctcgtcccgaaaggtgggcggggcctcctccgacctgtgcgcgcgcgccgcggggaggtgttgccgagggcggagcgggagggggcgtggccccgcgcgggcggccgttgacggcgaggccccgccccggatgtcgcgtgtcgctgaaagggcggcggcgattggccggcgccgcgggggcgggcggggcggaaggttctggagggggctggcgggctctggaagcttccgccggacgggtatatagagtccgggactggtcggcggcggagccgggggacggcgacagcgggtcggcgggccgcaggagggggtcatgggtaaagactactaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggtgtgtgctcgcggccaggggcgcggccccgccttttgacagacagggaaactgaggcacgctggcccctctcggcggccccccgggaaggacgccccgggccgtggggccgagctgccccgccctccggcctcgcgggcctccgccctcggattggcggccgcgcggtgggaggaggagccttggcccagccgctcggccagaagcttctagcatgtctggggctgcccctccccgggcgcctcctcccgcggccccgagcagccccggggtgcggtgcatgggggtgggggagccgggggtgacgacggggacggcgcggcggagcccgctgcggacccgggctcacctgggctcggccgccggggtccgcggggcggcgcctccggctcagctgcggggcgaggggttgtgaatgcaggagccgaccccgttcgtgggcttgggggctgggttgggataattcccgggaagtgatgacctggccccggcagggcacgcaggaggcagcggccgcccaggtccggagagcggggccgcctcggagggtaaggagagcagggctttttgttcctgtgcccgttgatgattcaggctggcttctgggcttgatctggagctgactttttgtgcaaggatggtggcagtgaatgctaatgtgtgaggatttaaaaactccctatttatttttgtttttttttttcttctcttcctacgcaccattagccctaaaacgttgagagtaaacacttaccgaaagccgaccctggaccatgtgtctttagccatctcttggtgatgttgccaggaggatgggtcagtccaggagtggcagggcctaggtggcacctggaggtgaacacctaaccgcatgagtccttttccactgtcaggctacgcggaaatactgttggtaggggggcgtctctgctgttggcagtgagaggtagaaacttggggttcttccttgctctcccctgacagacaaaaaagttcctcccccatggcttccaagctgtttccccctgtaagggaagctcgagagagagtctgctgttcagccatctgactgcttctaaatctgcttttcaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggtaaggtgccaggtggggcggtgtctgtagagggcgatggctgctttttgaagcagtttagtatttgctgaaccaatgtgttggggtgtgtggtgcgtgccaggcttggggcacaacagtgaacaggactgaccagggcgctgttgtggagctttcgtggtggggacgtgtagatttgggggccaggtcttagctgcagaggcctgatgggtcttatctatggcagacggcctctgggcaagagctgagcctcttgagccagcttccatctaatgctgtccttttgcttttcaaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccctggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctcaggggagcggtcctgtgactctgtttgagggttctgctggttttgggggtggagtggggagctgggcatccttccaaattcaatcaaggtgagagggtgggatgggcaggaggcaagtgccctgcaagggaaacgtaagtctcccttcctcagccataagtgggttggagaacttctacccagactcggggtccaaaaaaccagagacccaagcacagtggccttggggatcattttttgatgaaggttggagtcaaagtagcggtggggagaggcagggtctggctcctaattctgcctttcttcagggtccctggctttttcagcagaccttggctctggggccaaggggccaacccagggtctggcctcttaattccttatcactccttccctgctagaacgggctgggcgtcctgaaggctggccaaaccggagctcaaggtcctgcccaggactagccccactgtagagaggacccatttcctgccttggctttatttgcaggctactaaagctgcttttactttgtaactttctttaaaataactggttttattataaagtaattgctcaggcttaaaacaatgtattgctgctttgttacaaaatgttctaaagtggaaacactgtatatagaccaggagcagtggctcaggcatgtaatcccagtactttgggaggccaaggtgggtagatcccttgagctcaggagtttgagaccagcctagacaacattgtgaaaccccatctctacaaaatttaaaaattcagccggagaatgcagcgtacacctgtagggccagctatttatgggactgaggcaggaggatcaattgagcccaagaggtggaggcagtagcaagctgtgtttgtgccactgcactccaacctgggtgacaaagtgagaccctgtatcaagaaaaaaaaactaaaacacagtatccaaaagtcaaactgggccagacgcagtggctcacacctgtaatcccagcactttgggaggccaaggcgggcagatcacctgaggtcaggagtttcagaccagcctggccaacatggtgaaaccccgtctctattaaaacaaaaagccaggcgtggtgcacgtacctgtagtcccatttactcaggaggctgaggcaggagaatcacttgaacatgggaggcagaggttgcagtgagcaaagatcccaccactgcactccagcctgggtgacagagcgaggctgtgtctcacaaaaaagtgtcaagctaagagttgctttcccttcccactgaaacagttgaagcgctgaaaacaggctaggggcagccctgccagtccaggagaactttctgcaatgactagaacgttctatataccgtttacttaaacatcttacaaattcaataaaattagaatcagttcctcagtcctgccacacttcagttgcttagcagccacacatgtatgtggccagtggcaactgttggacaagtcaagtctagagggcttttccctaaagacattgcaggggtgactttgaagagcagccacattaagccaggagacgccagcccaatcaggaggtgaccctggaatatcaagagctaagagatgtttaccaaagtatcccacacgccaaggtcacatttattgcggaactgacctgacctcattggtgacacaaatcccagggctgccatccccacccccaagtctccattatacaccaagtccctgtgaacttcatactgaagtgtcacaaacataaaggtgcacgaagccttgaggtatatacaattctgggaacttcacaaaaaacacggccaagcaacctaccaggtagcagtgtgaggagtgggacggtgggattttgaggggaaaatcttggtggtaaaagggcccaaagacctttcacacatgcatttttttgctcaaaggccactacttggcttgtctatcttggccggatatctggtgcacccacatgcaaacttttcccaaagtcttgggcttgt

SEQ ID NO: 14771 - DNA, 12723 bp, Human
atgcattcatttgtggcaaggcttatagtaatgcctggcgaaatccatattagctattatagggagcgttcctcaatttgcggagaggtttggggtagaggcacaaaagatgaccttacaggccagttaaccattctcatctctgaaatgccccgcactttcccttccatgtcttgggagcggcttcctgatgacagcagttctgtccacacgaatctgaggctttcacccagctgtcttctcagagccgagccgctgccccttcccctgcctgtcccctgtcagcgcttccctccaccccatggtcatcgcacaccggaaaggccttgcgagccccaggggagcagatgttggtgctccgattccacgaggaggcctctgggttttccattttacctgcctggatggcttaggactttcccggactctggggctaaagattcggcacctgagttttaaaacctttcccagcacttcccagagatgccctcccgtcctctgcactcctgtccttccctggccacttgggcagaagtcattagcactgctgagaagggatgatgctggggtttctgtgcactcaggcccttaatccggatgagatttttttaaactccccacagccagttctatttccagctgcacctgcccctggatcttcacagttcctctggaggggattaggcaaaccgtgcagctgcctaaaacctcacaccttgaaggaaatagtcattgaatgtctgacctctgggctggctgtctcggactctaagctgccagggaaccagggccttccacccagtgggactgcctgggggcttttaaatgcccctgcctgtcccctactcccagagatggtgacttcctgggtctaggcattaggagtttgtaaaactccctgatgattcttctgtccagcccaggctgagaaccactggtcagaggcctgggcacatcccaaggctcatccagaaccatggggtgcaagtgacagaaacaagagcggctgctgattgcctcactgagcagtgaagcccagccttgaccatggattaggccagctggacccaggagctcaggccggaggatgcctgcttccctctgctctgccccaccggccccagcagcctgggcccacatcctctcagtcagaagctggctctcaccggctggctgggctcacagccccaccctgaaaccagcagtgtggcccggggcccccgcagggctcagacagccaggccttgggtggttgaaggccaagagctgggggccctctgggaaccacacagccgggaatgggagggggtgctccccaagggacagttgaggtgccggctttcagtgggaggaaagggaatgggtatgagctggacagagccattatgtcacccagagaggctctgtcccccgccccgctgagggggagacagtaggagagtggccacaggtccagcagtggcgagcacaggctctggggtcaggtgttggagcagggtccagctcctccactggccagctgcatacctggttctcagtgcctccctcccctggggacaggggacagtgccatgcaaccttgtggggcacaggccctctgtgtggtcagcatgccaagagcacagagagggtggatttgcacatgagcagccccctgtgtggtgttcacccagccagcaacgtgctagacccaggaaaagactcggagcgctctgtcagagtccacagccacaccaccaggtgcagactgtctgggcccagagcctctgcttcttcccctcccgtccaccaaacgccagcccctgaccagcctggcggcctttccaactgagtgtggctgttagtcctcttgcaggccttgctccagccagactcccaccttgggcctctgccagcctggcactgatagccacaggcagagctgagacaaaagagaggggccctggggagtatcagcagcagccaatcccggaagacatctatgtcaggtggtttctggaaatcgaaagtagactcttttctgaagcatttcctgggatcagcctgaccacgctccatactgggagaggcttctgggtcaaaggaccagtctgcagagggatcctgtggctggaagcgaggaggctccacacggccgttgcagctaccgcagccaggtaagctcctgcctctagctctcaggtgggcacccctctcagtctctctctcttttttatttttattttttttgagacagggtctcactctgtcacccaggctggagtacagtgatgcaatgtccgctcactgcagcctctgcctcctgggttcaaacgattctcctgcctcggcctcccaagtagctgggattacaggcgcgtgccaccacgcccagctaatttttgtatttttagtagagacagggtttcgccatcttggccaggctggtctcaaactcctgacctctggtgatccacccgcctcggcctcccaaagtgtagggattacaggtgtgagccaccgcacccggccagggcacccctctctctacacaggcaagtgggggtcatgcctccctgtttgcacataggcctggagctggggatccagggctcctgagtccagcaacaatcattgctgctcccaggcccacagggcctctgtgtacagttgggcagattactcactgcacaaggataccagccaaagggcaagtgggttagaattcagcttggccctctctcagacctgtgcatttggcctaggcctgcacccactccaaggaagagcacctttttttctgatttgcacgaaggggccaacacaggcagccgggtctcaactgtatgaaggaatcaggcaaaaatagccgctgccacacaaagggcagcgacgccacctgccaggtgcttcgttgccccccccttttttttttgagacagagtcttgctctgtcacccaggctggagtgcagcggctcactacaatctctgcctgccggattcaagcaattctgttgcctcagcctcctgagtagctgggactacaggtgcacaccaccatgcccagcttattattattattattttgtatttttagtagagccggggtttcaccatgttggccaggctggtcttgaactcctgacctcaagtgatccacctgccccagcctcccaaagttctgggattacaggcgtgagccatcgcgcctggccagttggccatttttccaaggccctgagttactctcccaggacggacaaacctagtggctgcagcagagtgaagtggctgggggcagaagtggagagggcgtccacccatactggcgtgcctgggactgaggggtttcccaggacacagggaaacttcagtgctaaaaccagcacagtccccagcacacaggacaggcggtcacaccctggcccctttagccatctactgacattgacacagggaggagaggtgggctcccccgagcagaccccctgcctgtggctcactgactgtggatgtggagcccgtttgcctctctgggtgtcagctcattcacttgtaaggtgaggtgtaactaaggtggttctcagggtcacggtaaggcctccagtggtgcccggggagccccgacaaggggtggctgcacagtgccagcgagcacgagtcccagagcaaagctgctcaccagccagtgcacccagctcccagggcgcttgttcatgcagactcccatgcagaggggctagggcaaggccagccatgactgcatttccgacaagctctggggatgccattgcagccgtccaccaggccccctccaagcagcctcaaggtcaccaggcccagactcccagccggtgcccacagcagtgccacccagaggcctgccccaggcttgctgaactgaggggacagtgtcaggtatcacaggattcttaccgagccagagaaaccataactgtctctccattggcagggtgtgggggagggaggcagacgaagacaaaagcgtggaaattacacggaggcaagaacaccaggccagaaggtggagacccggacctccccagtcctggcctgagtgtcagtgtcttggggatacttcagcatttcctccctgttcttcccccagcctggcccaccctgggctgcagccctgacccttttcatctatcttccccatcggaacaccacggagccccgatatatctccctgccacttatctctgtcacccctcgcccggattctgtgccctctcctgacgagtcccctcccatccactctccaggctgcagcctcgtctctgcctgctgagaccctctgggacagtccctgcaggggtctgttgcctgaagcttaaggccgagatcttaaccaggctcacccggcctcccgacctgggcccacgcctgtggcctcctccatctccccgcccatgcccgtgtggcagccttgcccggggcctggttttttgagatgagctcacttgcctctagtcaccaattcttgctgcccttactgccagggggtgcccccagcccacgcttcatctagccaagtgttacacatccttccaggaccacactgcagaccaggtgaggggcccccgcgggggcatccacagcacacgtcacacttactgggatcatagtgggctctgcaagagagggaccccgcctgccacacagcccaggttgggctgaagggtgaatgggcaggccagtccctggggcctcgggccatctggctcccgtgcctcacccctccgcttctgtctgctgcaggatctgggcatccaggcacggccatgacccctccgaggctcttctgggtgtggctgctggttgcaggaacccaaggtgagctgagcccctgggaaataccaaaagcagaagtgtggaaggctggtgcaccctggggctgctcagagcttcaaggagatattctgcctggggcccggggcccagcggttagccagatcttctctcctgcttgaagcaccaggtatccccagtgatgatgacttggaggttcccgggggctcacctgggttcaggtgagatgcaggttatagagaggacactagggaatcctccattccgtccagagggaaccagaggggctgatcaaaccagcagtcacaggggccgttgtgaggtcagtggccttggacgcaggtcagtcttccagagggtcctggctgcttttcctcacattctttacactgtgagcccctggaagctcatgctcatcctgggggccccatggaagccagatgtacccccgactggattcaggcacccagctcctgcccggctctgtcagctcctgtaggggctggagtgttggtggactgagtcccagaaggacatgtggggcgggggaatcccattatctgccctggaaacattctgcctgtgctcccaggggtccctaggcctgctgcccccataggccagcacccccaaactgcagacaccctctgcagggcgggtcagcacggggcctccgttcccctcctatccttccctcagggtcttgccacctccactcccagtgctggagaactcagggcttctctgcccctgttctgtctatggagtgaagggctgagacccctaaaacaaggaaaggcgagtttggcctccttgcggggtagggggggctgtatgtatcttccactcctccctcatggaggtgcccctcatggagaggccaggggaccttgaagccctgaaatacaagctcagcaggggagacccaggacagcatatggggcctggaggtgtgggcggtgggtgctgcaggccccagcctcgccctcgctggtctctgcctgcaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggtagggcctgctgtccccttccactgaggctgagacccacagcacagccagctcccaggaggggcaaatcccctaagacgaaacagtcaggtttcaaagacatgcaaattggattcctattaatttagcaagagcaaacacttttttttttttttttttttttttttttttggagatggagtctcgctctgttgcccaggctggagtgcagtggcacaatctcggctcactgcaacctccgcctcctgagttcaagtgattctcctgtctcagccttctgagtagctgggattacaggtacctgccaccatgcccggctgatttttgtattttttagtagagacagagtttcaccatgttggccaggctggtttttaaacttccggtgtcaagtgatccgcccgcctcagcctcccaaagtgctgggattaccacacccggcctatgagcaaacattttcaatggtgctgaaggcctgcggatcaagttctgatgggactgctccacccacacttggccagtgatggtggcgggtgcttgggcaggttcaagagctcggctgggctcgttccctccggcccagaaactccactccagggagtttatcccattgaaacaatttctcctcaaaagaaaagtctgcaggaagatttccactgacacagcagttgcgattctggaaaaaaaagaaacaatccataaactatttagcagcagggatagtcacacaattacagtatgtgaacctgatgttgcagggatagtcacacaattacaatatgtgaacctgatgttgcagggatagtcacacaattacagtatgtgaacctgatgttgcagggatagtcacacaattacagtatgtgaaactgatgttgcagggatagtcacacaattactatacatgaatgtgatgtcgctgaagcagccggtaagctttataagcatgaaggctaagtttatggcctgacattgcaatcacaaatccagcccatgctggaatatcctccgtggttcgctggtgaaggacctgtaagcagatggacccacacggccggggcggagaacaaagggctgagtcgcgctgtgggactcctgggtgcagtcgtcacgcccccagccctgccatctgctgtgtccacaggatcaggccccatcatgctggacgaggtccagtgcacgggaaccgaggcctcactggccgactgcaagtccctgggctggctgaagagcaactgcaggcacgagagagacgctggtgtggtctgcaccaatggtgagcgggggcgcacctccctgcggaggccccagtgtgccctggggtcccgtggcccctgcccctcccagcaccacccccccacgcacatgaagcacacaaaggttccttccactaccgcctgcccactccgcatggagaggcccagacgtcccaagagcccaccagctcccagtcccacagtcccagactcctccccagccccttctggagaaacacccagaaccaccaagtctccatgcagaacccgagtgtggggcagtgagccacagtttcagtgagcatgacacctggctccagcctgacctgaaatgccagcgtccgctcagaaatacacttcacagcacgcgacaggctcaagcccgtcctggcggagggagtcccggctactcgcagcctcagcctgcttcccccaacctggcccagtttggagggaacccaggctgctctgcaggttggagcctctggatctgagtttcttgtttttctttcatgccgaggtggctcttcctgggcttgcacgtgacaacctgggcatttcctgcccactgccctttgccaggagttggaggcccctaaggcaggacgggtcgaatcccagggagcccctgtgcccacatgggatggacaagtggctggagctgagcctggactcacagtgggggaagcccaggagacgccatggggctgtcgggggccaggggaggcggcggggagcacacggggccatgggcgcacggccaaagctcctggggcaggagagctgtggtaaggcgtgcaggtgggagggagctgggggtcctgcggtggctcaggttttaggaggcccagggcaagcccacctggttgaaaggtcacagttacttcaaaactactatatttgtggcaaagaaaaacctatgggatttcattttgagttaggctttgagaggggctcaaagaaggggagagggtgcaccacactgacccccgagccgggagcctcccatgacttctgcaggccttctccccgacaggaagctgctcgaggacccccggagttctaaaatggggttgccacaggaccctaacttttcaggccatctaagcaggcagtggttttggtgttagtggtgattggtgaccaaggctggggagtgggggctccggagtcagtaccaccaagtctccatgcggagctgctgcctgagtcgggggagcagcacagagcagagggcctaaagcgggggcctggacaggcttggccaggtcctagctgctcttgttccccagggctggaaggggcggggcctcagggtccaggaatccgacacttccggtctctcttgtccctcgtcttcccaggagccttccagagtgaatgaggcagccacaaatccctcactttcagatgaagacactgaccccagagagtggcagtgccccggctcctaacgcagcccacttccctcccgccccttcttagaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtgagccgtctcgtcctcaggctctggggccgccaggggctttgtcctcctcccctcttcaaaagcacagccccccacacacacacctgcacatactcatgcatgcacatgtacacacgcagtcacacatgcactcacgcagttgcacacacacgcatgctcactcccacactgtgtgcactcaggtggctgtgttggacagttgggcccagggctcccctgctgtcctgtggggccggcatctgctctccttctttctccccaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttcctacatttgtttgtacagaaagtgttgttgggtccacaccgtgtttagacatcaggtgtgccaggctctgggggacaggtcatgaggcagagtccctgtccttgtgaagctacaggctaacggggaagacagggaacaggaagcacacctcccagcccggagcaatgacacagtgggacacgagcaggagggtgcgtgccactgcatgcgtgcacgtgggtgtgtgattgcatgtgcacaggcgtgtgtgtgctcatgaaagtctggctgtgacgggtgccctcaccccttatctgggtaggtgtgctcttaaaattttatttacttttgagacagaatcttgttctgtcgcccaggctggagctcagtggtgtgatcttggctcactgcaacctccacctcccggtttcaagtgcttctcccgcctcagcctcctgagtagctgggactacaggcacctgccatcgtacctggctaacttttgtatttttgtagagacagggtttcaccatgtgggccaggctggtcttgaactcttgacctcaggggatccacccacctcagcctcccaaagtgctgggattacaggcgtgagccaccgtgcctggcctatgggtgggtgtgcttttgccagcactacctcctgctcacgtccgaccggaaggagagggtgctgaggtggcaaggtcagggctgcacctccggcggggcgatcgggtctctggaagacgtgaccgggctgggtcatggagagcagcagacagcagactgtggaagctgggaggagggagaacgaacagcaggagttaggaaccttcgctctggaaatcctggtccacagggacaggggacagagattctcatctcagccttgtaagagtgaagaattggaaacgacgtcaatacccaccaacaggtgcttgactacaaataaaaggcacctcccctgggctgagtgaggcgggtagaggtgcgctggaagatcctgggaaccacagagtctcaggggaggctgggggacccattggatgccggggggacatccgtgacaatgccacagcaggttctgggcacagaacgtcgctcaccaccaacaggaattcaaaactgcccctgcttctccatggcccgttgcaggcacagagtccccagggaggcacctgctgggccgagctcaggctggcacctgccgctgtgccacggtctgggaggacaacagtgtggcctctggaacaggaggtggcacaggggctcccctaatgggagggaggttcaggtgctgaacagccaagatggcagcagacgccccacccaccctctccccacaggtgccacaaggaacaaaagcagtctcacaaaacctcctgcctgtgaaggcagctgctccctgtactggatggaggcctctgctcccccaacccccccacctccagatcctgcgtccagcccaggtccaccatcctggcaggacatcccctcctccacatgttttttgtttgttttgagacagtgtcttactctgtcgcccaggctggagtgcagtggcacgatcttggctcactgcacactctgcttcctgggcccaagtgattctcccgcctcagcctctgggactacaaagtacttgggactatagatgtgcgccagcaggcctggctaatttttttttctttttttgtatttttagtagagtcggggttttgccatgttgcccaggctggtctcgaactcctgggctcaagcaatttgctcgccttagcctcccagagttctgggattgcagggatgagccactctgcccggcctatctcctccacctctattttgatcctattgacattttagcaaccgaggggccacgtcgccacggaccactgccaagaccagtgttggggacaaaccacaatgagatcaggaggaagaaggaaaagcgatgtcacggtagaggcgtggcagacatggcaaagaccagaatcacagcctccatttctcgagtcagtccca

SEQ ID NO: 14772 - DNA, 92681 bp, Human
  misc_feature (1)...(92681): n = A,T,C or G
cacgccaccatgtctggctaattttttgtatgtttagtagaaatggggggttttaccatgttgcccaggctggtctcgaactcctgagctcaagcaatccacccacctcagcctcccaaagtgatggtattacaggtgtgagccaccatgcctggcctgcaagttacctcttgatttaaaatattttccaatcatgaaggaaattgacttgattctgctacttccctccacctctgactttgggggtaggggacagataagcagaaactgctgaacatgaccctcagccggctgggcagccatccctcagccacagtgagcttgatttgcgtgttccagtaggaagcaaggagtcaggtccttctctagtcctggggaacaggagaagggtgggggaacccctgattcctccccttctgtagccaaagcagactagtttagggaggagacagggaaaccaccagagcaggtcaagatcaacctgaaggaagtgggagtcagggacaacctactaaaggaagtgcatgtgtgccttgtacatgcatggggtggaccaaggaaaagatttaccctaaaagaacaaagtatgctccgacaaatctattgaaaggaatgatttacactggtgcttcctgcccaaatgttgagaccaatggcctggtgcttccttcttgaaactaggttgctctacttacatgaaacaaactgggcagaggtcaaccgtgagagcctgagcctccccaagtaaacagcaaaagattccccaggcccaacagcccccacccccaccttcaaggaaagtggatctacccggagcacgtaggccagaggaggcaggagaagagggtcagtccgtgagctccgggtacctggagaacatgaatctcccgggtgtactgtccccatgagggtcaccgaggaacctatggatcttccactcttcgcccagaatgtcttccctctatcccctccacctccccaaattccagcaccaggggccacctcagagccacaaatcctgaaaggaccacccaggtgactcgggcccacacacccctctttcggggtacacttggtggcaggctagcaggcttttggcctcagctggtggtgccatataaccagattcgtcacagagacccattttttatcagtcccaggccagaagtacgaagactgatcttaacgatgtggcctgcctgggaggtaaggcggcaggcgttgccagaattgatgggaactgtggcacaggtgggaaacctggtttaacaaattcttcattgattcaggggaccactttccttgagccaagtcttggcaagcggccggcgaaactcacaggtccctttcctggctgcgtccccagcctccagccttccccgccccagagatgccccaggagcggcccctcggtgtaggtaacgggtgcccgggcggctccgctccgccgcctagagcctggaagccgccactgcggcccaggacaatccggctacgcggccggcgccgaccccgcacgctggagtccgctgccgcacggcgctggcagtcgggggtggtgtctgaagtcaggcgcttcctgccttttcgtcggcccgggtgcccggctcgcgccgccaggctctgggatcccaggtcgccccgcccagcagcccgcgccctgctcggtgcgctcagcgtccccgccccttaccccaaacccccaccctctgtgccctcaggggggcacccccatcggggcgggaggggggggtcagctgtgccccggtcgccgagtggcgaggaggtgacggtagccgccttcctatttccgcccggcgggcagcgctgcggggcgagtgccagcagagaggcgctcggtcctccctccgccctcccgcgccgggggcaggccctgcctagtctgcgtctttttcccccgcaccgcggcgccgctccgccactcgggcaccgcaggtagggcaggaggctggagagcctgctgcccgcccgcccgtaaaatggtcccctcggctggacagctcgccctgttcgctctgggtacgtacgccggctgcggcgccccctgcgccgcgcgacaccctgcttcccccggtccccgccgagttcccctttccgggggtttctgcgcccgcctgggagagtggagagaagcgagtagtctcaatgggttggcgcctgggaggcaaggggagtcattaagaatgacaaagaggggactgtccggtcgagcgccgaggcttccccgggaaagtggctgcctgggccgtgcgtgagaacacctgggaaggggaagcggagtgtgaacgggcttgaactttaatccgccgcagctgtgtgtctgctcagacacatgcctacacctacctgcttacctggctgcctccaagcccggctcagccggcgtcgctggcgtgtagactgggccgcctcggaacgggggccggcgtctaaccctctggccgggtcttgcctgcgcccctttggcaccccctgcccacctctaagccccagcgacgagcagagatgttcaagatcggcagaggcgccctcgatctcttttcagagctcttgagctttgggggtaggttttggatttttgggcggattaatggttcctttaattaacttccctgggagaagtggtttcggtgtccgccgagggcaggagcgaaaccctagaccgagtgttgccagtttcctttgagtatgtccttggaaatgaaggagggatgggaaaggtgaggggaagttaaacccctctcccgggtcgggtctgcggagcggtgcgttttttggcggtgaagttcaagggtctgtctggacgcggtgagggcgcagcgccgcgcgcctcctggccaattcttgccccttgtgctggtgggtctctctggtgttgagatagctgatcaatagcgcaggtgtcctggttattgctagtcttccgtgaagtgaattgttcgttcgatatgccccgagtttaacccgtatagcatgcggctcgctgcagggtggttagagtctgtggaaagccatggaactcctccccagaaatgcccagagccgcagcctcacccagctccgtgtacaactacagggggttcgcggccccgcctgcaagcctgccctagaaacgctgattaaaaaccgcagcagaaggggaggcatcctgtaagagaaatacaaggcagtcttggaaccggatgctcccagctacacccttacctgaaactcaccagcaggtaacatgggtatgggaggcttttcccccacatttttgaagaattgccttttttgtgtgcatgtattgactgttgctctgatttaaattttagaaaaagcaataaaacattaccaatacaagggaagcttcctggatataattatcccttgtaatgtttttgcaaataatagtagtaagtagtagtagtaataacagctgatgctattcgagcattttactctgtgtcagacacagtccaagtgctttacatttattcatgcagttttcacaccaaccggataaagaaggtgttaatattattctcattatatagcagaggaaagtaaagcacacagggtccacagtaagtaactggaccaggattgtcgaagaacgtggaaggaatgtgaatatgaaaagtcacctaacttgtggtcattatagtcccatctctcttttgggactttgccttaaagagagattatgtggaataccctggaacttgttgttaaattgagtttcctattgaattcctgggatctcaaggtggttattcggtaaaaattagaggcaggaaatgatgaagataagcacatttgagtaagtgtttgaaagctgtccctacaccccacactcccatcccagaattctcgcccacaaagactgcattcattcatcatgtaatttttctcttttgcctgaatgttcttttcagcttgatctttgtttccttctttaagaaaatgatgtataaactttaaaagattgatcaatatgtaaaaacttgctcacacagttccaaaatgtgagcagttgaaaaaagtggagaaaaaaaaaaggcaggagtaatttacaccagtgaggactcctttttatttatatgtctttaaaagaaaaatcacagctgtgagttctgtgcgtttactagaactgctgcctcccacatatagctttactttgcacatttccttcaaagctgctttcccctctgatttttcttaaatagttgaaggcagttccaggagaatcaaccagtgttccatcgctacccgagatctaggaaacctccgtggggctagtctgagaaggaactggctgttaggagtctcggttaatgtttgattacttggaacctgagcattgattaatgttttcagtaagagaatgtgaagactgttgcccaaatggcaacactggaaacataacccaggttcctgtggtggctgccctcccatgtcaggtttccatcactggcaggcagaccgcacgggggcttggcatttccagttacatttcctcctctgtgttcacggagcaagatgtgtgatcttgggcaagttacttagcttttctatgccttgtttttctcacctgcaaaatggggatattaatagggttgttgaatatatttaatgtatgcagaagggtgcctggtatgtagtaagatcttaatcttatcatcatcatcattgttgttgttactttgggccccatagaattccagacatcattgcaggttatgtgagttgtataactgggagagtttgtaggttttcgtttatctcatctccatgctctttaccattccttcgaaaaatatcacccaacctaaaaacctacctaggtaatttctggtgaatatgatttggccaatgacaaattcaagcaaatctggagggtttttttgttttgttttcttttgtttttttggttttttgttttttgagacggagtctcgctctgtctcccaggctggagtgcagtggcgcgatctcggctcactgcaagctccgcctcccgggttcacgccattctgcctcagcctcccgattagctgggactacaggcgcccgccaccacgcccggctaattttttaaatatatttttagtagagacggggtttcaccgtgttagccaggatggtctgcatctcctgaccgcgtgatccacccacctcagcctcccaaagggctgggattacaggcgtgagccaccgtgcccggccctggaggttcttttagacatcatgaattctttaattctttttaatttaatcttttttaattttaattatttaattatttaattttttatgcaaattttttgtatctcctttagtattcaacgatcagttgtttatggaagttagcactaagttccagttttgtcatctgtaaagtgggaataataaaactgtgcccacctcacaggctgttgtaagactcaaatgagatggtaaatatggaagctatttataaaaaaaaataaggactgcacacaaaatgcaactgatcttatgatacaaaaatggattttataatccagagataagctttattatttttatggcaactcccgtaagtaaggaccgaatgtggacctaaagaatgatgtcataggaaatgaagtagcattaaggatgggcagaggcgaaatagatcaccttccctgtttaagtcaggactgagggaccagtacgggaactgaaagaagacgtttcttttctctattacctggacgtgatgtctttcagagtagacagtggaggttttcctaggacacatgttttccgtattgggcagccataattagggagtgttcacttagaacatgggctgtaaagctgtatatggaagccttagaggctgagttttccatatttgcttttccagattttgggttcctcaggataaagtgatctttctataaatactcaatgtcccctgcaaaggggacttttcttataggaataagtgatgcttcttgttactgttactgtggcaacatatgaaaaatagatgacttttccattaggcctaaggaccttttcaaagtgtgtcttgaacaaggtcctactctttgcactgccctctaaaagggatgggcaacgggaagaggaggtttggttaatggaaatgaaaatggcttgtacacactgaattaggcatcttgtgcttggtgtcacactcaaaacctctgtagtatcctctacagcaggccttacattggaatgatctggagggctggttaaaatggatggccaggcctcctccactgcggttgtgattcagtaggtgggaggtttgcctggctgacaagttcccaggtgtggcgtatgttgctgatggggaaagggcagaagggacccttggagaaccactgcttttcagtcagttgctgttagggaaacttttggcttaaccaattgcatgttacctaaagtacgttcagacgcttgtaaatgccaccgtgaatttacaagctactattaaaggcactttaaggcctgtcatgccgaccaggacagagttagccctcttgctgagacgtcttcattttaagtgttcttgttcgttatccatggaaaatgtaacgatcccatgttattaaacttaagcttgccagtgctaatcatgtcaccttttcctttggattaccaaaagctgaccgttgtcttgctgccgtttcaaatatttttaatcacctaattaaaaatatgaacatagctctttgctaaagggctaatatgtttaagactgcacttagatagaggaagattgggagacttttatggtggcttttggttttgtttagccttttcttccccctaggaaatgtcaagtataaaaatctttcataggctcaagaaagccagaaatctacactaccaaaaccatctcttaggagctcttcaaggcacattccctttagaataacactaaaaatctaggtaaaaactgggtaaaatggtaaattctgttaaggattacacgtttgttgtactgagtatgacttaagaaataaatagttgctacctgggcttagaaaaagttggaagtttattgagatggaatttaatgtattttgctagtgctctaagtcagaggaagcaaatttgtttcacatggagctgctcccctaatcaagtgagttctatgcctagcacgtttggctttaatttttgttgttgttgttcccttactgtgaaaggctttccgttttcttcaccttcgcatttgtacccttgaagtatttgctgctgcttagggtttcctcaagacggaacccctttaggtaacaaccaggctgccattgcttcacctgttttcatcttggaatgtgttaacttttccagctgggaaccccggtagcagagccctggccccactgtgttctggtttggattaatgttgattggtgcttaacctctctcctctatcagtttgagggcttcttcctcctcacctctgtgtttggcacctctgagcacaggccgagcctcagcagggaccaataagtatttgatgacctcgtggggacccagtgcaggatactctgaggtactcagttggcaaacacttggtggtgttcatgttaatcctgaaaaattctttattatggcaatcaagggtggttgcatataaagtcttgcatcactaatgctggtagtcttcaggatagcattttattgttttaaaaaatagattataatttaatgtcttcacaattgcaaatcatattttttctctagaacacttggaaaattaagacaagtgtaagagagtgttttcatgacctataattccaccatggaaagataactgattcacattttgttttagaacctgatggatctattctttatagtatactatctatctatagatatatatatctctctatatatagatatatatatctctatatatatctatagatagtatatatatagatagtatatattgtatagatagtatactatattacatatatagcatatatagtatactatctatatatataatatagtagtataagtatagatagtatactatctatacttattctatttttatactattatatagatagtgtaagtatctattctttaaaagcatatatgaattccagtgggttcacactgtttaatgtacttgtttttgtaacttaatctttcataatagtttttgtttgtttttcatgttttttttttttttcttgagatggaggctcgctctgttgcccaggctggagtgcagtggcacgatctaggctcactgcaacctctgcctcccaggtttaagtgatttccagctaatttttgtgtttttagtagagacaggatttcttcttgttggccaggctggtcttgaactcctgacctcaggcaatctgcccgcctcggcctcccaaagtgctggattacaggcatgagccaccgtgcccagccaacaaacattttttgggtcattaaacattcatctatagcatttctagtggctgggaaatactcccttgactacatttattgtaacgacttttgaagcactttgaccatatagatttttcctatttgtcactattatgaataatccacacattgttgtgggaatattaaccgatacaacatttttttaaaagtcagcgtggcaatagctacaaattttaagtgggcataacttctgagtcatcaatttcactttttgatatatcctacataaatacatgttgaaatgtgcaaagaaaaatgtagaagatggtgactattgaattgtttgtaagaacaagttgctagtaccacactgctataattatttaaggagatttcttaaatcctttatttttctatgtcagtacaatgatttactgtgtagctatttaaaagatttagctattaaaaggttttctggccaagcaaggtggctcacacctgtaatcccagccctttgggaggttgaggcaggcagatcacttgagcccaggagttcaagaccagcctgggcaacatagtgagactcccaccatggctggatcaaagatggccagataggaacagctttgtctgcagctcccagtgagatactccccacaatctcttcaaaaaaaaaagaaaaaagaaaaattagcggggtgtggtagtgcatgcctgtagtcccagctacttgggaggctgaggctggtggatcactggagcctgggaggtcgaggttgcagtgagtcatgattgagccactgcactccagcctggccctgtctcaaaacaaaaataataataataaggtttttcattgggatggagagagggagcaagtgttgaaaaactgtctattgggcaccattcttactatctgggtaacaatgaattgtaccccaaatcacagaattacacgatatacccatgtaacaaacctgcacatgtacccctgaatctaaaaataaaagttgacattaaaaataaaaaaaagtaatgaagggtttttgcaatacactaaatttaaaagggcaggttccagtgtcttgctctgaattggttaattttttataagaagcatatattaaatctatagtgcctaaagtcaaagaagtaatacaacaggcattcttgtacagaaatgtttggcacatcctgtaatatttagaataaatttctagaaattggccttttctctcactttcttgatcttccataacactgtaagttagatttaacatttgccaagttgattggagaaaaatgatctcagcccagttttcatatgtagtatttgttagagtcagtaaatttgttggacatttgtcattttgctacttgcatcttaacctttaaaaatttttttcttattgattgatcatccttttcttggagttttataataacactttatatgagaagaatagtaatcctttttctgtcatacattgcaagtattttcccccatttattttttatcttttactgttttgtttatggtattttgacatacctaaggtttttatttttatgtagcagaaactatgcatctttccccattagtgttctacctttacttatatatttaggaaaaccttttcttattccaagatatgccaatattttcttactttttttcttgtaattctttagtgatctcatatattatgttgaaatattttatctataatttttctagggtatgttgtgagatgtaactcattttcattttttgaaacagttaaccagttagtagtctaaaatgctatttatggaataatctacccttccccctgtggtttgaaattccattttcatcatatgacaaattctgtttttttaaaacaactaaaaccggttctttgtaaaattataagatctggggcatactgtggcataggaactaagcgcacaagacttggactctcacagactctggattcaaatctcagttctgccctactagcagtttaaaatgagacacaatatgctttcttcttcttcctcttcttcttcttcttctttttcttcgtcttcatcttcgtcttctttgtcttcttcatctccttcgtctccttcgtgtccttcatctccttggtctccttccaacatttttacaatttttaattcttgtgggtacatagtaggtatatatatttatagggtacctgagatatttttatatataggcatgcaatgtgtaataaacacatcaaggtaaatggagcatctgtgacctcaagcatttatcccttgtgatacaaacaatccaattatactcttttagctattttaaaatataaaattaaattattattgactatagtcctctgttctgctatcaaatactagatcttattctttctaactattttttgtacgctttaaccacctccactcccacaccacccactaccctttctagcctctggtaaccatcattcgactctgtctccatgagttcaattgttttcattttcagctgccatgaataagtgagaacatgtgaagtttatctttctgtgcctggtttattttcatatgctaaattcttaagtattggaatctgtttatggaatatcagtttggttccattatttggtatttttgcccttattgtgaatgtgttcactcatttattctgcaaataattaccaagcacctgttctgtgctgggaccacttctagatgctagggattcagccaagaatgaggcagagttccagttctcgtggacctgtgttctaatgtgggagacatttccccctgctatctattctaattggttattgctggtatataaaagcttttttttcatatttatatcttaacgagttttgttaattctaatagtccttcagttgatcctcttaggttttctaggtagatgatcatttaagcttgaataataataactttgcctccttccttttaatattttaatctcttattaaatatcttattttaatcttttattaaatattaaattattaatatttgaatctcttcttacttatagcatagaccaggactttaagagcatggtttcttaaaaggcagtagatatccttgtatttttcatggctttacgggtaatgtttgcgcatttaacacttaagtacgaagctgactttttggttatatattatatatacacatatattctttatgatgttaaaatatgtttctcatcataatttactaaaagagttggcattttttgttttgttagttttttaaagcaggaggcaataatgtgtgggttttttccctcaaatgttttgaggacattgattgactcaattatgttaaagccacctttaaattcttgaaataaactcttcttggctatgtggtattattctctgtataaactgctagatctgctccattatgaagtatttggggctttgttttcttttttagattttgatatcaatattatgtcagctttataaaataaattttaaagcatctcatcttttttgtgttctgctagttgaagtatcaggataaccaacaattttgtgaaggcttgaaagaaattgctaagaagcttctggcctggtccctttttagtggtcagttcaaattttctactttttgagtcagttttggtaattacatattttcctcacaatctattcaactcaaatttctaaaattttagcatagatttataaatgaactccttttaattaaagaaacattttttgtatctgtggccccagttaatgtagtctttttttttcttttttttttttttgagacagagtctcgctctgtcgcccaggctagggtgaagtggcgcaatctcagctcactgcaacctctgcctcctgagttcaagcaattctcgtgcctcagcctcccaagtagctgggattacagctgtgtaccatgcccagctaatttttgtattctttagtagagatggggttttgccatgttggccaggctggtctcaaactcctggactcaagagatccacctgcctcagcctcccaaagtgctgggattacgggcatgagccaccatgccaggcctagtaatatgactttaacaaatgtgaaataaagtaagtatcaaggcccccaagataagacatattttaaagtttgtttttcttgatgatatttagagggaaaaaacccttcttttatttttaagttttctttttattttttttaggtggagtttcactcttgttacccaggctggagtgcaatggcgcaatcttggctcactgcaacctccacctcccgggttcaagcgattctcctgcttcagcctcccaagtacctgggattacaggcgcccgccactacgcccggctaatttttgtatttttagtagagatagggtttcaccatgttggccaggctggtctcgaactcctgaccttaaatgatctgcccacctcggcctcccaaagtgcaaatacccttcttttaaataaaattgaaggaaaagtttcataagtaacagtgttcccataagaccaggtaaataaccttagtttgtctgcatacgtgcatataccacagttgttatagcaatgccacttctgatttggagagtatatgacattgtaatttgtagctgaggctgctgagcagcatcttgatgctttgttaaactttaaaaagcttgaaaacctccaaatacaccttaaaaacctccaaatttaccattgtgtccattaggtgcacaaccaatgcttatatgagagaatttattgttggttggttgattttgtttattttctgctgtgtttttaaaatcagcacttctaggttaaaatattagattcttacaatgagaccgtatcttcagcttgggttccttaggggctttagtctgagtttgaatgaggtcagtaaacaattctcctaggcgctgagaggatagatatacctttactcgttttcatcatctcttgccaggtctgaggcattctctttgtaattactgtacttccaagaggcataggagattaactggctaatagttcaggtaatgtggtcacacaaaagtggctgaagctgataaacaaggtgtttgcaattacagactttcctcccttccctctcccagttcttagcaactaacaaggaaaactcaaatttatgatatatattttttgggggggttgacagagcttaagatctgtaacttccgccatggcagcagccctgaggaattgccaaatgaattatggtggccataacctgtccatcttatttgtcaccgagcgcagttggaaacttttggctggaacccttctcacctcgggatggtttctgggttttaagttttgcagtggaggatcgcatcatcaggccggtctgcgtgctgtacacactccctgccagcaaatttcaacaatgacagatgttttttgcacatagcagacctagggtgttataattagggtttcaggggatgaatcataggtccctgaactggaatgaaagcaagcctggggcctgagcagtttttaggaatgtgaggtaaactcatagatcacacagatggagaatccttctggatctggactctctctgaatctcatcaagcactctcctcccccaacaaagaaaaccctcaaaacaagcacacccctgtgctggccacagcgccggcctcttctcattcatagaacacgtgcatcctctgctgccatctccctgtgtgagctcttcacgacacactccttttccaccagcctcagttcaatcctgcacattgttttcccaaaatgaagcagaaatcagaatctgcaaacagcgtgtaaaaacacccccagattgactcaccagagacatcctcttactagatttaactgccaggtgtcctaccagccttctttctgggcaaggatacagatatttgtatagtcatttttttcccttcacaacattgctagattctgttttaaaatctgcttttcgcttacagtatatggggaaaatatttctgtggcaaacatataaatatatctataaactattaatttttaatggctaggatatattctgttatacaactcttatcacttattaatccatcgctattgatggagatatagattgctttaaacttttaaatattcaaacctgaaatgaaaattcttgccactgagttattatcagcattttaaaattattttctatggatgaatcatgagaaattgatcactaggtcaaaagtttcacactttttttgtctcttaatatattttgacaacagaaaagctgtgcacgtttatacttctattgtttatgtgtgaatggttgtgaatattttcattctctagactttgctaattctgttggcaaaatggtatctcattttaatttgtatttctttggttttcagtaagattgaatgctgcttcatggttgagtatttaaatttattttcttgtgagttacctgtttgtatccttaggccctgttttgggtaggttagtgattttattattgatttgtaagcagtttttaaaaatacacactgaaaatattttgtcatcttgccttttaaatttatgtgagttgtatttaggtttactaaaagtgtaatttttttgtttttaaccttagggactaaaaatctgttcataatccctttatgatttctacttttgtgtaatacttagtcttggggtagaaatgattttctgtgactctttgatctctgatttcccctcatacatttatgtagttaccttcaaatctaaattttaattctttgggtgtggattttggtgtaagatgtggggtaaacatctaacttgcctttttgtcaaataatgatccagttattctaacatcatttattgaatagtttattctccactcactgatctcaaatctcactttgtcacttgatacattcttaggagtacttgggtctgtctgtcgagtttctgttctgttccattgatctaaggatcatggctataatgaaccactcttatgagttggaatgtgttattgcactagaaaattaaggcagaaaatattcaggaccaagaagataaagtgtattccagtggatacccatcacttctaaccctcataatgagaccttgacttccctcctacctaggtgatgttgaagggaaggattacttaccacgtttctctctctgttctctggccattctctcacttggccagagactggtgggcactgggtcttactgtactgaaaggcatggtgaacctgcttatcctctctcctattgtttctggaacttagtgttttataagaattgggccgggtcatgaggcaggcctgcaatcctccacattctggtgaactgagactgtctattttcatgtccccttctcaaatgggagtactagtgtagagtatgccatggcatatgtggaaccacagaccacacctggcacgggaacaactagagaatgaaaaaggaacttaagtggcaagtcataacattgttttctatattaaaacaaacttagatgtgttaatgaataggatgcaagattgaaatatcaaggttgtctggctgtggtgtctcatacctgtaatcccagcactttgggaggccgaggcgggcagatcacttgaggtcaggagttcaagaccagcctggccaacatgttgaaaccccaactctactaaaaatataaaaattagctgggcatagtggcaggtgcctgtaatcccagctacttgagaagctgagacaggagaatcgcttgaacctaggaggcggaggttgcagtgtgctgagattgtgccacttcactccagcctgggcgacagagtgagactccacctcaaacaaacaaacaaaaatatcaaagttaatttttaggataaaagataaggctttatgtaaattgtgattttttttttcttccattggattgcttcaggctgtgttcccagactagagggataggtatgagttccctctctctgccattttacgggggttttgatggaaaagtttgagaagtataggcatacctcagagatatagcaggcccagctccgggccaccacaataaagcagatatcacaataaagtgagtcacatgaactttttggtttcccggtgcatataaaagttatgtttacactatactgtgttctattaagtgtgcaatagcattatgcctaaacaaattacataccttaattaaaaatactgtattgtttaaaatgctaacaattatctaagccttcagcaaatcataatctttgttggtgaaggatctcaccttgatgtcgttggctgctgactgatcagggttgtggttgctgaaggttagggtaactggagcaatttcttaaaataagacaacgatgaaatttgccatgctaattgattcttcctttcatgaaagatttctctgtggcatgtgattctgtttgatagcattttactcatagcagaacttctttcagacttggagtcagtcctctcaaaccctaccactgccttaccaactaagtttatggaatactctaagtcctgtgttgtcatttccacaatgttcacagcatcttcaccaggagtagattccatctcaggaaaccactttctttgttcatccagaagaaataactctacatctgttcaaattttattgaaattgcagcaattcagtctcatcttcgggctttacttctaattccagttctcttgctattcccaccacatctgtagttgcttcctccattgaagtctcaaacccctcaaagtcagtcatcagggttggaatcaacttcttccaaactcctattaatgttgatattttgacctattcccatgaattacaaatgttcttaatgtcatctagaatggtgaatcatttccacaagatttttaatttactttacccagacccatcagcagaatcacaaatctgtggcagcaatagcattataaaatgtaggtcttaagacttgaaatttgaaattgctctttaatgagcatgggccgcatagtggttgctgtgttagcagtcatggaaacaactttaagctccttacacagctccatcagagctcttgggcgacccaggtgcattgtcaatgaatagtaacattttgaaagaaatgctttttttttctgagcagtagatctcaacagtgggcttaaaatattccataaaccatactgtaaacagatatgctgtaatcaggctttgctgttccatttgtagaggacaggcagagtagatatagcataaggactttggaatcttgaatggtaaatgaacattggcttcaacctaaagtcaccagctgcattagcccctaacaagagaatcagcctgtcttttgaagcttttaagccaggcattgacttctccatagctacaaacatcctagatggcatcatcttctaattgaaggctgtttcatctgcactgaaaatttattgtgcagagtagccaccttcatcaatggtcttagctagatcttctggataacttgctgcagctcctacgtcagcacttgctgcttcgctgtgcactgtcatgttatggagagggcatctttccttaaacctcttgaaccagcctctgctagcttccaactttcttctgcagcttcttcacctctctcagaatcaaagaactaggggcttactctggagtaggctttggtttaagggcaagttttagctggtttgatcttctttccagaccactgaaactttctccataacaaccataaggctattttgctctcttatcatttgtgtattcactggagtagcacttttaattttctccaagaactttcccttcgcattcacaagttagctaattgtttggagcaagaagcctagcttttggcctatttctgcttacaacatgcagacttcactaagtgcaatcatttctagcttttgatttaaagtgagagacatgccactcttcctttcacttcaaaactgagaggccattgtaggtttattgattggcctagttttaatattattgtgtctcagggaatagggaggcctgaggagaaggagagagatggagaaatgactgataaatgtgtgttctgactgctccattgatcagctaagtttgctgtcttctacgggtgtggttcatggcaccccgaaacaattacaatagtaacatcaaagatcactgagcacctgtcaccataacagatattataataataatgaattgtgattattaccaaaatgtgacacagagacacgaagtgagcgcttgctgttggatagatgccacaaactttaaatttgtaaaaaaaaaaaaaagaaaaagaaaaagaaaaaagaaaacaaaacaaaaaaccacagtatctgtgaggcacaataaagcaaagttctatcaaatgaaatatgcctgtgctatcccatgtggatgactaattttcagatactcagcacagagcaaaacagtaactaaaatgaatcacttcatctttcttctgtttactttgcacttaattggctcttctctttctagtttcctaaagtggaagcttagcgtattgattttagatatctcttctttgtaatatattcagtaagtgctataaatcttcctctaagcactgcttttgctgcatcccacacattttgataagttgtatttttcttttcatttagttcaaaatatttttaactgctcttgagtttcctttttgacccatgtgttgtttagaagtgtgttgtttcttctccagtactgggggatttttcagctctctttctgttattgatttctagtttatttccatcgtggtctgagagcatgcattgtatgatttctatttctttaaatgtgttaaggtatattttatggcccagaacgtggtctctcttggtgaatgttccacaggagcttaagaagaatgtgtattctgctgttgccagagctcaactatgtccttactgatttctgcctgccagatctaaccacttctgctagagggatattgaagtcactacccataatagtggattcctctatttctccttgctgttctattagtttttgcctcatggattttgacactgttgttaggtgcacatacacattaaggattgcttagtaacttcgtcattctttaatgattcagaagctatttctgcgtctctcaataaaggtcttctctaataaactctttatgctcatgtgatacctgtagttgacatagtctccctcagtacttgtgaatgagaagttccagtgagttcagttttcttcctgacttagttaaacagaactctgctcaattttaactttaattgtggagagagagaaaaaaagcattactccagtttcctggacaagcattctactagggtcaagataatggggctttcttttattgaggtcataatttcaaataaattcttttttgaatcctatatgggttgtagaagattttggctaacagactggtattgcaccagtgaaccacttcaaagttagggatttactcttaggaaaacaacatcaattcactatgtaatacgaccttattttcttgtgaagtgtctctttcccatacggtgcaacagagggaaaaacaaacaaaacagtcctttcaactaaattggatgttttggatttcagataaaaagcagggcatttttcttttaatagtgagagcagaggcatgtggaatatctatgctatcatcccatgtaggatatatctaagtgatcaaacagtaattgtgatttttgtgaactaggcctaatgtaacatttggtgcttaattcacctgaggtagctactttctttacttaatgcttatagaggcaatggaatgaataacaaaactaagatcagcacgaagtgggagatgctatgtatctacatatttattttggtgatttattttgtggattgttcactttagtaaacatttaactgtatattagatactctgctgggtctggtgttattaatgcaaagagaaccatgacctagcccttgccctcagctcctgaattttttatagatcatggcaggagcagacacacagttttttacaatatggcatgaggtacacagtggacaccttgggcaccttcttggtatgacagggcaagggtgctttcttctaaaagataatggccaatagttagaaggttgcctggctcatagttcttccagtaccttacatattgtacaaactcctttaacccacctagcaatcttatgagatatggtatctccattttagagatttaaaaaaaaaactgaactgaggcacaaaattgttaggtgacttgcccaagttccctctgccagcaagtagcagaataaggatttgagcccaggacccttgcctgccatcctagccatgctgcttccattctgactctccatatcagcctgtggaaggctgtggatgctgaggtgcctggagttgtttgtgtgtgagagcaccatcgtgtaacagacttgggctaaatgcagccagactttcagacagccactctccgacatatttaccatgatgagagtaattcccacataggtggttgtcatgctggttaaaaagaaatactgcccttcccagtgctaggaaatataaaaaaacaagtatggtagagtggttttttccctccttcagtcaacagttcaggtattcagatgatcacaagaggcatgctatttgacatattttattatgaccaaggaacctctaataataaattcattggtgggggcttgtttgcttttctaccataaattttttttaaaggtgtttgatttgaagagtgatctgttgatgtaggcagtctgtcccccagtgagtgacacgcctggaagtcatggggcacattgagccacagcccctggggcactggcttcacctcctcctcatccccctctacacctccccaccaacatttcccccaaacaatggcagaaggctgcagagtctttaacacttttactttaacacttttagttcttcacagtccaactaaagatagaacctgcgagagcacagttgctaatagctggcttactttcagacttgtccccaccaactttagcgatgacatgaacctacaaaaagcacaggcatttccactgacttgaaggaacagcagatgagaacaaaaatagcatttgctcttttacttgtatgtaagaacttcattcagctggcagcatttttgggtggtctttgtacctccgaatagtggacacttcagtatctggttcgggtctgcatccccaagtgttagagcagggccacagtgtgtgcattctacaaatgtttgttaaaggtgtatttttttttttcctttagataaagagagttgtatgcattggcaaacagtgtattgctaacacacaaaacaaccagtgagacagacttctttgcaatgaatgagcttctggaaaaaaaaaatgtggattttaaacatctgtctcttatttaaaggaccttatggtcttcctttaggagagtttccccttaatttgcttgtaattccaaatcattcacatctctgaattacttgaagcagattacatctactgcagggcccaccccttctcctcgacaaaagttgactacttgttaactgtgttaacacagttaatttgttaacagttaacagttaacatagttaacacagttaacaagaccagcagcctatccagcagcctatcctgctggtctgttggggaggaagagttgatgttttcagaagccaagaaactaacctatctcctgagatttaaacacacagacattagcttcttttaaaaattctgctgctcagaccagaggcccttgtggtattttctgcagtttttgtccacattgcactagaggcttccttgatcttcatctgggtcagctaatctttgtgacccacaatctaaaatttttcttcctcacctgattgatgtgcttccgttgtaacattcagcaggtgttggggggtgggggtagggggaaaaggtttaacattttataacagagcagtccctttgggtcgaaatttcttcatcttttcagcttgtacctcagaacacaaggagtccaaactgcacagaaccagtgagtgataacaaggaaaagacgctgttttccagcagtaaagaaaataaaccgctgggcgtggcggctcacgcctgtaatcccagcactttgggaggctgagatgggcggatcacttgagcccagagttcaagaccaggcaatatggtgaaaccctgtctctatgaaaaaaaaaaatacaaaaattagctgggcgtggttgtgtgcatctgtcaccccagctacttgggagactgaggtgagagagtcacctgagcccagggaggtcgaggctgcagtgagcagtgattgtgccactgcactccagcctaggcaacagagtgaggccctgttaaaaaaaaaaaaaaagaaaaagaatatacacttgcttaattattcagagatgtgcttcaccacctacaatcagggaacagcactttctggctgtttttggctcctctgggggaggaactgcctaaagcagggagagggttctgctctagcagtgactgttcacaggccacggatggggatgggctaagagaggatgggcagtttctctgagtcccgagccttgagaaatgaaccacaggcgtaggagcctagtgtatgttttttatcccagtaaataagatatgatatgcatcttcccttgaatatactttaaacaaggccggcaccagccgcccttgtgaatgaggaagaggattgtgttggaaagggaatccctatctttgtgtgcatgctcctcttccctgagccaaggccccagaggctggaggcaaagccaagcgtgcctgctctctgggggctgtgatgtcatctgactccactggggcagagcaaaagtagatgaatggcctccctgcttggccgtgaagataaagtcattaactttgggaaaactcatgtttaggttcccaataagataattagaaagcaagaacaaaatctggattgttctaaactccctagctatgtgctggtttgggttttctctattttagcttctcccataaatggtttcgtcgctttcaactggtctgtttatcacctgatgagctattttcagaggcttcacaggcagaaattttctgaaaatctggaactttgtttatataaaaaccatttgctttaaggaggtagatagattggtatgaatagctgttgatattcttgtgtactgcctcccttatactggggggaaaagaatccactttcattttgtagtcaataccaacgagtgtctctggatgacctcttgctccattggcaataattttgtgtgagtatgtgagagtgtgggtgtgtttcaagtagaggtttcatttcctacttcatggacttcttatttcacctttcctcttgcccttgtgttcattctctgcagtgacattcaagggttgatcaatgttttcattgatgacatactttacccttaagagtctctcttcacttccctctttttttccttccacccacatccttgacatagcagcagatattgtttgaagcaagtgggaaatattccatcttctgtgacaactgtgatcatttggaagtggctgtttagaaggacttggaagctgcatctgagttcagcaggaagtagtgctgtgatcaattagtaatgtctgctgtgggttctgtatggaggtggtgatacaagcgcagtgtatttgcattcttgcttgagatggtggactcttttccttaagaatgaggaaaatatgtgtttctaagaattagttgaaggtgtccccacttatgttgcttatatctcatggctttttatttttttaaacgcagtacttgaggctttaaaaggtgttccataaatctagtaccatagccatggagaatcactacggagtcctgttagacaggattggcttcccagcaaggcaaagagcccatgagggtgtggactggtatgtttgaaacccttcaggacacactggggtgtctgcctcccctcgaagtaagaggcaaaaaaacacagctaatgggactgaccatactctgtgtggacgttcaggtctgtcaactttgggcccttgttgagttatcacatgagtattctgtctggctcttagtcagaaggaacactgccttctaccttttcttagaggggaggactcctttccctggaggatatagggtatgtctcagtgctcctgcccgagcagccagctcagcatcatcacacccacttcagtggaggtggctatctctgttaaactttctcccacaggtgcagtgtggagatataaaggaaagtggagacctggggcctcagggattgctgcagaggtggtacattgagggcatagaaacctagaggagagcacagtcttgggctgggcatttgcagcttgcacgtgctctggtaccaggccagcaccgagcctgtttgctttggtccttgtggacccttcacctctgagcttgggttgctgtcagacctgcctgcaggtggtattgctgaggtctgtgctgagctagatgagacactgtgtgagcttccagaaagccttgggcatagccgttgtcatctgcaggctaatttctcctgggtatttaatgcatgtcttataagtaaacctggggttaccttagacaaaggttgtccaacctgtggcccatgggccgcctgtggcccaggagggctttgaatgtggcccaacacaaattcataaactttcttaaaacattacaagattttttgtgattttatttttggcttatcagctattgttagtgtattttatgtgtgttcttattcttcttcttccaatgtggcccagagaagccaaaagattggacaccactgccttagatggagatccctgggatctgcctgtgaatgaccaaggacaaagccttcattccaggtggcagcatcctgaagtattaatatttcagggatggtgggcagaccctggaagggaacttgaaagtgcttcagagaagttttaaactatccagaccaagataagatttactcatgtaggtctgactctcacaggagttgagcctgctaatggatatctctaagcctgagttcctacttcttcatgtttgctttttaaatttttttgagggagacagaatctcccatctgaggtggtcaggaaaggttcttgcagacattggtacttgaactggccttggaggttgaacatagcctaggaagtagaaggagaaggcagggaatagtatagatagaggcagagggaagaatgaggccaaagtatacccccacattcagtccctcaggaagttctgctggctctgtttctgttatattctatgtctgacaactctcatgtcccagtggccaccccactgtgacctttgcctgaacttctgcagtgatctcaccccattcttccagttcccacttgtgcctccttaaggcctcttctgtccccaggaccctgagtgtctcttctgtcacatgcatcagatgttattgctcctctgctcaaagtcttccaggggctgcccagcttggaataaagtccaggcccctagtgctccccactggaggcgtctgccccagcatctctccagcctcatttcccggtgtgccctcccccagccacagcagccacctgctcttttctaggactggggcggggggattcactcctcaggacctttgcacgtgctcttcctccagatatttccagatctggctccctcgttttattcaggcctgtgtcagatgtcatctattcagaaaagacatccatgatgactatttatttacacgcatccgtgatgaaaaatgctccagtgtctgtgttatttgttggagaactgtcatcacagaaaggttggaacagtgtctccttactccagatggaaatcacctagattccacaaggtgcttataaagtgctgctgctcaaataggagagtccaagtgttgtcttctgtagttcatgccccctggatgtctctgcggaactgcctggcaggtttggcttgaaaagaaacaattctttcagcaagtgtttgctgatagcttgtctatgtgtcaggcactgttctgggcaatgagaatacggtgaaccaaaaacactcccctccacctcacacacctgacttggtcccaaggagacagaaaacaaacagacatacataccataaaatgtcaggttgtaacagtgctggcaacaaagataaagccagggatgggagtgagctgcttgctacacattttcaccagaggtggatgctggacaattaaaagcccccctcgtcccacccagtgctctcttgtacctttctctcctgaagtgtaagaaggaacagggagaggaggctggaagaattctgtgtagctgtagcttcattttatgataaaggccgtgtctgatacccacttgggagccctcccttatatagctggagggtcaagaagttgaattaaactacccttgtagtaactcttaggttctgccctcttggtcacagagctcactgacaatagatttttaaaaattgtattgataacttatccccagctgagagccagagcgcctaagatacatcatcttttttgtgggaaaccacacaagcaaggccagttgcactaaaaccaggatactggcttttcttggttgtttcaaaggctgctcagattcctgactgtgtgcctgtcaacctttctactagatgacttctctggaagacccacccgccccccacatcgttctacccttccctccccactcccccaacccctgccttttccatgcctctttccacagggatcattgtttttctcggcctcctctcgtctgacatgctcccagtgtgagagtgaggcttggggtacagggcagcccagcccggcgagatcagctactgaccgaagctggtcattgcttctccctgggagccactgtgaatacatgctactatgaccctgttattaacatgtgatattggtgtagtatgtttgttacaattaatgagcaattgttcaaaatatatcaaaaatattggtatattattaactaaagttaagactagttgactaaaattagatgttactgaacatagcccttcaacacatttcaccataggtgagaaataagcgtgcttctgccctctctgttttcagcagggtagaattcatagtgatggcaaaggctggaagtgagctttgtctgtctttgcaatcagctgagcccacagggcagcagatgaggctgagagccacagtgctccgtacaaggctgctcatccacgactaagcagtgtctcctctgcatttccagaaatgtctgactcaagctgcccctgccatggcttccttaggagaaggacgttgtacttgaacctagggaaacagtatgactggacaatccagagtgcagagtaaagtcatccaacttcacagtgctgtaactgtcatcagctggtaatagaatacttttttagagtagctttagatttacagaaaaattgagcagaaagcacagagagctttaccccactgcatagtttcacctgttattaacatcctgcattggtgtgatatgtttgttacaattgatgagtcaattttggtacattattaactaaagttaatattagttaactaaagttagatataaactaaagtccctcgtttacattagggctcactcttgtagttgtacattctatgtgtttggacagatttataatgacacatacccaccattatagtattgtacagagtcatttcactgacctaaaaattgcctgtgctacacctgttcatccctttctcccctctcccaagcccctggcaactactgatctttttacaatctctacagttttgcctttttcagactgtcatatagttagaatcatacaatatacagccttttcagactggcgtctttcatgcagtaatatgtatttaagctttctctatgtgacttgatgcttatttattttcattgctgtataatatcccattgtatgaatgtaccacaatttgtttatccatttacctactgaagaatattttggttgcttccaagttttcacagttatgattaaagctactgtaagcatctatatgcagatttttctttgaagataagttttcaactaatttgggtaaataccaaggagcactattgctggattgtataagggtgtgtttgattttgtaagaaactgaaaaactgtcttctaaagtgtctggaccactttatcaattggttttgactcctgaaccactttcatttagatgagtctaatttttccagaaaatacttcagaaatacactaactgttagtaacctgaaacccttttctcactgcactcttacatgggacttaaaggtgaaatgctgccaccttcattcttctttctgtagtcttcctgctggtctctgttcttgctagaactaaaccatcctagcagaaaacttcctcttttccctctccctcctttttgcttctcatcaccaccctttccccagcaaaagttaaaggggaaaatggactagagcagggttggtaggggagatcccactcccattttcccatagcagagctattgcattttctccgggatttttgttttcctttaaaatgtcttaaattgacactgctaaaagatacatgatgctctctgccccacagctctggggttggcatgccttgttccttactggtttgtctcgagtcaataaatgagattctgcccatacaactaagtgcatttggggcattaactgaacagctttgctacacgtggctggtaagaacatgtattgacctgagggagatacattaggggccttaaaatctggcagtggaccaaaagaaagtcaaatgcatcatccccgtgtgtttcttccctcttggggcttccgagtctcattggaaccccaccactataaaacacctggagtgggttttgtgacttgtcagtcttgttactttataaataggcttcatgttgtgtaacctgaatgctttgggttaatacaaagagacagacaagacaggcacaggctgatgacctggagaatagagggaagagctgacaggaaaaagcattccaggtaaatggggcaggttggatcaccatggtccttctgtgaccattttcaaggctctaatgagtggccctgtctgctcatgtgactacaagcttgttgcatttcccctgagttttgggtacatctgcccatatacagttggaaactaaatgacctgcagttgaagagactttctctgttggggcccagaatttctcaacagagtgcactgtcaatatgttaagcaagacaaggttctgtgcattacagaaatcagaaacttagcatccgcggccccaccattaagtaccagtagtgccccctagtccttgtgacagtcagaaagcacctcccaccacaggttctcagatgctccctaaggggcatctgctaccagcagtaagaacccctgggctagcgggtggtctggtcaaggtctcccagtgaaagggagtaaatctgagtaccaccccgtccactcctcctcttcagcacctggagcctgcacttgttgcccaggcctttctcccctactagcctcttctccctcctcctgccccttgcttctggggcccaaggaggagaacttagagattctgccagtttgcagtgtgatgtgggttgagaaatgtggagctgcaagaagtaagtgtatttaccccttaactcttgaaaacctgtagttctggggatttgtttccttcttgattgaacttgcttcttaatcagccacccttatcaactcaagtgagcatgcctaaggggtgtcctgtggccagcccccaaggtggacagtggggattagcaatggggcagcattgtccccttcccccatcccctacttccaggctgatgctgcattgatctgagattctgccaagtcacactggtatttgtattggcccaaacccaaagcctcacaatgccttctgcagggtggttccggggtgtccagggtgttgtgcaccagggtgcagggatgagtttgtcatcaccaagctattcacatggaggaaatgggacagagttcaaggattgcttgtttttacctcctccctgctcataccctactttcaagccacttgtgtgaatgatgcccacacatggctttgactgagctgaggggatgggcttggtttgatttcagccaccaagagtctaactttgctggcccgaggtgcacaccagcagaaccactgctcacctgggcccagaggatggtaattctgagacatcacaggccagggaagttgagatggggccaatgggccttcacggatagggagggacttataacctccccatggatccttccagaggtggtgtttggttcctgtacttcttgtcagccaggtgccctctgctcagctggttcacaatgcaaagggcccagggccctgtggatagctatagcatctgccactttatccccagctttgtccctagcccactgccgccatccccttcttcctccctcctggactctgggaaaatcaagtgtaaccctttccagagacacctcaaggcctcgtgtcacagtgccagtcagctggaacaggttttcagagtgcctcagcttggcacggcttctctgcaacctcagaactcggccctggtagagcctgttggtgattcagcagctggggaactccagccagcccgagagggctcggcgatactcgccctgttgccttgaaattccaggaatttggatgggggccctcagccagccagtgcgtgagcaggcctggggaagaggaaggttgactcagtacccagcccctggtctaagtctttgataaggcttaaactcttcggaagagacaattgcttcctcctggcacaaaagggtgtggcatagatctgcacaggtgagagcaagcacagggccttcctcacctctagccagatgcgtgctgcatcctggttaacactgttggataaagatgttttacctatctgctatttgctttgctttatgagagagggttctctcggaccaccagatcagtgggcagccttattctataaggctttgaagtgggtaacatgttggggagaatacaggaagatgtctgtgtggcagtgtgagttgttgcatcacagtggccgggccttagaaacaaaagtgtctcaacaggaagcaactggctcctcctccaagggtctctgtgccttttttatttagttgtttattttttgcatgcttctccagatgtcaggaaaagcatttcacctccttttgcagctatgttacttctctgttaacatagctgcaaagggttatgtaacaactaggttacttctgtggtgtcagttctgggcacttgttagtggcattgactctaaagagttcaaagcagtttgccaatattctcatttgtctcttgaagtagggaaagatagtaaccagctctcctaaatcagtaatggtgggaaatgaggtctgggctgagagaaggagggacaggagatactagtccatgtgagtgacctgatcttatacccagcccagtgctggtgggtattaggaggtgcaggcagggagctctgcctgccagagtggtcagggggcatcgtggaggacttggggattgagctcgacctggaaggctggtagaaatgacgtcaggcagtaaggaggcttttctacgcagaagagaaggagttagtgtttgtaagagacccggactaggtagaaacatttgggtggaagaaagggctgtaatagggagcatcagagatacaggaacaccagtgagtgtgtttgcttcaatcatctggattgtaaactccttgtggcaagtcttgcctttgcttgaagagccctgggacacaacattcacaacgaacgttcacaatgagcgttcactcctctgtcttagcctccttgggatatggccaggcctctttggggtcactggatggaagtctttgtgttcttataaaagtttcaggaaaagccaacaaaatgagttaagggtaggaaaataaaatatttcaggggtcatctcatcgggtgaccaaacaatgcaggatccacttgacaggccacttcagcagacttaaatccgggctttggataaggatgacagttccttcattcctcatggatttttcaatattgtagtgggaatatttaatatcatttaaatagaaaaacacagatttaacttaccacccaactgaacaatggtacagctatttataatggagttcaatggcttttgagaattggaaggatcctttctcataggaagggacttttcattcattgctctctgcccagcacctagacaatgtcccgctaatggtgcagcaggtgctcagtgagcacttgttgaatgaatgaatgtcaggattcaagtgctctgtgcagcaaaccaccatggcccacgtctacttaagtaacaaacctgcacatcctgcacgtgtacccctgaacttaaaataaaagttggctgtgatcccagcactttgggaggtcgaggcaggtggatcacttaaggtcgggagtttaagaccagcctggccaacatggtgaaacctcgtctgtaccaaaaatataaaaaattagccgggtgtgatgacacacacctgtatcccagctattcaggaggctgaggcaggagaattgcttgaacctgggaggtggaggttgcagtgagctgagatcatgccactgtactccagcctgggcaacagagtaagactccatcataaaaaagtaaataaataaaaaataaaagttggaaataaaaattcaagtgctcctcatctccactgaaattagagtaagaaccaagacctagagctgtagcggcagggatctagactagaagtaaaggaattcccgaggatctgcaggttttcccattccccatctgtacaccctcactactcactacccagcccctagtccaagtctttgatgagactttaactctgttttcaagctggtgacctcttagagaaattcagttcaacataaatgtattaaaatcctatgtaggtgcgttaggccaggtgtaaggatagagatgatttagccacagctcctgaccgcactagagaggagagacaggtaagatgtaaaaacttctgaactgcaaggcagaataaagtaaggattcctctgaggaagaaatgattatttctgacatttgagcaaggctttgagaggccaatttgattcccatgggtagaggatgggatatgccgacttgagagatcagcatgatgtgaatgaaaactgtcaataggttcggtacggtggcctgcgcctgtaatcccagcactttgggaggccaaggcaggtgaatcatgaagtcaggagttcaagaccagcctggccaatatggtgaaaccccgtctctactaaaactacaaaaattagccaggcatggtggcgcgtgcctgtggtcccagctactcgggaggcggaggcagaagaatcgcttgaattcggaaggcagaggttgcagtgagccaagatcgtgccactgcactccagcctaggagacagagcgagactcaaaaaaaaaaaaaaaaaaaaaacaaacaaacaacaacaaaaaaaactatcaatagtagcagctaccatttgttgcatgtttattgtgtgtcactcaatataccacatttttctcatgtgtctctcgtttaatctctaaacaaccctgtgcaagagttggatatctttatctgcttttacagtgaaggaaactgaggctcaggcaactaaactaaagtcagcagccataagaagttgggtgaggatcctagtagcatgaacccaaggcaccaagttgggagtgccaatttttgtgcagggaaaaggggcagtgctgggcagctggggtcagaggacctgacaggagggaatgggtggagtttaggtggaaacgaggtctaggatcaggttatgcatgctaaatctctactcaggacttggggctgggttctgtctctgcgctgggttctgtgagtggtacagagcccatggagagcttagaggataggagtgatttcattcagcaaggtcagtctagtagtaggagcaaagatttttttttttaagctgttggcaagaaaaccagtctaacaactattttgatagcacagggagagatgatagggcctgaattggggcagtaacagcagggatgcagggggatggataggatggacggtgtggaggctgggtgtgtaggagggcttggcttggatactgggtgaaggagagggaagggctgacaatgactgcctagttatcagtcccgcccagaaccaaggaagaggtggaagacatgagttcaattttgaacacatgatctggggtacaggccttgtggagagtggtggaggttggagatagtgtttgggcatggaagcaggggaagcatctatgggaatatagggtcggtccggtgccttggtgggctgtagtgataacttcaacagcctacacttgtctgcctttgttgaagtagggaggattccatttttctcgggtagttgctgtcccacgtgacttgaacattttaagggaaagtcaaaggtctcagatttctctttttttacttaatttgctcacagtatgtaggtgctaaataaatatttgattagttaacataagtaaataacaattttttttttttggagtgggagtctcgctctgtcacccaggctggagtgcagtggcacaatcttggctccctgcaatctccgcctcccaggttcaaacaattctcctgcctctgcctcccaagtagctggtattacagatgcccaccaccacacccagctgatttttgtatttttagtggagtccgggtttcacaattttgactatttaaaccctcaaaaggcgtaaaaggcatgctatttcaagatcagtccatggaacatcagtagcctgcagctgggcgaccccggggcctcaagtaaaacccttcgttgaagttcccttagtgatttccaaagggaggagggtcatgaccacctcctcatcatcctgaacttcctggaagttatgatgaaacaggaccaacatgaagccccatcaagtgctgtgttcagtgggtgctcatggtgacttatggacctcatgtactctatttcattttgtttcacttaatccttgcaagtcccatgaagggctgttatccttgttttatggatgagcacaccaagccttagcaagggtacataatagagccaagatctcacagtgaaggagtggcagagccaggatttgcacccaggcctgatggcaaagcccctttctgctgtgctgtgacaggctagaaagtggtagggggttgtggtgcaggcacccatctgcccatctctcttgcctccctgatcctgaagattcattctgaatactttgttttttgctattgtcagatatgtttagatggatatggaaaattcctatgagctttcaggtaatgctggatcatttcctgtgatgtcataatcatgaagtatttcccgagatttttctagttggaacttgctgctgtccaatggagatgccacatggctacttttgaccttaatatcccaatgagtttatggatagtccatggtacgctcatcctaccagccttgctcatagtcctcctctgcagggccttccctttttccttcttaatcagttcttaccctgaagccagcatcctcacctggctgtcaacctcttggatttaaaaatattgatgaaatcatacaatttagtgatttttgctacgcagttaaaatcctgccatgcttgcaaataaaatttgaatgttgggatataattcataagggaagatgccatgaacctatactatctggccctgggttctgtgtggcccatttctttatatatttatgcctacatgggagcctttgcagacctctccctgagcagcaggattcccaccgtctacgtaccactaactacttcctgttccttaggacctgccaggtctaagaatggtaggggaggaagggggaaacctgctgccctctgaatacccacactcccttctgccctgccctctagcacaattcctatcctcccgccctgagcgtgttcttcatccaaaggcctttcctcaccacctcgtctgaatccagaacatccttcatccaaaaggacctgctgcagcctcttcatcctcccacatccccctgaaaacaaaaacttacccttcatcccttcatgcaggaagtctggcttagaggatcccaaacaggtgaaaggtagagctcttgatattctagagggagcaactgatccatgcagtggagtacataggggcctgaaagcaaaccccagccccagcagaggccagagcaggacatggtccactctgctgaggtggtcaggggccagaggatgctcctcccagctccaggcactatagctgagtgtccacagaagaggtggtcaccaggccaatgggtggttgatgatgaagggtgtctgacgctgaaggcacagcctgggtatctgtgcagaattgctagtcccatgcctgattgaggagttggagtgggggtatcctgctctggggcccaggggagaggggtgtccagcctctcttaagagcatttcccattgacacatcagcacataggttttgggatggctccacttctggggactcatgagctaaatgggtgagcctcctttttaccttgtttctgttgggaacatttacctgagtaccaaacagctgaacgataagcatggcaacacttgtccttcctaagggcagaccaggttcccactctattttgagggacacaggatcagcctttcataagggttttcttccgttgcatgtggttttccccttgataccacccccttcttttcttttttctttttgaagtccacagtcttgggatttccctctttggagctatttaaacagaaataggatgccagcaggagtggcctagaagggattcctagaagccttcctgtcccgagggcctgcggcgggcaaggacctgctttgaaacttaggcaggaggagcctgtggctgtgggccaccaggcctgtgcactgtgtgtctccctgagccactgcatgtggctgcggtgcctgtggctgtcctctccccatccttcctttgtttggagtgacccttggagcctgccaaggccacatgtttctggaaggtcctcacacagcctggctttctaagcacagtcgtgtggccagagggctgggcagctggtgagcctgggtgctcatacctttgcccctcattagaccttgttcatggcagggagactggaggcagtgggagaatccccaagaggcaatgcatgactctcagggagagacggatcaaggctcagccgctgggcctgcagagtctgttgtttggactaacttggggtttgtgactgctgaatacacacctgtgtcacaactggccatggtgagaaggactgtggtgtggtctggtaattagacactgtcttgtgcatgggagttggagacacttgagtttgaatgtggctgcaggagcttgggcaaatttcttaacctctctaagcctcagtttcttcatctctatgactgggcatttctaccagctggaccagaaggttgggaggcacctatgtcatgagttgttataaggactaagtaagagaacacatgcagaacattagcactgggcctgggactaggtcatgcccaaaaagtggtacacatccacctgcaaagtgagagacctgagccctgtcctcctgctccagggtcctcttaggttcaccacatgatgaagacaaagcagaggccttgccgctcatcacagggcctcagctgatgctaggcatggatcaagattgcagagtgaagcccagggcaccaagaagttgttttccgtgagggtatagaaaggacctattcttcttgtgttgctcaaattatgaataaaaagccagtgtctttcatctgtggaacatcgtggttttgcaaactttaattcattcccaaaacacctctgtgagtttagcagctgcgagctcacaggtgaggaacagaaggtgaagtaatttgccccaaggctggggagcaggcccccattgcacaccctcatcttcctggagcagtggtgctcatcagtgtcttgtcctggattcagctgtacagtgtttgctttcttgtctgggttttgcttaaacagaggccaacatggagcccaggaaccatgctgactgggttcaccctgactgacaggatagggagcaggaacagggcatgaagataattctttagttcggggcagtttgtgacaggcaagtcacgcttcccctcagagtatgcaaagcatccccggtgtcatccttgaacactattatgagtcactggctgactttagccaaggatggtttgtggcagtgccagcgaagtcagaacatgactgttccccagcttcaagggggcaactgctgacttttcccggcttggatggggatgccttgttttaacactggtgtgtgggtgacagaggggccctgggagccttgcttccaaaattagcatcaattggacagcaagaaagaattgcacagggaagacatgcatgattttactgattttctctccctgtccccctgccctgcctccaactccagcccaaacatctggcttaggattctgtaaaagtctttcggaggtccatgccagacctccagtaaaagcagtctgaagttcttatgtttctcatttcagaggttggaaggaacatcgggagcatgattgctttatctattccaagtgtgttttgttctttgagagtcaggacttctgtgtctacaccctaagtgaaaaggggcaaggaaccctcacagcctgcagagtagggggctgcatcgatcctgtaacagacagaactttgcttgtttcctgtgctaacttgattcatttgctttctgagctaacctgtcagaggcccagcccctcggcacagcaactgtggcatctttttgcgtttcagttttgggaagtcattctaatgtggctcatgctgattgcataactcagaagaggttccttcttcattggaaggttgctaccatttccagaaacctcgagtactgtaatctgaaggcacataaaggtcatctgttggcagggctggttttatgggcatgcaacctgtataggtcacacaggaccccatgctcacaagggccctgagcttgaggtttaacactctgcagttgcagtcttaaaaatcttgtagttttatctttaaatttgcgtcttgtaggtgaagtccagtgggacaatacagtatgcactgggggcttagaggctttgttcccgtggtcctgcttattaatatctccctgcctcccctaggttttcttgctcctgccatgatctatccctggcagggcctggggttaagtacatggcatctcagggtacggcatggtggcagctgtccccattctggactggcagctccatggcatcttcagtgggcaactagagaggggtgagctgcttgactccccctgatccaggtacctagtacatcctggcagggaggaggcaatatccttaaggggtcacccatccatcttgggttgggacagccacttcctgggaataagagatacctgactagacccctcaacccccagctgggtcacagcacattggcccggctgccagctggaaggaaaccccagagggagtgggtcctttgctcccttacacactctgtccctggggtatacctgtgagaggctgcactcaacctgtgggtatcctcatacccaaaggacagcaatgacataaatagcaaacaaacatgatgacatgaacaacagggtgaaggtacttaatgtcactgaaatgtacaattaaaatggttgaaatggtaaattttatgttacgtatattttcccaccataaaaaaatatatatttataaggtgttaagaaaaaacaaaggccaaaaccaccctgacagatggagagagagactgggaagaagtggaaggctctggatttcagtgcttttcatgggcattttcttcttactttttcaacaaggggtcccatgtgctcattttgcactgatatccacaaattatgtagctgagcctgtctaccggccactctgtgaaactaccgaacctttgcctgtcaaagggcctgccctctaagcgtctgaggacatcatttgccaagcagactctgaccttttccctcttctcctccacccaacaggtattgtgttggctgcgtgccaggccttggagaacagcacgtccccgctgagtggtgagtgcagctgccgtgggtgtgtggatcgtgtgtgggaagggagcgggcctgctgctgtgtggctcctcaagagctccctccctggcctcctgcccaccgagcacacgcctgtcccggagtcctctctgccccctcctcaggggcgaggaggcgctcactggaaggtcttaactgcaggcccaagggggggctgttcctggccccctcaggggcctcccctacgtgtctctcttcagctgttcagacaattcctgtgggcaagtgtgccaaaacagggcctgcaggaccccagagcttggggccagctgttttccccactctcgtaatagtccacctgaagtagaacccagatttctgaaccctcatcggtgacctttgtttagttattttctggtttacgttttaatacttatagtaaaaaaaaaaaaaaaatcggtatttttttttattattattttaaagattctaaatcaaaatagtggagagcttgggacatgtaggaggcaaaccatcagtggccacagcactgcaggggagcaacctctgtttgatttgcatgttgcttttgccctttctccatgtgtgttaatatttttatacgagtagtcctggtgaggaaacaatgtggattcctgctttttaagctcaaatgttggggctgtgcattgttccatgttgctggaaagtcttgaaatctcttctcttaaaatgtcatgctgtctcattaaagtgaacatgggtgatttaatgaaacatttcccattggatatttacggtggctctagtttcttaagttatgatgctacctcttcatgcctagaagctttttccaccttttggattctttcctcagcatgtgtctccggaaacaggaataaatacagatttatgacccttggtacaaactgccagatagctttccgagtgaatggtgctgatttctcccagcagtgtgtgagtgcaccagtcccacaactccctggttagcacagagtgtgtttcagtaacttctgctcccatctgttactgcactagcctcctgctgtgtctccatagttatttcagagaggttccagtgggagggggcgggtttcttacctattcataaattctgtagccaaccacaccgtgtccctggtctcttctcctccttcaggcctttccctccaaacccactggaggcgacactgccagtcccactgggtaccactgctcctgcagccccaccagtcccccttgctactgttatccttgatgcgcttggacccttaaggtgcctaagccacttggtggtccatgatgacacagaagaaaatgcctgtcccactctgtgtcgtgctttgttggggctggaagtggaaaggtgtaagtgtgtccacctcaaaacagtgcatctggagtccagggtctactagggtttccataaagcagtactttcactttttaattacctcccatccacaaaggactcagatatgaacatatagggaggaaaaagaggatagcttagtaacttcaccatgccattctcagaattgccccaaccccctttctagaatgcacttgccccaagcttcaccttctgcccctcctacagatagacctctggtgacctgcccaaacactagaaagtactgatactctagcaacacttacgcactgggtatcatttgagagaacctggacactgggccagttgggggttaccactcattttgatacttgtcactatgatctccacgcatctccatgggctaagaagcctcctgtgttttcctcaccctccctgttctcttctaagccaaattgggtagaactgaggtataaaggccttgagattaagccagaagggggagatggagtcctgtgccccaggcctctatccctagtttcccggctctctggtgaagccttcctcctgctcctcctgattcacactctaagacctggtaggccaagagccatgttctccactgaatcaggtgacaagttgcaatgatggcaagtgctgacactgccatgcatagagaagggggtcctcttggttatttgaccccctcctccaagtctccatccattcagacagacaagaaaaccctaagggatgtcgccctggagcctgttccccaggagcctggcataactcctgcctaggccttttggggttccctaggccctgctgggcagatgtgggcagacctgataaatttgtccagaaggggactattctttttgcagtcgtgaacaacctctgttccatcttttcttcctgaactttctatgagaacatctctgaggtttacttcccctcattgtgacatgtggtcagaaaacagcagttgaacccctgctgcgttgcatattaccctgtaaccagctcagtgccactcgggggcctgaggtggtctgtgagagcagaggcagtgccacaccttctaaagtccagagagcctcaagccccccgggttggctgccagtctgcagaggagggaggtggctgcccgtctgccctctctgttgctctctgtttgatgggtcactgagctacagaacttgcaccccagggccttagagatttaatgaaattactctttccagagttatttactcttggccctgccccatgagacccagacatgaatccagagagggctgggccaggagaaaagtccaagtggtgatgaccgtgttatagtcacacctccaaaggctggggctttatgactagatcaggcttatgcttaactttctttcctttagggtgtccttcctgtcccctagaggactgctcaggccctggtaggccttcccaccccatcccacccactctctcatcaccgcacagggctgaaatcctgtggtgggcgcagctcaaactggggaccaactcccaccagccacactcactgcccgtcattgtagcaagtgtgtgtgtgtgtgtgtgtgtgtgtgtgtgtgtgtgtgtattcatgactaataagtaaaactctctgttaacattgtattagagaaaccttcatccacagaagaagagatagtgaaatcagttcctgtatacccatcacccagctttgacaattagcatcattctgtcatttttctttgatctattctccctatctttctaatttctccctgtgccggggtattttaaagcaaagcccacttcactcgtaacacttcaatgcgtatacgtaacagataaagccttttaaaacgtcaccacaattccattactgcaccagaaaggcaatgatgattcctttttgttagatcctcagatatggaaggtagatgatgctgtatttaattttgtgctacttcgttttaatttgcatttactttcatgtttttgtatcttgcattctacttatatttcttttcaggtgaacactgttttcataaaatgtattcatgtctctgctgagtgactttcacatctgagtgcccctaactcccaatgctctggatgctggtgggctcctttactcaatcccagaatcaatccagaaacaaaccatccagaaaaatgtaaatggtgtgaaaccatccccaccagttaggtgtgaaaatgggtaattttagaacaaaagctataaggactttacccatgatgtaaatttgcaggccttctcactgtaagagttgatgggaatgagaaataataacggatgcaagataggttttgatacattcctgagtgacagcactagagcatagggcaacaggagtactcagggtgaagccgacacactttaatggaacattgtggagagaaaattgcaaactccatgtgctaatcaaaggtgttaaatgggctcaaaagagcatggggcttatctcatgtggctttcttgtgcattttttttcttttatttttagaaatgagatcttgctatgttgcccaggctggtctcaaattcctggactccagcagtcctcccactttggcctcccaaagtgctgggattacaagcatgagtcaccacgcctggcctttcttgtgcattttggggaaaaaaaaagttctgtgttcttataacttgaccattgctcttggcctttcttcttgacatttcattggtttcttcctgtcttcatttctcttagatccccaaatataaagggcagatgatgccagcgtcataggaaactggcattgtcattagtaaacgcttctcagacaatttgagtgggacagcagagggatgtggtgactgaggctggaggtgagagatcatgggttttgggccatttggtctcagttttttctgagttttctgagggtttttttgagtttttttgtccagtcactgggcaagttagttttctggttcctgtttggatttgtttcctcatctattggacttgaatcagaagtggcctgtgaggtttttcacatgaccacacactgatggattggtagagatgacttggagagccagggtggggagggttataaggctgactgcaggttttaggaagtactgcactgatccattggtgatgctaattgtcataggcccaaggtagggaagtggtagtgtcactgacacgtatttgattttcttggaactagatgcttttttacattcaggttcaaagattctagttgctggaactatacaaaggagcaggctttctctgccttgtcctcaaggagcctcccatgcaggtgagaaaagacagcatgggaacccgtgggggaatgtgtcacaatgatacgggcaaacttggctgactgcttaatgcatgatttagaaaatagttgccatgggagtgaaatcaatagcatggttggggacagagtatttttatcaggttggttgtcaatttgtaaagcatgcagagaaacattagctggaggcaggacgagggtggcagcacctatagcttagaacacctgtcacaccctctccaggaaggagttatgacctatcttcaaaagacacttttaaatgccccttaagagggacagaatgcaccctggttaagaagttgttgggtggctacttgcttaaccctgagaaatgttgcacagttcccaggctgcccatctggttctcatatttccatgagactcactctaatgaccaagggggtgtggtgagggcattactcaggcgcccgggaaccagcctccaggcttccatctgctatctgccttgcatgagctgggtactcagggcggcactttaaacctctgaacttctgctccttcctctggcctgtgtctagggacacccacctggaatcaaggcatgtttgaaggcttgcttaatttagtgtctgggaggcttctcagaggtgaggatgaaagaacatggaaatttacagtgcgattattcatggggaatgtcaccattatcagctggcttagggagatggtgatcagatctcagtggtgaccctgggcttaaatacgtttaggtggcaagtttgagctgggggtgcacagaaggaaggcagatgagattatagggaaaagcctttgaaggctttacttgtttggaaaacaggtagaacgtgtgtcagccagcaagcaagcaatctggttattgctcatctcgcctaacaaaagcttttcagaactgcaaactgcttccccgttccattgtctagagttttcccacatggagctgaagtcattctaaaattagaaggctcatgttttctacccaggtactacatggctcacctgctccaaatatgtgtctataatacaagacacttggtatgtctcagtttggggataaaaccacatacactcatttgtgtttactttaaagaatgcttagaagagcattaggagggaatgagggattcttcctttcctctccaagatttatccttgtcatccacattctcatttcaccttctactttttttgcaaaggaaattgtgctgggtcagtgctttttgagcaaaagctgctcagggtagtagacagaacacaggatatgcagtccagaatcgtaattctgactcactggctgcaacaccttaacagacctcttaaatcttcttgaacctccgttctgccatcaataaaatgaaggagtggaatgaagtcaatgtcttttcaaactgagttgcagaatcactttacgggtcataatcaacatttttaaaagtggaattgaatagtttagagaatttcagagtgcatcacatggaggaaggacaggtaccatttcatgactcttgttttagttattaatagattcatatattggcattctgcatcactttacttgcatgaattacacccatatcacttcttctataatttccagatttgatttattcataaataagagcttagacacttgcagagtaagtgccataaatctttctagacctataacattcccccccttcacctccctagttttttgtttgtttgttttgagatggagttttgctcttgtcacccaggctagcgtgcaatggtgcaatcttggctcactgcaacctctgcctcccagattcaagcgattctcctgcctcagcctccccagtagctgggattacaggcaccggctaccacgcccagctaatttttgtatttttagtggagacagggtttcgccgtgtaggccaggctggtctcaaactcctgacctcaaatgatccacccgcctcagcgtcccaaagtgctgggtttacaggcatgagccaccatgcccagccctcctagtcttttatagttgtcttatccaccctaacttagcagcagttcgtcttcatttttccaaaactctctacttatagaaacaacagctcttttcttatgcacaggtatttcattaatttacataatatgtaattaagttacataagtgcaataatgagtacagctgacataaacaggtttggcaacaaatgcaaatggcctcttggtaaatatatagcctaactgttgagaacagaaataggttgataaactagagtagccaactgaggttttgcatgctgagggcattggtctagatgctttagcaaagaaatggagagtatggggttaggtaaatcagggccttggtttaagtggagctcagttaatagcgcatctaccatcttcaaaagaggcaaggcaaatgacaaaactaatggatgtgaatatggacataacctcctgagaaatagcttaacattaatagcgaaccgaattccttagtattagtaagtgaaaacttaaaaattgtatatgccctgtgacccaactatcgtacttagggatctgttttacagaacaatcagatgttaggttattatccagtagagtgaaaagtagccaatgtcaacaagaggaaaatagttatggaacaggtagacagataggctactatgtagccctttaaaatcatgttgatgaggaatgtttaaagattgggaaaatacacatgatatatacatagaaaaagtagtatataaaattggatgatgtaactcgaacttataaactatatacacagatgcaaaaatacagggcatatagtgttcacattaatgatctctggttaatgagactatatgtgaatttcatttgcattgtgctttcctgtttttccagtgtctagaaagaagaggcagtggctgccctgcaggtctgttggccagtgtgcactgagtgcaggctgcctcggccttgcagtccagtgactgcacctgccgaggctccgaggctcaggcagtacggctgtttctagagcatggggaaacagtggcgccttgcatgagggacacccatttttgtagcttggctcccaggcctcactcccctgcacagcagcactcacaggacctttgctgtctggatgagttgtccccagcatttgccactttgcctcagaagtctgggaatattcatccaaactcttcttcagtgcctgtgactcctaaatattgacccactttgcagaaatttcaagtacttaacacttccaggtttcaacagagaggttgggtctttctgggcatccaggtctatggtcagtctctcaaatgtgaagactctgaaaccagacagtccaagttcaaattccacctctgccacctactagctgtgagaccttgggcaagatacttaacctctctgtgcctggcttccttgcctgtagaatggggataataatagtacctatcatagggttgatgtgacaattaagagttgactataaagcacttgcaactgtttgtatacacggcagctactctaagtgttagctgctgctgctgctgttactaccctttttatcattactggtgatgcatacagtgtgaagcaaagctgtatctttatggttactttttgccacctggagttaagtcctatggtagtggtcttacatttcagtgtgcgtaacagtcatcctgctgactctgttgaaatgcagattcctaggcccttacagcatgcgatccagaaatctgcatttttagtcatcaaccacattttattacagttggatgggaagatgaggctgaatgtactgcccttgtaggctgagatactctcaccagaaggtgacagcacttctccatcccccaagttcttgctttacctcggccggacagtgctggtcactgggagtctgtgaaatgtgtgtgacccaggactgactttctagtattcacccaggactttggtaaagaaaagtcaaaaacctcagaacttgggccacctcaaacctcaaacgtcttctctctcattggccttactgtgatgaaatgatgaacacggtggctttctggtgaaacatcagctctgttttctggctgtgcaagcccaaactcctggcttctgagttcagagattgacctggagcatctggttatttactgatgaagagacctgcagctattttaatccagtgaggctcagatgtccccacaagcaggctctcccactgtttgctttatggatttgttcagaatctcctttcctcgtttcctgtcttgaaagttacggcccaattacgttatcagaatgtgtaatggaaagtgatttcacacatctggccattttatcaccaggttgcattgactaaaatgtttcttaaataccaaaacacaggagaaaatggattagatgaagcagaatggagggcctcagttctattcacaatgtagtgggggctcaaaaggagaaagttttttgttttttttttccttcctagttgtcacttagcagcttcaggaggaatccctcttttagggtcttttttcgttttgacttttgggggcttggatttaatgagcatgtctccttgccttgcacagtaggtccagaaaggtatctttaagatcttgaaagtgaaacttgtcgggtattgctatgaaatctgccacaaatgcatcttcctggtgctcttagatatgaaaaatagaaatacgattaatcacctaacagtccacaggagcctctatatctgatatcctgttaaagaaacagcccagcacagtgacaggctctagaaacctagatgcacccctgaccaaatgataaccagattgcagttgccattgtgggcaatttcccagggattcagcccttgaccagtgcttcccaacctttttcagaataaagatccatttttaacatcaaaattgtgtgagaccccacagagagtagttgtgcctttattattaacgtaaattatattaaatgagttaataaacataatggtcaaaagctgctatgagaactcagtgacactttaaaatgaatttgtattttatcaatcacaatagaatttacataataatatgaactaacacttatagagtactccctatatgctgggtgctgctccatttagctttatttatttctacaacaactctaagaagaaggtactactattagctccattttacagttggcaaaattgaggcacagagaagttaagtaacttgcccaaggtcacctagttagaaagtggcagagctgggatttaaacccaggtaactggctgcagaattctaagcacttcaccactatgcttcaaaaacatacacacacacagatacacatacatctcactcagaccacaggtgttatttgaggggagatttacaaacactttgcattaaataactgtgtgactctttttcttccccttccccaagacagattggaaaccactttcttgggtttttaacccttcatttcattaaaatttagacatacagcttaaagccaggtatgtgtgtgtataactatatgtgtgaatgtgcacatgtatacatatataccaatgcacatgtgagtatatgcatgtatgtatatataagcttttatttttatcttatcacaaaactatggaatcttctgtgtgtgtgtgtgtgtgtgtgtgtgtgtgtgtgtatgtatgtatgtatgtgtgtatatatatatatatatatatatatatatatttgttttgttttgtttttggttttggtacagagtcttgctctgttgcccaggctggagtgcagtgacgctatctcagctcactgcaacttccacctcctgggctcaagtaatcctcccaactcagcctcccaagtagctgggactacaggcacatgccaccacacaggctaatttttgtgtttttttagaggtgagtttttgccatgttgcccaggttcatctcgaactcctgagctcaagtgatccacccacctcggcctcccagtgttgggattacaggcatgagtccccgtgcccagcctgtatacattttcttccactcaacaaacactgacttgtttcctgtgatggactttgttctgtggtgtctaggttcttattattgtaaatgtttttgcacaaacctggtcacaaatagatgtttcctaaaagagtcttttcgtgaattgactgaagatgactgtgtcagtaggcttatgaagcacaggggattgaacctgtcagactccaaagtcacaaagtcagtggggatgaaaacgcagtcttccctctccttagcttgattctgtgcacagagctcaccatctgctagccaccttgggtgtatgtccaaggacggggcctctaggtcagagcaaatggatcgcttgatttccgcttctcattaacatgtgaggaaatcatgcctttttattatttaaatttggcttgatgaaaagttgcctacaaataaaaactgtaagtatttgatagcacggtggttaaagtcaggagccagatgacctagatttaaagcttaactgtgccccctggggactatgaccttaggcaagtttctttttttttttttattattattattatactttaggttttagggtacatgtgcgcaacgtgcaggtttgttacatatgtattcatgtgccatgttggtgtgctgcacccattaactcgtcatttacattaggtatatctcctaatgctatccctcccccctccccccacctcacaacaggccccggtgtgtgatgttccccttcctgtgtccatgtgttctcattgttcaattcccacctatgagtgagaacatgcggtgtttggttttttgtccttgtgatagtttgctgagaacgatggtttccagcttcatccatgtccctacaaaggacatgaactcatcattttttatggctgcacagtgttccatggtgtatatgtgccacatcttcttaatccagtctatcattgttggacatttgggttggttccaagtctttgctattgtgaatagtgctgcaataaacatacgtgtgcatgtgtctttatagcagcatgatttataatcctttgtgtatataaccagtaatgggatggctgggtcaannnnnnnnnnnnnnnnnnnnnnnnnnnnnnnnnnnnnnnnnnnnnnnnnnnnnnnnnnnnnnnnnnnnnnnnnnnnnnnnnnnnncccattaactcgtcatttacattaggtatatctcctaatgctatccctcccccctccccccacctcacaacaggccccggtgtgtgatgttccccttcctgtgtccatgtgttctcattgttcaattcccacctatgagtgagaacatgcggtgtttggttttttgtccttgtgatagtttgctgagaacgatggtttccagcttcatccatgtccctacaaaggacatgaactcatcattttttatggctgcacagtgttccatggtgtatatgtgccacatcttcttaatccagtctatcattgttggacatttgggttggttccaagtctttgctattgtgaatagtgctgcaataaacatacgtgtgcatgtgtctttatagcagcatgatttataatcctttgtgtatataaccagtaatgggatggctgggtcaaatggtatttctagttctagatccctgaggaattcccacactgacttccacaatggttgaactagttccgtttcttaaccactctgtgcctccgtcccccatctgtaatgtggagataacagcagaacctaccccacagggtctccgtgagaatgaaatgagagaatatacgtaaagcacttagaacagggcgaggcttacataggacacaggtaagtcctatgtaagtatttgttataattcttttcatttagatttacaaagacagaaagcaataacattcaagtaagaaatggtatctgaaataccaagatggcctgagccaattgatggcagagacatgatttgagcttaaagtcataagggccatgacaggatcaatcgcataactcaacactaaggagttatttttgacacttaaagaacagatcagctgggtgtggtggctcacacctgtaatcccagcactttgggaggccaaggtagcagatcactcgaggtcaggagttcaagaccagcctggccaacatggtaaaatcccgtcttagccaggcatggtgactcacacctgtaatcccagctactcgggaggctgaggcatgagaaccacttgaacccgggaagcgaaggttgcagtgagcctagatcatgccattgcactccagcctgggcaatagagtgagactccatctcaaaaacaaaaacaaaaacaaacaaacaaaaacagatcaaaggaagccacactttggctgttgggaagtagggtcatggaacccgctattccagtagatgccaaaacactgagctttacttttagaattacagcacccaaagcagagaaaacacaccccctcggtgctttcctttacttatgggagacgtggaatgctttgcactattccagcaacaagattcaggaggaacatcgataaattggagggaaccaccagggctgctgtgtggaaaggctgaaggccagagaagcagaggcacaggagggcagaagaggaaggcaaaggaaggtctcagctccctgcaagtgcccagaacctgccacacaagcacagaggtgaaaacggcaggaccatttgcttgaggaagtcatgttctcacttgctcgcttgctccacagaagcccttttcacactgttctttaaaatacaaacaggttgctctcctttggtgtgaaaggttcagggagaggtgatgatcacagatggagactattcatagcactttatgtgagaaaagttagcgcctaatttcccttttgatgctaatgctgtaagaattgaagtgagagtacaggttagaaatgtataaagatggaaaataattagctcattaaatggagagtatacctaattggggaactagagctatttgagtttaaattctttaccatctgggggacaacgtggaagaaaatcatacctgctcaaaaaaagaaaaagagagttcttcggtaccctggagtaacagggtattattatactgaagggctctttggcccaatttaagttgactttctctctttcttgtttaagcatttttgtgagtgagcaggagggcttactgcagagggctgtactgggcatcagagatgaaccaaggacagtcattgcccttgggttcttctcagtggtgaaggtgacaaatagaactgcaaaccattgcctgaattaaatgactgtctgccagacttgtgaacaaaatggtgttaggaaggatgcaggctgtcctctcttgagggcactgaagaagtttccctggaggagaaaaaaaaaaaaaaaattgcaagcaaagagcactttaaaaattttttctttaaaatttttttgaccaaaaaatatatgtggtgtacatgttccaatataagtatacattagggaatggctaaatcaagctaattaacatatgcaggagttcatgtacttaagaccctcatcgcataacaaatacaaaaatcgactcaaaatggatgaagacttaaaagtaagatctgaaactgtgaaactactagaagaaaacagagaaagagctccataacatcagtctctgcaattttttttttttttttggagatggccctaaaagcacaggcaacaaaaacaaaatagagaaaaggattacacccaattaaaatgcttctgcacagccaaggaaacaatcaacagtgtgaagagacaacctatggaatgggagaaaatatttgcaagccatccatctgataagggggcttatatggaagcctacacaaggagttcctgtataaagaactcaaatggctcagagcaagggtgcccagggccagctcttctaggagagagagcccctttgatttaggatacagtggaggtagcaccagacagtctgttttactgcactgggagaaggagctgagttgagcagttcttcctccctactggtcacgtttcaagtcaaaatgatcaaccttggtagagtgttggtactacagggctattcaaatagttgctcttggaaaaaaagtagtactaactcatttagccacaagaattctccaaaagtacattttgccattaagactacaagttaacttttttttttttaaactctgcttaagtagtatcactttgtgagtgaatgtagcccctgaaccaggatgttgtttggggagagagctttgatgataccaatattttaaaatatcagtgtatttttattggtgttcaaaggctgatactattaaaaatctggaccagagaggattctcagttaatatttttgtttttaagtaaaagagttcctgatgcccaggccacttgcatgtggtacctccttgaagaggatatcccgagaagcctctggcagctctgtctagaactgcatcgtccaatatggcagccacatgcagctgtggagtgcttgacacatggctagttccaatggagatgtgttgaaaatagataccatataccatatagtgaagacttagtacattaaaactgaatatcttatcgataaatgtttgtattgcttgtttattgaagtaacactattttgaccttatttggttaaattaaatacattattcaaatcaatttcacctttttatcctaaaggtggctactagaatatatagaattacttatgcggcttatgtttatttcacagttttagaaccttgcgacacatttgttttcactcacatcctttccttcaatcctgggtttctccctaaacgccagccccagggtcatccttcctcagtctcaccccaatattgtgctgcagccagctgttgagtgctttctcatgtccctgtacttgtgaaaatgctctgcatacggatgaacccctagtgcaatgtctgacacaatagatacaaaataaaagttgagtaaataagtgaatactagctctctgtagctcacctatttctttataaagaaacgaagtacagaaagttaatatggcatcgaggttacttctaaaagtgtggaccataggctgttggcataagaatcacccagaacgcttgtaaaaattaagatttactccagactaaaaggttcagtcaggagatgttaggttatgctgcagtgacaaaatttcactggcttaacagcaggtttaactctcggtcactctgtgtccactgcgggccctgggatactccccaggaaaactgatagttcaggttagacctccatatcagcaagtgggatccatcagcaagctgggtactcccgcctagttatgcgttacttgtcagtgctcacatttcattctctgaaacaactcatatggccatacctagctccaaggagaccgggaaggcctctatatacctagaaatagaggtgagtgtacactggtaagcaatgggaatgtctgcttcataggccaaatgcaaatctcagaggtagggcctggggatctgcatttttaactcccctagtgattcatattcactgtaagtttgaggaccattgagtagaactagagttctcaactatggctgcacgttagaattacctggggagttttaaaaacactagtgtcctggccccaccccagagattctaatttacagggcctggggatggcatccaggcatcagtaatttttaaaacctcccccagagattctagtatgcagccagggttgaaaaccacaagtgtaggggaaaaagagggaaggactcttgaatcctgactctaacacagaccgaatctggttttgcatgtctgttgaaggcagtaaagatcaaatgaatgtgaaagcatttgtcaactataatatagaacaaatactggccattatacactggcaggtgtggacttttatgcaaactagatctgtgcaagctgtcatatatgtatgacatgatctcactgccacacacaaaaccaggagaggaggggcagcatccaccacacctttgcacctgccaccttttacagtcagtaaatgggtggtcccttctacctcccctcccctccacttaacttgatgataaaggggataaagagaagaaaaaactcattccttgtcttgatttttttctctccagcctgttccaaaacccttagcccaagccccgttgcccttactctctgttaatctgaaactggtgcctcaaacctctggtcctctgcaacctcatctcctcctcttcctgcagcctatttcccacctgccaccctagtcccatgccaggaaaggcagggccctgggggagccccaagcctgctggctgatggtttgaacagcataaggaatccatattctcagaaaatttgtgcccaacattgtccctggtggtattgttaagaatggcagatttagcagcactctgtttaagaggtgaggtatgcaataggtaagaccagcttttatgagctgctccagctctttcacccactttttgtaatattctgtttcctgtggattctgagatctcaccaaatgatttacaaacaagctcttggaatgctactgttatgtaaactggaaattgtaccaacagtcagttttctttggttataaaaataccacattggctttcttccattggcagagctaagagttaatgctggaataagctgtttttagttatttttcctcttgtatctaacaattttcaaggcagaacaatgcaagagtacctcaagtaaataactgtaacaccttttgtgaaaatacagatttgcgcatttgatatgaattagctttaaaaaatgatggaaagaattgcttagcctggatagctgtgacataggttctgtaaaatgattcttactggtcaggctgacatggccaaggttcttggcagtggaagttttatgtcaagcagcagatcacaggccaccactgtcttttcaaaacctggaggccactttctcttatcctacccaccagcctggccctcctttctacagctggttcttaatcagaagttagcagggctgggatgcaatgtgcccaaaggagaagatgctcaaggacctcagctccttgtaggcagtgaccactggtgcaggcttttcttatttcagtgcctcccatatagtaggtgaagaaagtgcttttcattattttgtgcatggggttaggtctggttgtggaccttggagattcactgaattgaacagaaatgcttagcaatcttaaaatgagcctcctaagttaagatctatgtcatatactttgttgcaaagaaaatagttaaaaatgtgtgtaagcttctggtttaaatggcaaacccaatactgcatctctcatatcaacagctacaagaacatacatagtaacatactctcagagtaaagtccaagctctccattgccctgcagagctctgccgggtgcaacacccattcccactccatctgtagctcatacgtctttcttccttactttctatgctccggttccctggtctcctttctttttcccagatgtatcatgtccttctctaacttctaggctttgcacttgctcctccttctgcctggaatgctctttccccagtttttccagtggctgactcattcatgtccttcgggtctcagatgtgcttcaccatttcagagaagttttccctgcatggtgattctggcagtagctcttcatcacatctctgtgcatttccttagtagcacccagtgctgtctataatgatttcgtttgtttatttacttatttgcctgcctcccccattagacttaagttccttgagggcagggaccttgtctgtctagttaattaatggatccccagtacccagcacagtgcatgacgcatacaagacacttgatattttgttgagtgagtaaatgaatgaaggaagtaaagaaggaaggaacactatgcaccataccaagtgctttatatcacccattttgcctttataacattccctattgattcatggggaaactgagccccagagagtttcagtgacttgcccaaggtcagaattagtaagtcacaaagagccaatatttgctctcaggtttgtctgcctataaaggtttgtgccagagtcaggtctgaggttatggttcaatattaagtttttgcctctttctgtatcttcataggtataatagcatgaagtattctgtttttttttccctgtggctcaaaattttttgtccatggcctttgaaataggtccttttctgctattttctgcaaaagaacttggtggtaacaagaaagggttctggtagaagcatattttggagggagctgtggagatctgccttgagtgtgaagattacgaatgactcttatttgagaagcaatatgtgtcttaaagtctcatttttaaaaaacaataaaaataatttatggcagcaactggaaagcagtgtccaagcttcagataacagtgatactgctctggtaacaccacctccttcccccagtctcggggccttcaggttcacacatgtgggtatggcagcagctttgcagtattcagctgagatctccacggcagccaggctcctcagtgctcaggagcctctggttggaaaagagataaatcactatttctacaaattatatgagtatatatcaaggaagcacgcacaaactgccacaaatgcctattagaaatcttaaaagtagccagtagggtgcaagtaagaaaacagtcagtagttttcctataaaccatcaataaccaattaaaaatatactgagcaggaggggaaaatggggaattattatactattcaaacggtagaatgttccagttatgcaagatgaaaaactttattgatctgctgtacaacattgtgcttatagttaatgatattatacacttaaaagaatctccctcaaataacaataatcatagtaacaataaaaaatatactggagagaatcaccttcaaaatagttgtaaaatatagactatagaccaagtagaaataatctttaaaagatgtgtcagaatctgtttgaagaataccataaaatttccttttaaggtaatttatttgactaatagagagacctgtgcccctgggaaagtaaaaggttatagaactgttcttcccattattactttagaaacccaaggcagttctagttactctttccacaagattaggatgaataagggggaacttaactaaatgattctaaagttcacctttaaggcacaagaaaatgctcatgtaaaatgtggagggatttgtacctccaaatattaataaacattaaaacactgaaataattaaaacattgcaacactgggacaagaatagacacattcatgagccagcatggcaagctccaaaagaaacccagttatgcataagctgacatgtgatagtagtggcatttcacatccatagggaaggagcggaccatgtcacaaattattctgagatggtaggttaaacatttaaaaagaatctagatctaaaaacgtaatgacattctaaaataagttctaggtgattgaaatactttttaaatggaagcataaaatttctccaaggaaataagtggatatttatatagcttacacaaaaggaggtctaatcagagcattgaaaacagaaaccataaaggaaaatagagacataaaaattataattttctgaacatctcctgaaaaccactataaataaaatccgtatttgctagtgtttgaatcctaaagaggatttatatccttaatatgtaaaataaactcacacaccaataacaaaaattttaacacatcaataagagaataagcaaattattggaataggcaagtcacaaaagaaaaactacatacggccaataaacatagaaaagatgtccagccttactagtcatcaaagagatgcaaattaatgaaatatcattttcattggtcaaattagtgaagataaaaataagagctgcgtacaaagcagataaggtcggagacttattgggtatataaattgtacaacatttatgagagccatttggtaatacttatcataaggctgaaaaataagccctgcttatctgttgacccagaaataacacttctaaaaatttatcctaaggaaataagcatgggtggatttgtgccaaaacttagcttagtgttcattgcagccagatacttatcaggaaaactccaagcacagacagatgattgaacaaacagaaggaaattattttcatttggtgcagaaggctgaattgtggtcccccaaagatgtccaactcatattctccagaaactctgactatgctaccttacatggcaaaggggactttgcaggtggggttaaggaccttgaaatgggaagagtatcttggattatctgagtgggcccagtataaccacaagacctttataagaggatgggaagaggttcacaaacagaagagaagatgtgttgagggaagcagagcttggagtgatgcagcctcaagccagaggattcaagcagattctagaaggtggaaaagatgaaacagattctcccctacaatctccagagggaaccatccctcctggtgatgacactttgagtttatccccataagactcatttcagacttctgacatccagaaatgtgagataatgtgggtgattttaagccactaaatttgtggtaatctgttatagcagcaatgggaaactaatgcatttggaaaaggaggaaaaatcaaatttgtactaatgtagagcgtatacacgagttggtcctgagtgggaagttcagaggcctagattctagtcccaaccttaggaagtcacctctttagagctccttttcttcatcactaaggttcccttcttgctctaaagttctgttcctccttaagcatttgttaaccatcattaggtatgtcattgttatggcactggtaagtatgggtgaggctgccgagtagattttagtttatttgttttaaaagctggctacactgttgttagcattttcctttttggggtgggtgcttgggtgaatagtgtgttctcatatgggggattctggaacatttcagagggtactgtggaggcaaacacagaggttagaagccatcagaaccaaaacaaatcgggggtggaggcctcacagagtctcccatggtggtcctaggtctttctgcaaagatgtcctgaaagatccctcctacccagactcctatgctaaaatcactgcaaaattttgtacatacagaataagaagtttgaagctatagtgtcacgtcaaggccatgcagtggaacagcccaggttcccccggtcacttgtccagaagggaaggtgggcctcctgagtctcctcacatgctctctggcccatagaaagccgcagtcagtgctgctgaaggaaactgaaatgtgaatggtgagagttactgcttgatactacagggtatatggcatgtttaataacttggtacgtggagcatttgggttttatcatgtacattctttcatctatatataagcacaggaaccataatcaatattcattaccatttgagattgaatatatgaaagataaatatatacatgtagttttcatatttgtatatgagcctatagggaatgagggctacattttaaaatttttaagtgagaatgagttttaaaatcagaatgaattagtcttataaccattggacacaaattgctatagaatttagcattctaactaaatgtaaagttttttttaatcagggaataacatgaaaggcacctttgtttttcagagcacatttgaagcacaattggtgattaagaaacatgtaaaagggtcgtagttatgacttgttaacccaacatttggaaaagttgtgaaatggaacctgggttttgaagttaaagatgagaatatggaaaacccctactttacacgaattcagttcaataattaaaagggatgtccagaaacatcaaggtgaacaaagcctcatacagtgagagaagaaaacagaagcctgggcctgaatcaccagacagtcgtggcgctctggaatggccctggtgccaaccagcagagagcatccttagacaagtcacttaacctcttgcttctgtttccttgtctatgaaatgggaaaataatgcttgtttgcctggcgatggtgagaaatggggcatgcagccactcatcttgtccacactggacctcaagggaccacagtccagctgagaagatgtcagggccatgctcgattgaccatgatccaagccagagcccattaattcctgctctagagtcctctcctctgggctccaccttcaccaggtgtggagaaggaaatggcgcattcaagtatctgttaaggtgcaattataggttatggggtagctcgcatcaatataggacaagcttgctctctcttcttcccttcccaagccctggctatgtcaggtcccaaagttttgtctatattcttaccttccaccatttcttcccttcttgatactttttcctctccctgtatcatcataaatcttagacctcatgcaggtctaagatcctgtgaatataaggcatgacttgctcatggtttttcttttctgcagcatctagccaagtattcctgcacaaggaaagagctaagttaatatttggtaagaaatttaaaaaatgtagaattgaagttctcacctacaagaagctggagatgtgccattgtgcagctcatttggtgggttttatgcactcttactctatgatgtgtggagtgctgccctgggacttcccaagggatgagggtaggaaactgacagagccatggaatcttgcacagggcagggaagccatatgtgagcctttccttagggggccagaggacagcaaaaagtgtcttttgctcataaaggaagagcccttcaaagaataaaggcagtgccaacagtcatgtgcatgggaccctgttatgccactgtctccggggaaggggcatggctggctgggaacagggtaagagggagacttgacattgtacactttcatactttttgaattttcaaaaagataaagggaatgaacttttttaaaaaccaagtttcatataggccagttcacaatccagagactcatggaagcacaggtgggctttggtggagccatcttgagtggagtgggctttccttgcctggtgtggtatggatgacttctgaatcataccaagctgaaaactttggtttgggttgggagggttttgggccccccacactttactgaactgaaagccactggtcctggccaacctccccacaccttattgttgccatgccccaacatgggtttgtcctgggagaccccattccaaccccatccctgatactacatacctggctgctgaatagcctgaaggaagcaccatcctgaacctccactcattgtcctcagacccaatctcagcaaacttgctgggtttctggtggggccataggagctgacagtgccttcttaataggagttcaattaaaggtagatgggtaggtgggtgggtgaactctgtgctgcctctgggcttggactacagaatgctgtcagtttttctgtgatcaattccccaccgaatatcgtgatatcctatataaaacctgatctgcttggggaaacctgaaccaagagccactttctatttttctgagtcaattttatgaatggcttgaattgaatggaaaggcactaattggtccacagacatatctacactttatgttttgtaagcggactccaggaccagataaacaaaaaaagcatgggaagcaccataagctgagacttgtctttggagctgacatcctgcctaggtggctagaacgttagggcagatgtcttttcataactcacctatgagttgaaagcaaaataaggcaggaagttagagagagaccaattcatacccccttgattatttactcaacatgatgctgaaagacatttgtgttttttggaagttctatcccctggcagtgaaacaaaacctcctttctaagcgggaaagattgatgtccaactgcattaaaggagtgtgtgagtaaaaggaaactctgtattctataagtgaacacaagaacttccactgtacttacgtaactgcagtgcaaagcgcattatccgactgaaatttccagtgctaaaggaaaattgtgctaaggctgaagcacaaaaatgttcccatttgccatcatttgaaaattactatatgaggaggttttgttttaattagtcacaaggtggaaagaagatgggagagagaatatcttatcttttaccttctctgaatagtgcaattcgttgttattttctcaagtgcatcatttattgacactatatggtaaagacatcagattggtggttatatgttcaatttattttcaataaattttgctacagttgtttataaactttctatgattctatttatagtccaggaagggatttctcattttttcttttaatctatttgtgtgtatactagaccagttgttctcaaactttgctatatgttacaatcacctgaagagtttttaaaaatcccattgtcctggctgcaccccataacaattaaatcattatctctgggtgtgggggtgggccctggcatgggtacttttccaaggtgactgcaatgcgtgtggaagattgaaaggcggtaaaccagagctacatatctcagcctacaatgtgtggaggactctcctgggggcctggttaaaatgcagattcagattcagtggctcaggggtgaggcctgacactctgcatttctaacaagctcccaggtagcaccagtggcacttgtctgtggaccacattttgaacagcaagttcctagactataaaagagaacctatagctagaccctacatggtagacacagtgagtataaaatgccacacaggttctcacttgtcccttgactgctttgtaaacaaacagcaaagccaccacagcctttatcctccttttcctgtgaggatttttgtattttatttgtaagcaccgaaggaaaagcccctctctcagacattgtctgatggttttcttgtccttgagcacatcagtgacccctgagttggagactggggcgcccccgccttgaatgggtggcaaccgtgtgattctctgcccagcggctcaccgttgtgggaacattccccaggcagcccagaacatcctggtcttgtgcttcgtctggtgttgagagattttagtaaacactgcgtgggaagaggaatgaaatagggagagaatgaggttaaggaatgggtgtgtgaaactccaggttgagcgaagccagggtgcctctgagcagcattccaacgcccacctttttctaacagctggtgggagaaggcgctcacctgcccagggagcctctgcctgtggcacagagccaggcaccctctccccaggaacagacaggcagcacagtttacagaggagtaaactgagacccagggatgggaaggacttggccaaagtcatctagagtgagtgtgacagagctgctactggggcccgtgctgctgactcggaatcttttgtgccatctttccagccctggaacacccttccagcctccaatgtatggtattatagcagggcttggtggctggaggcctttcctttttctgtcagggatggttaaaagtaagctgacggtgttacagagaaataataaatccagcagtggtggttgtatgcaggacttccatggaactttactgcagggtgcatcacagaaatgcgaataaatggagaagcatagcacatttgtgactaggaaaactccttgttgtaaatgggccagttatctctaacttgatgtataattataatgtcagtcctctaacggtttggatatggggaagagaacttataaatgattctaacggtcacctggaaaaacaaacgggagagtattcaaagtgttttcaaaaaaatgaggggtaggggcaagggaagatgacaaatttgtaaatttgtactgccagatattaaacatattgcaaggttacagtaaatgctttggtgctggtacagaaacagaatctcagtagaactaagtagaaagactgaaagtgagttattagcctatgataaaggtaacatttcaaatcaataaggagatgataaactgttcaacaaatggagttaggataattggttggctgtttagaaaataatgaaatacgtcttatgcactaaatatagatggtttagaattaaatataagcaataaaataatggaaggaagtgtaggtaaatatttatataatcttaagaaagggaaggcctctaataatgtcagggtgacttctgcataagcaaaaggaagacacaaaccacaaattatttgtaacatatataacgggatacagagttattagtattttaaagagtactttcaaatagacaagaaagaatgtatcactagaaaagtaggcaaaagatataaacagctaattaaccaaagttgaaatacaaatgttaataatcatatgaaaaaaatctacatcaagaaattaagaaaatgcagttaacataagagattcttatacattgccacgaaattgacgagaagggaaatgaaaaatatctagcattggaacggttatgaagaaacactcatctcctcctcaggggagtgtaaattgttacaaatttcctggaatgcagcttgataatgtgtctcagaaaaaggagcattcctttgccacactaattctactctcagaaaaataatcataaatgtgcgtgaacaaagatctatgtagaaggatattcggtttcatataatgtttcataatagtgagatattgggaagctatcacaatgcccaataagaggagattggttaaacagtatatattagatgaaaacttcagccatcaaagattaccatgtccagactaagcatccctaatcccaaaacctgaaatctaaaatcctccacaatctgaacctctttgagcaccaacatgacaccacaaatggaaaattctacacctgacctcatgtggtcacagttagaatacagtcaaaactttgtttcatgcccaaaattatctacaatattatataaaattaccttcaagatatgtgtataaggtatatatgaaacaaatgaattttatgtttagagttgggtcccatccccaggatatctcatatctcatatatgtatatgcaaatattcaaaatttgaaaaaatccaaaatccaaaagacttccaatcccaggcactttggataaagaatactcaacctgtagcataatacttaattgagttggggaagtgttcatgagtagtatcgttttattccctgttgggcacacagaacacaaaataaagacaatatttatattccaaagttttaatagtggttatctgtgaatggcttttgcatgctttgagtttattctttctttgtactcttctgttctctcaagttttctctcttaaacatgtattgcttttgcaatttcaaaagtgattaaaaacaagaaatagggctgggcgcagtggcacatgcctgtaatcctagcactttgggaggccgaggcgggcagatcacgaggtcaggagatcgagaccatcctggctaacacagtgaaaccccatctctactaaaaatacaaaaattagctgggtgtggtggcgggcttctgtagtcccagctactcaggaggctgagacaggagaatgagtgtgaacccgggaggtggagcttgcagtgagccgagatcgtgccactgcactccagcctgggcaacagagcaagactctgtctaaaaaaaaacaccaagaaataggcaggcatggtagctcacgcctataattccagcactttagggggccatggcaggcagatagcttgagctcaagagtttgataccagtctaggcaacatgcaaatcctcatctctacaaaaaaacacaaaaagtagcctggtgtggtagcgcgcacctgtagtcccagctacttgggaggcagaggcaggaggatgacttgaacccaggaggctgtgtttgcctcactgcactccagcctgaacaacaaagtgagaccctgtctcaaaaaaaaagacaaacaacaacaacaaacaaacaaaaaacacaagaaatgaataaaggcagggggtgcaattataaggatcttgttgcaatttgcttagatgtttttgagagacagctttggtgtttgtggttggggtctcatacaaccaagaggagtataccttagaggtactcagacacggatggaaggaggcaaaatatcctgcctttgttccctgtacccttcgtcccttaagggccactgtggaataggtcagaatattcattgtttcaccatctaagtctacagaggtcatttttgccatattggctggaggcaaaatatagacctccatctgcaagaagagtgtcacaagtgggtaggtgagggaaaagtccactccagtgggcagtagaaagcaatgacttcctgatgtagcaggctaggaaaaatatgttcagggcactgtaattaagatatatattttgtgagcttttgcctttcaaatactatcagcttggcatttgggagtgtagaagagtcctcggttccaggaggaggaaatatgattgtgaattgtgacttcctgctgaaggatacagcgttgcccctgatgtagccaattagtaagtatctggtctttcttgactgttcatctgagacttgatggagaagggccaacacagccagccaccagagtggggtggttgcctgtataaatgcaatatatgaatataatttcagctataatgtctttgtagcatacaaagacagggaagtaagtaagtacatgtttggcaaaagagccactgagctgatcagtatgtccctaagctgaaattgcagggagggaaaaaagtctcaaaatggtcaagccagatgctatgggaagggtagcagggatggtttgaaaactaagcagtgctcggttcctttggattgattctcagtcttcagaggtgatcctggatttattttctaatttcataaaacactaaaagggactgtgccagcactttgggaggccgaggcaggtggatcatgaggtcaggagttcgagaccagcctggccaacatggtgaaaccccatctctactaaaaatacaaaaattagccaggcacggtggcgggcacctgtaatcccagctactcgggaggctgaggcagaagaatcacttgaacccaggaggcgggggttgcagtgagccagatcgtgccactgcactctagcctgggtgacagggcaagagtctgtctcaaaaagaaaggggggggatgactgtgaaggtaggcgtatcaatttaggaagggtgagcttgagagaagaaggaagagcggtaaggctacagaacacagtattgctataaacaagacttaccaccttgggtaactacagatttatagctcactttgggggcagtgaatagatgaaacttggcattttaattcagtttctgcctgtgggcttgttgaggaaatgtttttggaaaactgaagcgaatcaatggttgcagtgagttgaatgggtgattccatgatcctgtgggcactggagaattggtgacaaggaatagcattataagaagtcagttgaagaacagatcttgttccgaatacatcaactagggttctttggttgcaacaatcaattccaactaacttgaacaaaagcaactttgttggaaggctgttgggagcacacagaatctgtgggaaagctggagaatcacccttagaacagaacagtaacccagatgactccaggaagccaggaatcaggaatggcagattctatctcagaacagaaactctgctcaacatgccacagttataatgcatgaattccatcagcattatctttttgtctttcttatcaagattcatatttgaggtaaagaggatggaagggtgggtagcacatctgaacatggtgataagccaatgtaaacctgtaggggaagaggtaattccctaaaagaaaacctgagtgctgttatgaagtaaagaaatgtttgccaggcagccccaaataaacaaataggctcaataatgacatggacagttgcttcaagaaaaaataatcgggatatcaaaagttaaatcatcatagatcaattctgtagatagatggttgatctaagaaattaatattgtctggatcttgatgacaaagtagtcataaggatagaatgtggtttggcaacaaacttcagatgggtatattttctggaaatctcagcatgctgcaaattgaacacctgaagaattctttacatacttgttggttatgtattactcagaagataaagaagacaacagggacacctgcttctgtgaatgcagtcttgatcagaaaggataacaggttgatatctatatgtgctatagaagtgagagaaggaaacactaggtagagttcaatttcaggcaatcagagtgtccaaaaattcagggtaaaaccacatgtgatcccacaagcatgattctacaagggaataaggccaggccagttgagaggctcatagagttctgagtttgtagtcaaagggttcatgagaaagtaaaggggagagagactgtaaggaacccaaatgtggctgcagaaggaattctctgatacatcatctagtaagttatgcaagaacatcaaaagaaggatgtgtcccaagaggtgacaaagaatagaatggaagagcactttgttgagggaacaagcacgttagtgcctcctaggtggcaggtgtttatgagaatgtcaggaaaactgaaggacagaaagaactagagttgtggctattggccacaaaccaatggttttctgaggctatctttgggagcagacaggtaaaaaaaggaaggaataagtccatctcttgtggcaggtagaaaaggttagtgcaaaaccaggaaaagactattattgacataattttgcttttatattttctgtcaaaaagaataaaacaaacatagtaaatatgaaataaaaggttgagtgagtatcctagtaaaagacccctaataccacagatgagtttactcatcacaggtacagatgaattttacttcaatgtactgagaaacctgtagcaaaaatcacccatccctgttggtgatttttaagaaatagcagcaaatgtaaaaattgctcagagaatggaaaaagacaaatacatttctgactttaatgatgtaaaaatgcctgaagattgtttagaatgtagattataaaacttgacactcccaggaaaacattagaccaatttattacagcaaataaagaatgaaaagtcacagcagattaactttacttcttttttagtgttgtaagactgatgagggaaatgccaccagcataaggctgtataagaggatacacgttgagttcaacaaggcacatgacaaaatcaaaatattcagttggacaaaatggagaaatatgagttacaagagttcacagttggctagttggtgagaaggaacaatgccagtgacctctttaaatgaagagatccccaaacatactcaacatgggtttacctagaagcttttgggaagggtaggacgtttttaactaggtcatcttcagaaaacatttgttgatgtattcgcattgacctagaagggggactcctgggtgtgccagcaggctttatccttctttcctgttgagacttttatgagcaaatcaaaggaagacatataaggaaaagtttatcagatttagagacaacacagtgcccagaatgatagctgaagtattggatgatagaataaagactcaagagaaaaaaaaaaagttttgagccagaacaatggatcacagccaaccaaccaagttaaattgaacagtgacacatttataataacagtcagtatttaggttaagagtaatgatttaatcaggaagatatgaggccaaatttgacagtagtttaagtggagaaacagccagaggccttagctgaccacaaatttatataatccaacagcattccaggactgctggcaaaattgatggagaactaagttctatcaatgtagaaatcaggtcatgggaggtggttttcctactgtactctgttcctgtaacctagagctttagagctaggactctgaggtcacactgcctgtttttggatttcccttctgcctcttcctagccctacatctttaggcaaggcttttaacctctctaaacctgtattcctcatctgtaaaatggatagaataatagaacctatatcacagggcttttataagaattaacttaggtagtacgtataaaactgttagcacaaaggccaacatccaacgtatttggtaaatgtgttttgttgttgttgttgtccccattactctatagtagactattttaagaaaggcactaaaaaaaaaaaaaatcagaattttccctgaggtgagaggtttgcagactttcttgcttaaagaatacttatagaaactcaaagtgtatgttatttattgctatatgacaaattaaaatttagtagcttaaagcaataaacatttattttcccacacagggtctgagaggaattcagaagtggctttgctgggaggttctgggtcagggtctctcattgaggttgctgtcaagatggcaactggggctgcactgtcatctgaaggcttgagtggggctgaagaatggctcacttacaagctattgttgggaggcctcagtctttccacatggacctctccattgtgtgtctcaatgacttagcaactagcttcctccagagtgaccaatccaagagagagagacaaagagaacaaggcagaagttacagtgccttttatgacctagtctctgaagtcacatcccattcatattctattggtcgcacagaccagccctgagacagtatgggaggggacttcacaaggctgtggataccaggaggtagggatcattgggagctaccttggaggctggatgtcaaggggagtttaggaccacaaagacccagaggtttggtggctgactatagaaatgggaaaggactgctgtatagaagagggagacttattctgtgtggcttccaaggatggaattcaaaacaatacacagaggtttctgggaggcagatgttaatgtgtttaaggaagaacctcctagcaataatctgcccaaatagaatgccagtactaaggcagctcattctatttggggcagtagtacttagtactaccttagagactgagcccctgagtactggaagagtagagcacaggctgggtgtcctctcccagggacaccatatgcagaaccctgactgggtagaaagttagctgtgagtacctccaactctttgatatttcacttctggactaggggagaattttgtgaaatgagacccttagggcttcatttcttttagttttgaggaaaaacaaatttttcatggaactatgaggtctttgcttctgaaccagtatggcttggagaaactattaagaggtaaaatgaccctggtgtttctggaatcccccaacatttctccttgtaagagcagagctccaagttgcttgatttacacttagcccaggggatttaaaccaggaattcccaacttttttatgaggcagagcctttagatcatggaagaggcaggaatgttggcatggagttttcctcacggggaatcctggcacaccttggagagagggaggggggttgcagctctgggggatattatccagggaaggctcagatatccaccaacggaaatcagtccactctttgagcatgcaaaaatactagctgatgctttgctggggattcccatagagagaactgagaatgcactcatttttaaaatagcctcatggagaaactttttaagtggttggtgggggtggcgaggcactgttatattggtcaccatgtgggcatataatgtagaaaacgtccataagcaaagggtttccagggaaattaacactacagcataccacgtttactcctcccttagtccaatctacccttggacactcactgaaatgatctgtgaaatatgaaaccatttctaaatgtatatcagtactagaagctctgaagaatttctgccagtgagcgtgcaggtggcagccctcctaccctagtccaacaatcactcctctggaagacaggattgtcaggagcagaatcacccaaacagcccaaccttggaaggccaaggtatgagggtgagggcaggccatctggatcctgccaatgccttaagaaaggacacagtcaaggccacaataagtgacaaactcagtcagctctcactactggcatggcatgaatgtctggaaaacacaggggaaaagagaaaactctttggtgtgtacctgttgtctcctgcttctaccaaatagatttcttaggtatttgaaggcgctacagttaaacttccccttttctgtctttatctagccccaaaatattgaatagggccattgtctctgttgaagcccaaattaactccccatgatgctacacgaaagcagatctttctctgtaaagatgatgatgcaagaaatcgctggccacaagaaaggatttcatcatatgagaagattttttgaggaatttcaactaatgcctctattcctaagaaatgggtaaagatattgaataatctaatttatgtcttcaagactgaagctgacactgcatctatgaaacaagtaagaaacagctacaaagagatgacagaatatggtgaccaattttaaatccataatacactaatgagcagaagattagatatcacagtaaagtcagtaattttttttaatgggctggaaaatttctcccagaactcaggactgaaaaacaaaaataatgagaaaaaaaggaaaaaaggacccggtgatccaatatacagataattccaaaaggaaaaaagaaaactaaggctgacacaatcatcaaagatcattaaagagaactttcttaagctgaaaaagacttgtccttaagattgaaagcattaacttcagggtaatttaaccagttctcattgcaaagaaaaggtcttataagcactgaagtgaaaataaaagcaggttacaaaggaatatagtaaatctagcttcagttttttcatcaactacaagccagaagtcagtggtgggaggcctatggggtccaaagctcatgacccaagttgtcattcatatgcaaagccatgtacatgaatgaaacacagatgttctcagacatataatatttcgttatatggatatacttttcacatgcccttcctggaaaaaatgtccaaagagcctcttcaactagataacagctatatcaagataaaaacccccaaatggggaggatataattttttcaaaaccagcgataatgtgtccaagcaactgttgtcagtttagttatactagtacagatgtcaaaattaattactgaaatataagttttatatataaaataatgaggatatgaaatcagatgacaaataaaaactggtaactgggaagaaaaagaaggaggaagtaagcatgctaattttttatcaaatgacacatcaaatttcatttttaacattgataattgagaaaataaactaaatttttttaaaatgtaaacaaattaaaaagagtatttatattctaaatcaccacaaaaggggaaagaagtcaaagaaacatgatcttttatacaaaagacaaaaaaggcaacctactaaaaataataagcatttgtaaaatgttttctaaacacaggttatttcttctcagtgataagacagcaagtcatttgcttaggatatttgtatttccaaaaattatacaatgaagatgcataacttttaaataacaaattataaaatcccttgtgggggctgttataaaaagttgtttgatgtgtaacacattgccagtaaaactaaagaatggatggatgagaagttcccagttataacaagatatgatcaagatattctgggccaggatggtcatgctttttttttttccagtggtatcgatttaagattttgcagctggtgagatacatgatcatggccatttggagaactgtagggcatccatcttctatgtcaagaagattgatgttatagtagttaccatgctgtcctgccttggcgatttctgcccagagggttttgagaatgcagtatatttgcatcagctgtatagcatttccatcaaaacagttgtgccctgcctgctgtcaattgtggcggcaccattttatattttgttttatagagttgcagaagcagcctttgccccatccacactttgttcaattacaaagctgatctcactcctcaccccaaaagactgttactactcctggagaggtttgtgaaggtcgacctgatccctccaggatggagaacggacagaacagaccttaagctggggaccagggtttcaaagtggagcctcccaatcagggccagattgacttcagattgtaagcacagggcatgttgatgtttggatgaggctcccagaagagacagagaaagagagaaaaggatatgatttattgtgaggattcatcccacatcagaaattctctaaccaacccctaatgccagacttcaggcttggcattagagtaacactccctgctgtaacagataaaccctgaatattgtttatttcctgctcatgtcaaaggctctgcaggttttcctggccctgcagacttctttccatgtgcttattcaaggacccaggcttcttccatcctgtggctcctccctcctccatgtcctgcaggagcctctctaatcagacagcagctgggaaaagacaaagggaggtcacaccgggaggttcttatggaccaagcctgcaagtggagcatgttacctctgctgagatccactggccatatatcctggtcacatggtcacacctaactgcaagggaggctgggaaatgtagtctctattctcaggagaaaaaggactttggatttaggggaactcctgggagtctctggcccacactttatcttttgcatattccctgcctccttcagagagcagtttcccagctgaactctttcaattaaaagaaaaaaagtgacataagtatagtggttggaaatggatcaaataggctgtactcttttgggattttgttgtttatggtaggagtgtgtgaggtttctgtccatagagaccaagcccgaggtcatctcttaccaaacatctttcttctaagcatcttctgtcttctctaaatgattattttgtctccttcctccttcttcctttttattgataaaacatgaggcagtaacatgatttttcttgtgcagattaaatctagattcctcaaggccagtcttctataacactacaattctgtctgtgaataaaacactaacaataaaaattggttaagctttaactgtgtttatagtgttatggggttttaattttaaatggttgtgttcaaactctaaaatgctcacttcatgaaattcgaaaatttataaaaaaaaataattgcgtataattcgaccactctcttacatctcagcttctttcctcttgaatataatcttgattgaagggcttttatctaaggacaagcaaaatcatctgtacaaaactcagagggaataggaaagagagtcacatctttgtcatgggacatagtcccaactacaaattcacttctatgtttttaagactgttgagctttgccttaaatttacctctgtattcttcagtttcctcacttaaaatgaggagtatccttcttccacccacacggcatctgcaaactgccgatgaaaaaaggcacctgtcaaaagttctgaggacataaaatgttctagaaaaacaatcatcccaatagcgcttatatgtgctcagtgtagagggtttaaggggattatggttcaaagactcaacaagaggaagcattttttcctaagggtggattgagagtttcctgccaaccactttacctaacaattttgatatttataaggagaatagaggcacacagagactgcaaaggcaggtagccctgggctctaacggggctgttcctccaacaaagccagaacagaattccccatccagcaggactgggctccagttcccagagccattcacattctcgttcaaagccagctgatgaaagccaaacataaacctccttgtttaccttgtgaatggaacttggaagtaaagtattttccaaatgctggttgacaccaagaggatgtaattacaataaggggctttctggtttgaagagatgaaagaaggaaatgatttgtctctttgaaatcaaattatcacatattaaaagaaaagggggaggcttagcttccagtcctcaaagcaaaatcgtgacctgtaattttcttaatttttttttttttttttttttttttttgcttaaaattactaagaccaaggtagtagggatagaagaagcaacctgggagctggagaaatggggtcatgaggaggaagaggagcttagtggcagagagtgtgatcttcgtccagtatatttcctgtctatttccattgcattttaatccataatgaatgtagaatggtgattggcaggctgcttgtggagtctcatacctgcctctctcctccttgtgccttttgggggaggtagtggtcttcccagggggagtcggggtacaggtaacaggccaagttgaaatatgtatgtcgtgcatctttggatggatacagtctctggttttagcctgcacttaacatgattccactgaggttttattttaatttcccaaagcctctttgctaattaaagccatttgccttgggactcttagcccttttaattctaaaatgcccctaaattttcctggtaattcctgatttgttattttccaaatgagagtcatcttgagtgtgtggaagatgcccataaggacttcttaactctcaactctctctcacacacatccacacacgcaccatgccctctgaagtgacagtgtgctgtattagaaagggcgagagctttagaggaaaccaaccatgagttctggtttccgctctgccatttgctgacttcgcatcattgaacaactttaacccccctcagctccactttcttcatctgtaagatgagatagtgaggatttccttgcaagatttttgtggggattaaatagaattcgctctataaaatgctgggcatagcacttgcagtaggtggacaatccaatagtagctgctcctaataataatgtcatcatcatcatagtccaacctcagaaaattctacattgggttaaaaactctaagaccaggtactttagataaaattgaaagctggcaaaatacttctgtgttcatgttatctgattttcttctccctgttggaaaatgaaaaggtaccaaaatgatgcaaactctgcttttgccttcaaagtaagcatgatgaaccccactggggcttctctgactctatcttttttcccagtacacacacacacacacacacacacacacacacacacggctgctgtgttatcaataaccagtatctttgtaggaaagtagaaactaaattgtgtgtttctttaccaatatctttgtttgaatttggttccatcacatctgatgccccttgggtttttcccaaagggagaaatggtcagagggaattaaaatggctcagatgttcccttaggtttcccctacagcatcttgtttgaagctgcaaaagcaattcagaagtccatcttaggcctgctctgagctcctggacaagagcactgtgtagcccagaggttcctgcccttagtggaaggcctgatagcatctcatgttccagccaccaccctacttccagcagctcctcaattaaccatcatccctggacatgtagaaatctcttttgcatctgtattttcaaccactgctcccttgtgagaataataagttccatatgtatagttccccactcctcccccaaataaagtaatacttcctcttgtttctcctgaaagtgcccctttctgattactagaagatgttcactagttaagtgttccccttcctcactgccagcgtgatttgtgggttgggatcatgtgccttctcagcatttgtctttctggacttgaatagcatcctaattttctatagctcttcagtatctcaatatcagagaaaactgagatcaaatttcagttctactacattccagctatatgtccattgacaaggttatctaagcttcagttttgttttcttatcttaaaaatagagactaataatgctaaccccacagggtgcttttgatgtttggtgagataatatggagtctctgcccttcagtggggatggaggggtgggtaggatctaaagtcagtgtatgatcagggaaagttaaaaagcaaatagggtcagatttggtcaatattggaaaagatcactgaagaattaggagatttttcagggattatgttataggaaaaatatgttctcttttaagcataggagttctctcagtaaattgtgaatctggggttggggaatgatagagacaaaaatggccctgccccaccccacccagctgaacaagtggaacagcaagagaactgtagcactatagttacctttctctctttcactgcttaactacaacgaaggccccttccctcttaaatgatggtactgcaggctaaactctgttttcaaatggttttatatccatcgtttaaaagatagtgatcttgggtttaataatgaatgagttgcataattatatttatctcatctccaccatcccacacacccccctctaagacagcaaaattgaattcccctcattagttggtaacacttgagatcaatttcctactgtaaatgtgacagggattccctttccgtaactctgctgacatccgctgctcatttgaaaaccctcttgttcttctgcctgcacacacagccccaggaaatgcccctgtcgatcagtttccttgatagggcattgctctctctgcaaaggtcagtagcattgccacactagatgctgacagtgcccttcctcttcgggatcattcacaaaaagtaagaattattctcacctccccccacctgcccaggggagcaggatccctgctcaccaagtctctctgggcagccactgggttctagaccatttacttctctaagctctggcttagcagttctgccacccgagtgtaagcctccgcaccagcctctccttcactccatagctgcttttgcaggttcacgcatcacctcccaagcttggagttccacccttgtaaactgggcctgctgctgccctgaagccagcctcccatcccagagctgagtccagagctttgggtgactccagcctggcctcagggtggaatggaggccttgatacctgggagtatcagatttataccccccgccagcttccccagtagctactgctgactcccatctttactaaattaatctactgccttttctcctagacatccaaaaagtattagttggctttgccattgtagtatctgaagacaaaatatttagtcccaggtcagaaactttggctgaaagttcctactaaaaagccagacgtcatgattaaattgttagaaagttagccatgatatctgaggaagttatgaaatggctgtaaatgatgtaagctctgcaatgggcaaacgtgttcacaacttttgacatctggggaagagagttaagagccacaggctcagccggctcccgctgaccagcacagcatgaagtccaattagggctgcttttaaagggggtgattgcgctcaggggtgtggatgctgctcccaggggagcagggctgttgggaggagctgtccagatggctgtctccctggctcctctgaactacggagacccctcctgtgaattggatgggggatttccctgcccctcaattgctattccagaccctcttcctgtaagtagggttgggctccaggccctgttagtgggtctgtggtctctaggcaaagctttcacagcttccccagagagcagtggtgtctgcaagatgtgcgtttggttaacatgctggaggggcctctcataaatttcatggcaacaggaactgagtggctttgaaactccagctgctggtgggctcgatatgaggtctgttccaaaacctggaacatttgcttttcctatcgtcagccccaagtgctactcagacttggtgtctggaggagatgggccagagtcctgggggccagtgccagtccttctctgccctcagctggcacatcttggggagactttctttggatattccctgctggcctttgccaccttccttttctaagtgattctttttttaaattttaagtctctaggcctttccttccctcactcgctattttcttgaatttccagaaaaaacaatagagtgggaaagggagagtgaagggagatagagaaaaaaatagggggagagagagaaaagcaggaagaaaagaaagaggcagactctgagagagaggctgagagaatcattcttaggaaagataccaggaatttggggggttccttgtaatgctcatttttataaaataactggaggcagttttgccccccaaggaggagatggtactctaagttactgagcaaacccttgcccattgacaaggttgtctaagcttcagtttagttttcttatctaaaaaatggagactacttaggttaaagcaggccgcctaccctgcctcgacttggcggatgatgtaaggaaagcccccagcacttagcaagcactcaataagtgacatccctgtccctgccctcccctaccttcaccaaagtgcctctcataggaatagccttgtctgcctgggctgaccctgccctggtatttggggtgttctttgctgagtctgggaggatctaagacaaacacctttaaaggccctcaaatgagaacagttactccgccctcacttgttggagatggctttagtaaagcacatcagctcacgaggctcgtacagcaccctaggggcgcacaagccccagtgctgcccctcctggagctggctcatcctaagggtgcacaggaagagcagagtggtcacagtgtggcttgcccttgggactgtggtttgacccactcctccctgtccacttaggtctcaagtgtgaatcacatcccctatcagaaaacctgtgacaagctacaaagctgccaaatatgccagtggaagaggaacccgttctgcacatggtgcacattgaacttcctgggtggtgggggcaggacagcaccctgcgcaaagaacctcgaacttgaattaaatgcttgtttttaagaagtttggttatatggtggggggggtgcggggaggagaatgcacgtaacagaatagaaagagtaagtttaggtgcatgttcgtgtgcagtgtatacttacatggttctctctacatagtggattacagatgggttttattctctaatatggtacttattatatattgatttattttaatttcctaaaaatatgtcacttttgtaatgagaaaatgtcttgaaacttttgaaaaagtttcaagagtgaatgtatcatggttgtagtcaggaaaagggttttttttaataaacaaccttctaatgataatccactagcatcaagctcccttcatcctctctgccctttgggctgaggcagacaggtggaattatggaggaccaggaacttgcactctaagcctcaggcttgtttccactctggtctctgaatacacagagcgagaccaccacatgtcatctgccatcactgttactgttgcatggagcttcttcacagcttggactcttctggcttcttagtgagctgtgtgaagtgaaagaactgatggtttacacgggcagatgcttctttgggaaattgttcaggatgtcatccaccacagcacatgaagtccccttcaaaaacacccgcagaagaagagaagttgctctctgaccgttgctctccaaccacagacttagggaaagctgagcctgtccagcttgtgcagaacaagtatatatattcctatctaatgaaccttatacatccttgctaagactgccaggaggcatagagttagatttgtccctcagctttggcatgtgcgtgtgattttctgatatccatctttgtgtattaacctggtgcctgttttgctcattgctgctccttacccttactttcctttgtcccaatctctccttccctctctcactgcccgcctgtctgtttcttcctgtttccctccctcccctcttcttctgttccttctctctcttatcgctctcataaccccaccccgtctctctctactctctgtctcccttcctgtctccttccctccttcttcctttttatgtccctctctcccgtctctctccttctcgctgtttctcccacacacacttgtttctcgtttgcattgcctttttatggtacctatttttataacaccacctcatgtcatttataaaaagaggcaaaggtatccatcaataggggttaaatgagaccatagcagagtccacccttcaccaatcagttttagagaagtgttccaaaacagattccaagttttctctttctttgtatttctactgacctaatactttaccacgaagaacctcagcagatttcaggctttagagtcacacaggagtttgaagagctggaagataatcagctccaaaaaggaccctggcctttccacttttgcaagagcccatttatcctttgcttctgtgtaacacaagcctgcgtctcaaacattagtgtgcatcaggatcacctgcagggggccagacgtggcggctcgcacctataatctcagcactttgggaggccgaggtaggcagatcacttgagcccaggagttcgaggccagcctgggcaatgtggtgacactctgtctctctactaagatacaaaaattagctgggtgcagtggaatgtacctgttaatcccagctactctggaggctgaggtgggaggattgcttgagcctaggaggtcaaggctgcagtgagccatgaacgtgccactgcactccagcctggatgatgaagtgagaccctgtctcaaaataaaaatataaattaattaattaattaattaattacctgcagggcaaacattacagtatagcaattctatttcaataggcctgactttaaaaaatcacctagcaagtttgtcccacagatttctgggcctcaccccagagatcctgattcagtaggtctgggctgggtaggggtggcaggcaaactcaggggaatgtgaagctgtctgtctgcagatcacacttggaggaacccagcccaaagccctgacaaagggacttcctctagccacttggaggtggtggtttaaacggccttttgtggagcctgtcaaaagcctttttgaacatgtacatcaaatgagatccactagcccagcagcccccaacctttttgacaccagggaccagttgcatggaacacaatttttccacagacttgggagaggtgctggtttcaggatgattccagcttgttacatttattgtgtactttatttctattattattacattgtaatatttaatgaaataattatacaactcaccataatgtagaatcgggaggagccctgggcttgtttctctgcaactagacagtccaatttgggggtgatgggagacagtgacagatcatcaagtattagattctcataagaagtacacagcctagatccctcacatgcacagttcacaataggtttcccgctcctatgagaatctaatgccactgctaaactgacaggaggcggagctaacgtgagcaatgggaagtggctgtaagtacagatgaagttttgctgccttgccggcctgcattggcctctagagtctagccccttcatctctctgtgtttgttccttgacaagttcagtgagcacagagaagccagttatgcaaactacagcagacccttcctgtctcaattcagcatccagcgtctactgttagccagtgactgggcctgttcctcaaccactcaagccaagcacatgcaggtgactgtaaccagcccaggcaactggacccagcagtcctgcagactcctgctcagaggagggtccagcagccccaggtcgatatctccacctggctttgggcttctctgcttgtcctcatgtgtgaaagacagtaactgtcattaagggctaaaggggacacttggacttttagttatacctcactgaatgtatggggggattacttactgtagtggttttatcacgtggatattcattcatatcttgggattgtcagtggtgacaacaggagagctaacagctgagtgtcataccagacaatctcttgagtacagaacttaacaagcattacctcattcaaccgcagaggaccaaggaggcagggggacccgctgtcttgtagctgcagaggcaggctaggagaggccagctgcttcaggtggcagaggcaggattcaaacccgtgcctctgactgcaaagcccatgtttttaaccactacacaatgtgtctccttcaatgtcaaggattctgttgtatttttagcctctgcttttcccccctggaattatgggatttctaaaatgatgacacttctagaagcagctcatgaatagaaagatagcaacaggagtttaatatttagtgatggtctaaaatctcccaagatattaaatgttctgtcctttctcagagagcaagagctccaggaacatggatttttttccccaaaaaaactaagtgggcaagactcactcctgaaatacccaaaatagaagcataagaggacctgttgaaagaagcagtggagactatatcgatggagctgtcttgaaatagctacataccatgcctcaaatttactttggacaaaatgggagtggaaaaaaataagcccaaagtgctgcctggtcagcaggtctgttgtgcatgacggtgctcctgaattggctggctatttttattcctgtctgaaagccagggatggaaaaccctgagaggtttggtgaccaccccaagctcgtgagagtcatggtactagggctctgagtaggacccatctcagcccctactctgctctttttcctctctccccattatgggaaagagaaaagaatttcccaacactgactgtgctgctctcatatgggtttcttgctttaagtaatcttttttttaaaattatttaatttttttaagttccagggtacatgtgcaggatgtgcaggttcgttacataggtaaacatgtgccatggtggtttgctgcacataacaatccatcacctaggtattaagcccagcatgcattagttcttttccctaatgttctcccccaacaccctcccccaaaagggtatggggggagaacactccccccacactctccctgtgtccacgtgttctctttgttcagctcccacttataagtgagaacatgcagtgtttggtttttctcttcctgcgttagtttgctgaggataatggcttccagcttcatccatgtccctgcaaaggacatgatctcattcctttttatggctgcatagtattccatggtgtatatgtattacattttctttacccagtctgtcattgatgggcatttgggttggttccatgtctttaccattgtgaataggcctgccacgaacagacgcatgtgtgtatctttatcatagaatgatttatattcctttgggtatatacccagtaatgggactctaagtaatctttatagccttatcactcctaatcctaccaagagaagccctgctaccatcttagtgtatgtccttcccagactccttcatgtctaatttctatttgtgttgggtttttttggtttttttgtttgtttgtttttttggttttttttgagacagagtcttgctgtcgcccaggctggagtgcagagtgcagtggcacaatctcggctcactgcaggctccgccccccggggttctcgccattctcctgcctcagcctcccaagtagctgggactacagtcgcccgtcacctcgcccggctaattttttgtatttttagtagagacgggtgtcaccgtgttagccaggatggtctcgatctcctgacctcatgatccgtctgcctcggcctcccagagtgctgggattacaggcgtgagccaccgctatacagacaatactggaaacccatttacttaacttactgtatatcataagcacctttttgcatcattaactcttctgcttctgcatcaatttaatggttacagaatattcttttgtacctttccattctcttgctttcaaaacagattcttatgacagctatctaaaaaaaaatcactgtcactttgcaaaagtgaaattaggtagctcttgtgttgaaatagtaaaattgctctgttgtctttgaattacgttagtttgaggggaaatttgttttgctgtctacaaaaacaaaaagctggaaagcacgctatacaggagctctaggcctgtcttaggctttagaaagtaagtgagagctgaggagggtgtgccccaggtgagaacccaaagtcccagccatcaggggctccaccttcttgactggtagggtgggaggtgtggggtttgcatgtcagctgttcctggatctgagccctgcatctttcctctccccagcagacccgcccgtggctgcagcagtggtgtcccattttaatgactgcccagattcccacactcagttctgcttccatggaacctgcaggtttttggtgcaggaggacaagccagcatgtgtgtaagtatcccctgttctcctggagatctggggctggggtcagtccaatatccaattagaagagcatttacctccataagacttgccagaggctccgagacccctggagccagatgtgtcagaggattggaacagtggggctgagggacacctttttcaaaaccagatgtctaaaaatccaggttccaaggcccccagcccacagccactgaggcagaaccccgggaagttcaagcctggggccctgcatttttaacaagcatctcaggtcactcatgggtttagcaaagtctgaaaattcttggattcaaatttaattcacaacttagaatttctggagcacaaggcactgggatggataactttgagtggccaaagtctctaagatgtggtctctgccctctagcatcttcacaatccagctcataaaacaagccagaagtgcaggcgaagggctagtgtacataaatggtaacagaaccagaagcgacttagaaataaagatgcaggacatgcatggtggtctccacacctggctgagcatcatcctccttggggggcttctcgaagtattactgaactctgctctgacctacggaatcagaatctccaggagtgggacctgggaatcacattagttcagagccacagcgactgccacagtcagccaggttggggaagaaattcactcgaagaaagcttcccagagcaggtgttagggttagaccagttagggggagtagagaggttgttccaggcctcacatgctcaggggatctgctactgcagatcagtgtggctacaccagggagacagagaggagaccagcttagagacaaagtggaggccagagcctgttgaaagctgtctttattctttaggcaatggaagccatgtgggtttcagaaagacatatttaaagacaatcagtctgtctataatagaatactattagggggacctatattgaaccttggcactattacatttggagctgggtcattctgttgtggaaactgacctgtatactgaaggaagtcagcggtatccctggcctctatctactagatgccaatagcactactatccctggccgtgccaatcaaaaatatctccagacattgtcaaatgtcctctgcagggcaaaattgccccccagttaagagtcatggatccatatgaaattgccatttttgtaggtaaaatatggttgaggattggcagtttcatactaatcattaataaaaactggcacctattaaggttttggcttcatgtcaagtactgtttgaagtacaatccgtgtgctaactcatttaatcatactgaccccatgaagaagaaagagaggctatacccagcccgcatagcagggcctggactcaagccagcctctttggctcctgaagctgagttcttagccatgatgcttaaggccatcagatgcatcagcccaggagcctggggaccaggagagcctgctgcagtaggcggtgtggtcagggctttcctctgtctgaggtgcagctgtgtgagtctgggcaggcccctcagggtgcctctgagccctcacctggagagaaagaaggagaggcacactggccaccctcctcctcggaacaccgcagggctaagaaactcctccagatgacaggcctccacaccctgttaatacaaagcacgatgatgatgatgatagacactgtcattattcatgattatcattcttattaataattaacatactaggggcccctgggggactgatggggttgttttcatgagtgccctggtcattgtggaaaaacactggccctgaaggaagtttgccctcttgacccagatatcagaaagcttccctgtacaacaggcagaaggtactctcccaccagccacgtccagggctcggcccagaatcaagcatacagggcctcttgtgcactgggctatgagtagagagaatcctctttggagaaaaagggcaggtctttaccaagttct

SEQ ID NO: 14773 - DNA, 113060 bp, Human
aaaagacaggattttttttagtgttgtttttaatattacccaaataatgaacatgctctttgataacagataggttaaatgttttctgtaaatggccagatagtaaatgttttgagctttgcaggccatatagtctgtcagaatcattcaagtctggcattatggcatgaaagcagccatatacaacgtggaagtgcgtgggagtggctatgtgccaaaagcactgtattttttaaaaaaggcagcagcaggatggttctgacccatggaccatagtttactgattcatattttataaaattcattttttttcttatttttactagggtaaaagacatacacatagaatgtgtactcacacacttatccatatgcatatgtgcttacttaaaaatcatgaagatgaagcacaaaaaacaagcactttaagaaatttaagaaaaatacataatttcaagagaaaataaaacagatattctatccagcattcatttgttaagtacacaaagactctttctatccaaataagctccagagctggcctaccattctactttagttctaaaaccaacttagaaggtttaatttgctaataatcaaaattgtccttaaaaattctctaaatagtctgaagttattgtgcatagaactctgtattatactgttatatatattccaaatgtgagaaccactgagctggactaaagaaaaaaaaagctatatgcaaagatttggacggtcagacctttctttttaaaatagttatcaaattattacagggaatggagaattctaccatgtttcttcttgcctgcagacatttttaaatgtttatttaaatgttaagacattctaactttaatatgtactaataggacttgtttgctgctgcacattgtgtgtaaatattcacagattaaatgagctaacacatgtaaaagcacttcatacacagctctggcccagaccatattttttgcttttgaatcaaacttatgtctgctcatatccatatacacattggtccttagaggttcatacagaagaattgagccatctgcatcttgtctttccaacttgcatttcctagtgggtcttaaagaagagttaataggtgtcagagtttgagtctgggttccttacctgtagagcaacatcttcctagaagatatgacggggtccactctaccaggagtaaaatcacacaggtcctgacaaaacgcatggagatacatagatttagatacctagtataagagagctggactataaaatggccctcagctctgcaatcccttatgtattgtgcgtcctttgtagtcctctatagatgaagatagttacacctgaatggcttatgaagtagaaaacaagcctcgtgctttctagtaattctgtttatttctacataccacttcagtaagaagtattctgtattgttctaggtggagttcctaagcagaactgctaatccagaatgacatttaggattctgaatgtcaaaataagtttagtactccatggagaaaatttaatgagttgttaaaaaattcctctccatcctgtgctggagagaatcaatgcagactgggctggaggcccagtcctttaaagattactggatataattaatgatttactagaatgaatgtattctcttgggagaaaatatgattgtctgctatttattagctgaagacaatttaaaaatttattctcccttggatgtaatacctataaagtgccattggagtggttttcaaagtgagaaaaagcatgcagcagttagcattttcacttttctattctatctgtgatagttcccagccagtgataaatgctcagtgtatgaccactataaagaaccatgatgatatccatctcatagtcttatagttgccagaagagaaagccacaagatgaattctgttgttgagctacttgatgtgattaatgtatatggatcagggattaaactattaattttctatttttttaacagaaagaagccagaaaatattatcaaccctttgagaacacgacacaacgaactttatattttaccacttccttgaataggtaagactctctctactctgaaagagttacctacaagtgtgaaaaataactctttgctaaccttttgttttttaaaatctttaaataagtaacaattcattttagtaatggagaaataacttataaatagttatttctaatattttaatagttatagctaataaattcagtgttattaaaacagcacttcatagtgttgagttgacttaatagtaagaaaatgacaagctctttctcttaaatcaggattgaattcagcctgtctctcctgccttggttgacaatgccaacggtatttcttcagtacctgttacatgccaagcatgatcctacatgacttaatttgcataaatcaattcatttacttcttacaacagttctatgacgtagatatggggatcatccccattttagagattaggggcatgaggcagagagagaagcaggtggatgcagggattcacctgagattgcatacatggctttggaagcaggcactggacagaacaccagccccagctgttattaggagagtagtttcatgttgtggtagaaatgtctagcaatcagactttcctacattttgagtagtttttatcaaaatttatggaataaaaataacagtgcatttactgaacgcgctataaatgcatagcagataaacttttatgtttgcatttgttcctcacaaaatttttgcatgagtaaataaaggaatatatatgctttagctcagttacaagcagaaataatattttcctttattttacatctttctttaaactcaaaattcctatgataaaagcataataaaattatggaaagattataaatgaatgatttcttattctaggaaatatatttcaatttagtttttttaaattagaagtactgaatatataatcttaaattggccacagcagtattcactttcttgtttttattatttgtttttaagcaagaaaatttataagatgttcaaagcaaaatataaaaaaatattataggccgggtgtggtggctcacacctgtaatcccagcactttgaggccaaggtgggcagatcatgaggtcaggagtttgagatcagcctggccaacatagtgaaaccccatctctaccaaaaatacaaaaaattagccaggtatggtggtgggcacctgtaatcccagctactggggaggctgaggcaggagtatctcttgaacctgggaggtggaggttgcagtggctgagatcacaacattgcactccagcccaggtgacagtgcaagactctgtctcaaaaaagtatatatattacagcaaatacctaagcatccaccacacagattaaacaaatgctaacatgcagctatattaaaatcttgtctaaaaaaataatcacagaagtcatcaaagctcttcttgcttcctttttagtttcttccattcttccagagatgtcaaaaccctaaagatcatataaccttcctgtgtgtgttctaacactgctatgacatgtgtaagaaacaaatgttgaacaattattaacattttaaaagtttacatgaagggcatcacactgtagatattcttttgcatctcatctttacccaatattatatgtagagattctttcatatcgaggcatgaagatctggttgacaccttctgttataaagttgactcatcttaatgttttaatcttctggtgcctagtattattaattattatttctaaataactttcagcattttaaaggtttaatgttaaaatggtttaagcatggcttgcaaaacttatttgagatttatgtataaggaattcaaagtttttaatatataatatcatgccaatcctgcttatgttttatttttttcaactagaaaaacatttttttatttggtttgtaaggatcttactaatctaatgggactcatgattttcattcttttgctataacacaataattagaatctgttttatttccctatacatgaaatacttactattcccaaatatagtataaattactacctttggaatttaagatacttaaaagtgaaatatcttggtctggcctatgttagttgctcatattctagaaaataatggaggaaactaaaaaagaaattttttttcaaaatgttttctaacactatagctaattttagaatttgtttaaggtaaaagaaatgttagtatatggtagtgaaatagtagacatagactctctcccaacttttattttctgagagaagtaaattatttcgtcaaagttgggggaggaagaggaatagaagactaacctttttgggcaaatttgagtaagtaaatttgagattttatataagtctcttaggtcagaaatgcattaccattttgcataggaggcaaataaggcccaaatacctcaggtaacttactcaagatcatataatgattgcagagcctgcattcaaactcatccctttcaggctctgaagctattctgcctaccagaaaataaattggaaaaacctaatctgtttgtcacatatatagaaattttattcatgccactaatatttattgggatccttttatgtgagttgaggtccagtgttaggaaagcaaggaagacacagtacctaaaatgagaaacagtctattgaaaaccacgaagattaatttagtgataccactaaatgtgactatttaattagacatttttattttgctgtgatatcctcacactgcttaccaggtgattacctttgaaattgcctagccatgccaattcaattaaactggataggataataggagtgaaaatgttttgcaaatgacaaaatctttgcaatcatttgctaatattactaattctcatattccatgaatttagagttgaatacttctatcctaacacatgtacttctaaatgtgtttgaagtttgagtcttactaacttatgtagaattcacatatttttcggccgggcacggtgactcacgcctgtaatcccagcactttgggaggccgaggcagacagatcacaaggtcaggagtttgagaccagcctgaccaacatggtgaaacccccgtctctactaaaaataaaaaattagccgggcatggtggcacgtgcctgtaatcccagctactcaggaggctgaagaaggagaatcgcttgaacccgggagacggaggttgcagtgagccgagatatttttcacacaaaaaccttaaatattacagtgcagtggttagcaactctgaaagtttgtttgtttctaacaaccaccacctgttaaaggcatgatttaatctctttaagactcagagtagataattacagtaccaagctcatgcctgtccaggatcttatcatgccttatcatctctacctatatcattcacatccactgtctctcatgtttactactatcataatcccctgtactcagtcttgttcttctacagtctattgttcacatggaagtcagaattatcttttaaaaacatcttaatcaattgatatgactctcctatgcagaatccaccaatgactgcctgtaatagtcaaaaataaagcccacactcctacaatggccaacaagatgctacatatactggcatcttctacctacatcatctcgacatgatctcctctcatggagggcagagactatgatgttcagagctgtattaccagcccctagaactaccacctatcctggtggatggaccctcacttgctgaagggatgactaggtatgcaagggttaccatggaacaatgtaggtagatgctctgcacacagagtacctttaatgcagaacagtgatagtcgttgcccttttaaggattcctttggtttgtttcaacagaggccatcacatctgcaatgctaaagcactttcatgtttttgactcatgattttatagcattatgagaaactttacttagctgatttataattgcaagccataatgtataataccaaaagaaagaaaaatgcacatagacaaatcaggaactaattagctggatgagaaagccagttgaagagcagaaaatatttattattccttgcagtcttttaactaaataataatactaagatttaccacattcaacatagtttagattttactttatcttcagaatagatttatatctcttcatcactcatagatgagcaaagtttatcctttaagataattttctgtaaaataggctgggtttttgttgttgttgttgttttatttttataatattcctaggagaagcacttgatgagtgtttatatcattgagaacatttggcaagagaaagacaaacagtagaaccacaataccccaacatttaaggaaatgagaaagaaaacctggtattttcaccatcctctctgaaaataaatactttgacttgcactgattactacttcatcagcattcaactccgctccgtggcactctgtgtgaataattttaaaggcagattaagcattctaaaaataaattctattggtaaattaggatatcagatgcttccattataaaagcctatcctattctgtactctcagctggcagtcatatccagatctcaagctactctggctcttattgaacaagaacctattccaggagtgaggttttgaagagggatctctcatggttaactagagacagaaagaggcagaattgcccacatactctggcaggagttaaaataacaataacagccctcctacttaacaggctgagtcatcagcacattctactgatttctcagtaattctgggcagattgtttgggctggaattctgtaggcagaggtgggcaccacctgcttcaaaaggctctagttcttattaggagggtgctgttattaagtcttgtcttttaactgtttgaccaaatggagataggaaaagaaaacaaaaacggtgctgatgagcactttttctaatgcttagaatttttaaaaatggtggtccaggcatggttactatgcaattagttcttttactggctataagtcactttgcttaagcagaatagggaagattattttatggttgctgagggacctcataatccaagggctcagaaacagatcttatgagggtctagaatcaggaactaaacatcagccaggaactaaggccaccattctcccaatctctctggggctcctcagcccgatccctctgtagctctctttaattcaagatgactatagataactctttacgtagagactggatttccctactgcccattacacaagcacaactctcaagtgtgctttctcatgaatgccagcttcaagcagtatattaatttttaatgacctgagctgcttagctaataagctgtgatcaatggaatagaccaggtggtgcatatatagttgccaggatcctatacctatgggtgggaagagggaagaataatcagtgaaatggagtctcaaaagctattaaaaatctcatggtacagtttatttataccctaagtcttcccttccacaaaattcccctttattgaattttattgttgtataaagagccaaagagtaggatgttaagagattagaagagcagggagtatagccagcctccaagggaaagacaaatggataaaggacttcttgactgtggtttttgtgtaattgatactttagggagtgttcactacatactattttttccttcttcttcacatacttaggtatattttatggttgtcaactcatgaaaaccctattactgatcaagggtcttccatattggttggtgctcagaaactgaggatgtttataagcccttaaaagtcttattcaagctctccttgtcccttgagctagaaagtagcatttttcaagattgaagggagctacaagcaaaaaaaaaaaaaaaaaaaaaaaaaaaaaagagagagagagcgagaatagatggaaagcaaaatgactgtcatagacaaatctagagacagaacaagcagcttaaggaagcatttcaggtgcaaagttagcattcagcctttagcttgccacattttcctgtaaaaataaaactgcttataagatgcattcatctgtctgtcctgtccctttgatgcaatatgaaaaatgtgaacttagcaagagatgtgcgggtatgtgggtgtctgtgtgtttacatgcacaacttaaaccaacgtttcagtacacatagttccaaagaccactcttctacaaaacttggcatgaatgtgattatgagtttgggatgctttaaaacctcagtcctatggtcattgaaacgaattttaatttgaggatacagtgtgatatgaggaactttgcaggcagacccttcagctactgtcctgtggacctggctgttcctgaggaggtgaatggccattttcccacaagtggtatgtttggccggttccccttttgtccctcaggcttctgttgttggcaaaaaaaaaaaaagtagttaacaaggaaacatttttcttaatggtcataatctaactgcagcataatacctgcctaattctcactgaaatatgaaaccaaatatataaacttattttcgagccaatcatcattttacaggagagaaaagagtatgtgatgaagcaaagatctttctatttactcattaaaaaatattttaatcctaccttgttcaagtctctgttctataaagcatgagaaatccaagtaagggattgtgtagaagcatgaaactgcaacatgtgttaaaagaaacagcaagtccattttaattggattatgtaaggtagtagactgagttgagtcaaaaggggtaaattgaaataggactgtggagatgctataaaacctaacctaggggcatgcactttattcattagatagtggggattccgtgggcaacacggtttctggcagagcaatgatgtgatcaaacttgagttaggaagtttgattacactggcaaagatatgtagaatgaattagacagtagattctgaagcaaaagaaaattggaggtttgcatcactaatatgtatttacaccttcaatatgtggcagtggacaagaaagtgagtggaaaagaaacctgtagctgaggataacagtcaggactggaattatggactaggtactcatctacatatccagtatctgaactatttggagtgaagggccatggagaagagaataatgccagaaaagagcaaagaacattagggaacattcacattggtggggagaagtggagaaacagagaaaaatgagaaggatatttagaagaaggaatcatgcctatcatgaaccaaggttgttattacagaaaatgacatttaagtcaagaagaaagaacgaacaacaaaaaagtgtcatacttcgtgcttaatagattctcagtgactattaagagacaggaaaacaacagtaactacaaagtctctatcttcaactccagtcctgagaccaccaaacacaaagtttctaccatgctctggccatgcccatccagatatgctgtcgtcagtcatcacaaacacacatgtccctctgtgctcttcctggcacccaaagttttaatgtatctccgttgctatccatcaagatatccaagtagaaatccaagaatctattgtttaatcctcttgctttaattcctaaatctggccaggcaccagattctgaagtatctcagaaatctgagccatcctcttcctcactcttactctctcagcccagggcgtctaccagaacctttcagtggcctttgattagtttccctcttcctgaaattctttataaactgactctcctccatgctgtcactgtgtaattttcagtgtatatcagatcatttctttttcctacttcaaattttcctacagtctaaagctccaaacatattaaatgccatttagaacacgtcaaagcagctgtttctggacaatctccagtctttcctttctactcaattgccttttcttcattctaacctcagcaggtgacttgtacttcctcaatttaattatttatttttgtatgccacgtttctctcatgttacaatcacctttgttatttccgttactcctgtctaaatacccgtgttccccttgtctgccttccaaaagcctatgtctgttcaattcaaatgccattccttctatgaagctttttctccagtcctaaaaaagtggtattaattgtgcctttaggcaataaggggcatctggtagccttttaaatgtatctgcactatagaaaaatcatcttggcgtgtcattattcccatccagttggtgaagtctcaaaggcaaaagtttcaccgcttccaaaaccatgttattcgattttaaacaaaacaatacttaataaattgttgttaatagttgttactaagttatgagtaaaataatgagtacgtgataagtaaatggattaaagaggtgaaaagaaataaactgtagccttgagatagatttacaaaatagattttatggtgatggttactgtttgtcatcctttcgtgtggtagggaagggggtttgttttgggtaggaaaaaagactaggtttgtagtcagaaagcaagaaaaggaggaagaatgagctggaattgtgagaccatgaagggatatatgacaaaattttggaggaggcaggaaaagatacgttaaagagcaaataaattaacaaaataagggccacccattcctctaaagaaaggtgacgacaatgagggcaaatgaagagggcctagagagacaagacatagaccctttgcagggcttctgttttttaccatctcaggaaaaggagggctttcactctgcttttggcaaacatcaagctgtcctaagattccctgaatgtgtttgcacattctgtctgcacattggccagaaagcagatgttacaaaaggaccaacccagaagctgggccatctttgctccagccacaccggagaagggcatgaagagagaaattcaggaagagctgcaggaaattctttcctcaagtttgctctctcacttctcccactccacctcccacagggtgttctagttgctgtcaagatttgctgtgcaggcaataaactggggacagtgacttaaatgtttcatttaatcctgctacttctattagtctcatcgattttttggaaaatctcattatacttttcttcaaaccaaaaggattagcttattgctataacaaacagatctagaaatgtgttataactttgtttcttgctcacctaacagtccaggttcagtgttccagttgaaacgttgtttgtcctcttcgtagtcagccagggtccagacttcttccatgtgtggctttgctttgtcattttcttcatccagcgagtggaagggaaaagaccaaggaggagcaaaaggcagctgtacctgaggtgatcttggaagtgtacacagcacttctttctgttcacctgccattggtttgaactcagtcatttggacacacctaatcgcaagggaagttaagaaatgtactctagctatatgctcaaaatcaaaaaagattttggtaaatggttagcagtctctgttataccaagggaaaatctgcctacaaattaatatatttgaatactcagatcaagtagctcaagctgtggcaaaaatagatgtcagttataccacagagataagagtgtggattgtaacttcaatatcatgttaaaatagtaaatgtattaaatacactagtttatcgaacttaattcttataataatagagaaagcaagcattttgcttgggcaacatagcgagacctcatgtcatctcacaaaaaataaaaataaaaattagctaggaaggttgcacctgcctgtagtcccggctacttgggaggctgagatgggaggattgcttgagcccaggagttggaagaagcttgagagagctatgatcatgccactacactccagcctgggtgacacagcaagagctctgactctaaaagaaaaagaaaataataaatcagatattttacataactctccttatagaaatactcattgtttccaaaatgataatgacttcaaaagcatagtgtctattgccattcttggtttcttcagtaacttcttattaaaggaatcaattgattaattaatgtagaaaacctcattatggaaaaaataaatatttgtactttaatgagtttctaaaatttattataaaaagacaaattggcatagccagttaaaaactcatttttgtactgaagaaggatatatggccttttaaggaaaaatgaagagtaaaattataatagaaaaaaaccctgagttgatgcttttgcaaaaatgtttaaaaaactgtgatgttttgatgaacttacaaataaccgtatatagtcctgacgtgatattttgtatttgctccatccatactgtttatttggatgtttataaacattactatttacgtggagggtagcagtgcacctggtttatatgaaaggaatatagtgtgttgcagtgttgcatgaaagctgttctgttggataaatattctacaaaatcaatttatctgctaaaaaaattctataattgggtttctgtttcctgtgactgcagaatgcttgggtgtttgcaaaaatactgcattgcagtaagtgtgtgatcactgttttctccctgaaagttaaaacgcattttctctttgagagtaggcggccatttaatagaattctcatgacatcagagagcatttcaaagggaagaaaactggcctttcctacaagcatgtaagcaaagacagtttgatgttttcttctatgtgagattaagtagccagcaagaccccaatgtggctgaactcaggggctgattccttctgagtatctctgtcaaatcattcttcctaagaagtgtgatgattttacctaaacctagtaatttcttgagatttttactcttttcttttatcacccaccctctgcacttttctaatgaatatcaaggactccagttgtaccatgtgctcagtaattactacagaaggcagtttgattctgagacagttgtagtctctgtcagagaaatttagaattcactaaagcaaatacttcagtgagggagtgccaaagcttgagtcatttacaaccattgtgaacagagctctaggaaagatccagtagtaatcaatcctgaataaaaagcaaagggccaacacaatcaaaaaagacctttctctaacacagacagactgctgtggcactagaaagttcttcctactggcctactgggaagcagtgtgtaagcctttttgttttgagcctgtgtgttcctttttggcatgtgtttacaattggagtgagtcctgtttttggagtgtgagaattcaagagagaactttattttaaaagcaagggggattgaaaattatagtacaatataatgttatatacgtatatattatatatatatatatacacacacacacacttataagcaacagaattgaaaatataacagcgtaatacattgcatatgcacactgatatataatatccatatacatacatctatggattatttaaatatacactgtaagatttgactgaaacatgaggacagggaaattcttcattgaaatactatagggaagtaacataccaatgtatatttttaatgtaattttctcatggcagagctgagtaactgtattacatagttcaaaatatttgtacatggaaatcacacagaaaaacattctaactttattttctccacaatagtttaagtaatgacaagcctatcctgcaattattctttctggcatccaggatctaccatgcttaagagcctacaaagacttcccagcttgtataggatcctgtagagcttcgtcaggtgaatttttgaaattatacattaaaagtctaaaaatcacagaatgccaaatgaaagctcagaacctacctgaatagtattctctacaagcgagtgtactgctgctgtattctgcttttctcagctcatctggaatcccagaaagaaaaggagcagttctggccgggtgtggtggctcttacctgtaatcccatcactttgggaggccaaggtgggcagatcacttgaggtcaggaattcaagaccaccctagccaatatggtgaaaccctatctctattaaaaatacaaaaattagctgggcgtggtggcaggcacctgtaataccagctacttgggaggctgaggaacaagaatcgtttgaacccaggagtcagaggttgcagtgagccaggttcacatcactgcactccagcctgggcaatagactgagactgtgtcttgatgagataagacaagataaggtgagaggagataaggtaaaataaaataaggtaagatgagataagataggatgagatgagataagataagatgaggtgacataagataagataggaaaagaaaagaaaaatgggagcgatcagtccacagtggcccttttaaggatgctgttaccagtaatacttctaacctaaccatcagcctcactggtccctttttctcctcacttactacagtgattaaaatataaaattgctatcctttgttattgtgatggttatgatgaaatgttaaacatatgttaggtttaatagaagattaatttttgaataccagtgcattaaaaaattaatgtctccttaaactttttgtgatttttctaaaatttgttttattttaatattaacttaatcttttttgtgttcttaataatttttttaaattcactcttggctaggtcctatttacctaacttgcatatgatgggtctatttttatatctaagtattttgcctacaggcccaccacataatattgccacatctattaagacttttccaaataagattggaatatttgtctttgcagaaaaattaattattgtggcaatttaagtacttgaatattttttctagctcaattttttaacgtctcataaatgtaaatgaattgtatacatttcaggcctggaggatttagcaaatgtatgtcccatcatacccctccagaagtttgacagaatacaagtagcatgccatggaaatcaacctgattcctagaattcactctggggcacactaagataaatctactcaaagagagaagtcaaacagtatatgaaggctgatccagttggatcaaacttgggttgcaagggaatttcagatgacaaggattctctgtatgcttccttttggcccaactcaactgatatcatgaataaggctactttcaacttagaattcctctgaatcacaattacagctgcagtgggcacagcacaacacaagcagcctgccccaaatccacccctagaaaaaaagaaagaagagaaatgactctgctttatatgactcatacgttacttatatatgactaatatttacctttccctggagaaaaactagtatttaacataattaactagatcgttgatgctccacagatgtagtaggttagtatactttaaaatgcatgtaatacaaatgttttgcatccatccatttttctttttaaatatgtatgactcagaaggtttttactcatgtagtacctattttatcctctattattgcatttactgtgttataatgtatgttttttcaaacacatctgcctttctgaatacagtgtaagcagtttatggtcagagtctatatcttaatcatcatcattttcctaatgcctaacagcattcctgatataaacctggtattcaatcaatgatcattgaataagatactagaaaccaacataaattaatcgatggattgataatgatcttaaaattaaatgaaggcctgatacatgctcattagagatcattatcaatccattaacttatttattttgctttctagtatataattcagtaatcatttattgactaccacctttatatcaggcccagtgctttggtcatttaggctctctgttgcttaagcaatcctcccacctcagcctctcaaagtgctgagattacaggcatgaaccaccatgcctggcatcagcacaaattttaatgaaaaggaactcttctggacatcatatgtgactggaccacaaactgaattcaaaacataataatgtcaatacccatcaaaattgtataaaacatgatattttatcattcttttcaaaacatacatgtaaatagatgatagataaatactgtaattcatgaaacagtctgttaagtttattagactgtattaatttgaggattaggttttgttttaattaattaatttttttgaacatagaatctagccccttgtttcagtcccactcacactgccatagctcaggcccagttcctttcaaacaactgtctctgagaaatgtttctatccttagccatgtcttcttccaatttactttccataccactgctggatcaatcatcctaaaaaccaagctcgagtgtaccattttcttttctccatctttcatgggcatccctggccttcaggacagagtgcaggcatggctcaccacatccctttacaattctgccattgcctggccatcgacctcatttccacacttcccacttcacttctgttccatagtgaacaattttgtgccttacatgaggtttttttttttggttgttaatgttgttcatttatttagcaagcatttgttgtggagcctactctgtgccacacactgtacttggtgctggaggtcagagatgaattaaacacagcccttcctccaggagctcacagccttgtgagggagacatagagtagagaggaacctctgacccagagtgagggctggagttatggagatgccagaagatgctcattttggtatctttctagaaagtgttgcctagcccaagtctcaaaaacaaacaaaacaaaaacaaaaatgtaggatttggtcatctaggctctttcttcctagaaagcttcttgtcctttctttgactacctcctacttgtcctttaaaccctcttccaggcagtgttgattggcttcctagtgtggcaagagatgttgacgtacctccacaacttcccgtccttatcaccatcacagcatgtaccacactgtattattgttattggtttgtctgtcacctccttcaacatgagggctatatatttttttctagtattcccagtgtgttcctactacttgatacacagaagcctgtccattaattttttaaatacagttacaaaataattaattgcttaatgcattaaaatttgtaatcttagagttggacaacatcttagtagtcatacattccagcctcccatcagtcaaaaccagaattgattctgtaatgttcataacaggatggtcattcaggttttgcttgcttgaacacgttcactgataaggaatgcaatcaggttcaaagaaatgcaaaaaaaaaaaaaaatactatgactatgctgtaaatctgtttacacttatatttggaatgtgattttaatttgaacacgttagagacagagctttagtcagatggcttgcatttgtggagaaacaattgttcatcagaagataaagggactgagcagatcccataaagagaagggcacacaacaaatggtatcctgcttataattctccaggactttattcttcctctgtcttaaatagccaaaaagccgatcccactcatagaaaactatcaagcatctaatttttgaatttatgttctaatacattctccagtttcaattatctattcttttttttttttttgtcttttcatgactgccatttcttctccaacttttagagttttgttttctcttaattttaattctagcatcttcttccatgatgtataatatggcctccaagtttacctggatcatggccctgttacaataccagaaaatctctaaagcatctagtcctcaagtactgattgttatttttagattgttgttaatcccagccagtggcttcttcataatgtggctctcaggtatctcaaacccaaggatcttcactctgtggtggtgcaaatacttatggcctaaattctgctttgtaatgtctgcaattctagccaatattcttcagagttgtgtccaaagaagatttacttttatggtattttgttaagtgaacctggaccaagtctgacaggtcttgaatcagattccacactggaaaaagtttaaaacaaaatacattatttatccaaatccaaattataattttcctcttaagctttttatcctgatatttaaatgtatgcttatgtaagaaaaatttttattaaaattatgattagaattttttctccttataaagaaaaattctaatgtaggggtcaaagtttatttgttcaatggctccatagttagttacatacttatgaaactaacactctggtttagcatcatgtccaagtttacgtatctagtaagcggtagacccaggattcacccctatttttctgattgaaaatctgttacttattccacaatatctccagtacctaaatgcaagtccttaattccttaattaaatatcactggtaggggtggggggacttaaaaaaaagaaaaaaaaattactggtagagactaaagctctaaagcattttaaatattgtttatatctaatatacaggagctatttattagtcctctgatataataaaaaataggctcagaaatagtatacagctgtgaagcataagttgtatatcatggtcacataaagacaattgcccagtttcatatggtaggttgttaccaatcgagcaggtttacaaagttagtgttgttatctggagtggattctctttttagctctaaccctattccaccagtctcactgctttgtgaaacagcaagcaatggaacggatgttgggatttgacttctccttccagatctctctggaagtgtctaatttggttaaataattgtatctattcttggtttttcagtgtgggtcaaaccatgtactgaatcctattgctgaaaattttcaaataaaaaccataaaatgggctgggcacagtggctcatgcctgtaatcccagtgttttggaaggctgaggcagaggaattgcttgaggccaggattccaggcaacataacaagacccatctcttggtggtggatgggggggattagctggctatagtgatgtgcacttataatcttagctactcaggaggctgaggcttgcttgagcccaggtgtttgagactgcagcgagctatgattgtgtctccgcattccagcctgagtgacagtgtgagaccctgtctttgaaaaaaaaaaaaaagaaagaaaaagaagaaaacacaaaataataacaagtagtaggtaacatttcttaagcccttccaacttgtctgaacttatactttatttgtactatctatttctagcaataacctaatgttatctgtgcctatgatcatttgaaattacgtgttatgcacccaccagctctcttctttctaattgtttattagtcatggtatgtgatgaagaatgatgagtcatccttataggtattttacaatcagcctgaaataaagcagggaagatatgaaacaaatatctggattttcagcatatctttttcatgttatcaagaaccttttcctctgtttttcttagaagacaaagagggagaatatagagttgcaggcagcttattaacaaatgtttaagcttagaacttctcagcatttataagcaaaaatatggattctgcataaacttctaataccattaaggaccaaaacaaaagtttctattttgtgatactgatatgcatagtaacagtataaagcataattgagcctacatggaaaagagaaacaatatttatgtgcttaattgtattacacaactggtcattttagccttttgttcatctgtggatatgtagcagcacaaaattataaaaccaatgtttttgattgaactggcacattacatgatgatagggcagaacacatagaaaacattctagaactgtctgtgccgaacacattattaaaatggagacatgcctatctggcacatagtgtatttttcctttagattttccaagactttattgtttctccttttgccaatttttgagagtagttagtgctgcctggtaataactatcatcagtaagtattcctgtgctttgtgatctttctaatattgtaatccaaagaaaaccagtgaggtttgtgattatgtgggaatcccaggagggaaagttctattctacttaatgatattttcagcacacatgtctcagtgatctagatactaaataattcaattacttctttgagagctttacaaattcagcgttatctaccacacatttgcaccctgcttattaccccacatccacctccaaaatgatctaatggtaaagaaaattgtaactcaatttgagatattttaatcaagtgtacttctatcacaaaccattaatgaatgctaaggggtgtttaaagtaaatgttcgaaagacgatttgaaaatgccagggactgcccattgttttcataatgtgaagtagatttttttttaaccatggacaattggtaattttaaacattcttggaagatactacaagtaggattaggcacaacagagcactgccttattccccataagctagaatacaagcagtctatcttgtgatttaactccatcaactcatcataaatgttctggacaaaggaagtgaaagacccaacttctatttgtgagaatagtcatgtgacctatcaacatagttgccttaacccttcacttcagttagtctatagggatgttccatgtgtgtatttttatcactcctcattcttttctgaggtcctatgcagcaagcttggctgaaagcactagtcttcaaatgtcaatgtatcagagtcaccctattgagcttgttaaaatatcaatttgcaagtcccacattgagaaattctaatttgttaaacctgtgttggagctaattgactgaaaacactgtaagacacactggaatggatgatcaccaaagatcacttcagttttatgattttaaaacattttctccaatggattgaagtagtttatcttaaaagtatttctaaacctttatatcatgtggtttctattatgattactagacctctatcaccccatttatacagatttagaaatgtttttactagaccctattcgtgtccagtagtttgttttacttggtgttatttttcatatgcaccggagcatatgaaatggagttagaacttgaattccatacttctaccatgacagccctgaaaattagattcaaaactattcccctcttaacccaatttgctatatagtgttggccaaacatccacagcaggcagaacctttctgtgtttaccctgaggtaggtaattgattaattaatattcattcaacattgaatacatatttgaaagctgggaggtggaggttgcagtgagccaagatggaaccactgcactctagcctgggcaacgacgtgggaccctgtctcaaaaaaaaaaaaaaaaaaaaagacaatgaaaatgaaagccaaagtatgaccaaaggctgttttgatagttttttatattgctatcatggtttggttatgcacaccatactttcaaataaccccttttagacttcgaagaaaaggtatggaaaacttcaaaattttaaatgagtagaaatgagaaaattgtttcttttttagtaaaatgtatttctgatttgcatccttagtcctggagttatccagagaaaataaattcaaaattcatcaatagctcagactgatggcagagttgtcagggacatttttttctgtgtgtttctgcttacttcttatttctttcctttaaatagtctgggaaatatgacagctgtactttattttcttgtgtctgcaagccctcagggcatatgtgctcaggaactactttttgttacacttaaataagtatgtctatttgccacttgctctaaaaaacaaaatgcaggaaacatcagagtgtatcaaattatttttttccatgtgcaatattcaggcaatgcaataatagatggaggtccaggtgaaaatgcttctctttttaagccagctgttaaatgcattaagttttaatttgtacatacagttttataacacttagataaccaaccaaaatatgttatttggctgtctccaatataataagtcatttatcattttaaagttattattcacttattagccacatttgcttgaatgataatttaaaaagtattccaaggaagaagaacaaaggagaaatactttaaaaaaaaaactaagtaatttattccaacaaatcagatttttctgctacagtctgttaacctgtaacctatctgaaaggtctaaaatattacatttttatgagacattttgtgtggaaaatattgttgcctattttgtacttcattcgctttacatgaaaataagctattgtgtgctaaatgatattatataattctattgtaagaactatgctcaaactaaaatgttaaaaggtaatatgtacagttatgtatttatgatatatattctgcaggatttcagaaaagatttgataactttcacaattataaataaggaacagaacatagtactcaggacttagaataaagtaaatactgcattaagcattaaaattcttgggaataaaagaaaataagggaacagatgtatttcctgatagtctaattatcagaaatatgcaaaataagctgggcatggtggcttatgcctgtaatcccagcactttgagaggtcaaggtggatggaatgcttgagcttaggagttcaagacaagcctggacaatatggcaaaaccttgactctctaaaaaatacaaaaattagctgggcatgtggcacatagctgtagtcccagctacttaagaggctgcttgagaggctgagcggggagaatcacttgagcccgggaggttgaggctgcagtgagtgtgattgcatcattgcactgaagcctgggcaacagagtaagaccctgtctcaaaaaataaaatgaaataaagaaaataaaagaaataagcaaaatataggttatcttatttctaaattacaatgtaaattaatttattatgcattttttttgcacgaggcaatcacatcacaaaagacaatgtttcaacagtagtgttacagatttgcaggcagactttggctgcctatgggcaagtccaaattttttcttaacacagaaaaagaggaactcatttaagtatctagacacatactcaagtaagattttagaatttttaaacatagaacattacaatcttaggcctggaaaatgctaaaagcagatacatttaaatataagaaaatcctaatgcagtagaaattgaattgttgatgttccagtcaatactgtagaaatctgataaataacagcagtgatggctaaaagacctacccatcagctacaaaaagagtttccgagagtctacattaattatcatattagatagtttctattaagtgattgaaaattggaatatgtctgtcccaaaattgttttgccatagtacccatgttttatagtgagctggatatttccttttgttctttcttcattcttttgttgttgttgttgttgttgtttcttcctgttttttacttgcttctcaatctcttctatcacttctgtttctttagaattaataaattctaaattaataaaacatttggttacttattattccattctcacattgctataaagaaatatctgagactgtgtaatttataaagaaaagaggttcagttgcctcatggttcacaggttgtacaggaagcatgatgctggcatctgctcagcttcggggaggcctcagaaaccttacagtcatggtagaaggcaaagggggagcaagcacctcacatgaccagagcaggagtaagacagagtgaggagccacacacttttaaacaatcagatatcatgagagctcactatcatgaggacagtaccaagggggatggtgctaaaccattcatgagaaaaccacaccacgatccagtcacctcctatcagtccccacctccaacactggcaattacatttcagtatgaaatttgggtaggaacacagatccagaccatatcacttataaaattcataattcatggtaccaaaaccttttaatcaaaatgaggcaaagtacttgttttactcaacagtattaaacatgtaagcattaagtctacctaaaaacaaaattgaagaatgttacatgtgttaaaaagacgagaaattaattcatataccatttcaacttgaaatttaagctctagaaagaccattctattctggttatataacagttttattatgctgatatactatgatacagcttaaatcatcaatatgttagaaatctgatcaataccaagtctcttagtttggctcacatcattggaatcaaaggttaatgtcagatcaacaaacactaaagaatcttcgatttttcataattttccatcagtgaaattattcagagtgcagcagtgatcagtggtcagaggttggtatgaaaacattcatgttgttgtcaagaacattagcatgaaaaaaacagatctaaggtttatcaagggaaaaagctggaattttaaaaaaccgaagttttagcttttgatgaagtagaaataaatgtgtccatagaaactctcaaatatcaagacaaaattgtttaacaactaaggtagcaaacatcaaagctcaccactcagattcataactaacatttctggtggcacaatattttttcttttttttaataatataccttacctagaaagaatacttgggccctttaatatatagtataatagtcataatacaataaagtcaagtgtaatatctcaccctgatatcaatagatgtttaaacgtcttggatttttttttttttttttaacgcagtctcactctgttgcccaggctggagtgcaatggtgtgatcgcggctcactgcaacctccgcctcccaggttcaagcaattcttctgcctcagcctcccaagtagctggaactacaggcacacaccaccacacccagctaatttttgtatttttcttgggacagggtttcaccatgttggtcaggctggtctcgaactcctgacctcatgatccacccgacttggcctaccaaagtgctggcattacaggcgtgagccaccggtgcctggccatgtcttggatttttaaaaaatgcttatcacacataacagtattcccattatatattgacgtgtgttttgtcctaaaaagtaagattcccattgcaatatattataaattgtaaatcattgttttagtcttagatttccttgctcacattatcaagctaggcttttcagggaagagaaataaggcggccaagacggtgaaaccccttctctactaaaaatacaaaaaaaaaaaaaaaaaaaaagccaggcatgttggcgggcacctgtaatcccagctactcaggaggctgaggcaggagaatcacttgaccttgggaggtagaggttgcagtgagccgagatcacaccactgcactctagcctgggtgacggagcaagactccgtctcaaaaaaaaaaaaaaagaaagaaagaaagttgtttaggtagcatctcagcttgctctatcaaagctgggattgtgtggcagatgctcagctgtttggcagttaggagcagttaagatctgtgatcttttgcaatttggagagtttcccattgtacagtaggaatggaatgttaaaaattcctagtatctcacaacaaattttttagtagacttggagagaatttgtctttgtcttcacttttttatttgtatctttatttgcttagagacagagtctttctctgtcacccaggttgagtgctgtggcataatcatggctcactgtagcctcaatgtcctcagttgaagtgatcctcccacctcagcctcctaaatagctgcacccagctaattaaaaaaaaatttttttgtagagatgggggtctcactatgttgatcaggctggtcttgaactcctggactcaagcaatcctcccacctcgacctcccaaagtgctgggattacaggcaagagcaactatgcccagtctttatcttctttaattgcacattcacatggttttcaaagagatttgggtaaaaataatattacatcaggaagaagaaattaaagaaggctatggtacttttaactatgttgaaaataccattttgaagaacagagataatctatgaccccaaaattttgattagaagtataagtgaaatttatcatttatgggtggtattttaataatattatgttgtgattataaatgagtgtggccaaatagtgtctccttttgttcaataaacttttccctaaaacagaggcaatcttttcaagttatattttctgtaaaagtagttttgtcagagccatgctattttagtttgaaatctcctaaaatgatcattacttactaaatggttagactatcttctttcaaaaagctcaataaattaaaaagcaatacctgagtaatctgcatacattttaaggaatattatctgaatagtcttaccaggaagttgggtgatactttttaggtaatcgttttgatttgtttgtgattctagtattaagcgaaatcagtatggctagccagccttttcttcttccaaaattagtttttattaactaattttaaaaattcaaaactctaaagcattaaatactaaggaattcattttttaaatgtctgtcctcttgaaaacaaattatcataatatttttaaatggatgattaccaagtagcactctctctatttaagtgttggtttgctaggtttaaaataaggattcttggtcactgagaaatctgttccagaaagctctatggcagggggatgagagaagtcaaatgtaactgagagttgtgggtgcttatattgttgtatttgcttttaatatttggtggctagaactcctagagttaaacatggactaaagtacaaacctaaatatttcccagatcctcttggggatgttaataaatacggtgttagaaaaagttttgtggcaaattggtttgggatgttttgcacatcactgcctttgcctgagattcaaatatccagtagcgtatcaaaagctttcagaaggctcatagtgttcctacccacgtagcttagcatctcatctgaacactttacttctgtggtcttcctccccaaaacacataactttaaactaatcattacaaaaaacagacagatctcaatagaggggtatatgatttatctgattagtactcatcaaaactttcaaggtcaaggtcttaaaggaacctaaggagacatgaggactaaatataatatagtaccctggatcagatcctgaaacgaaaacgaaagacattaggtaagaactaaagtaatctaaataaactatggactgtagttaaaagtaatgttcactaattatataaatgtaccatactgatgcaaaatatttcaaatagggaaaactgtatgcaaggggtagatgggtaatctctatagtatctgcttaatatttttgtaaatttaaaactttcaaaaatgtaaagcctgttaactcagaaaaagctacatcaacaaggcatgttatttacgtgaaactttttctgtttacaatgttctctgtgtacacaaaataaattgggccatataagaatatggaaatcttaattaagctctttggtaaaacaaacaaacaaaaaagaaataaaagcatgtaaagattaggatactgatgtaggcaagaatctatcagtaaaatgttgtgatccaaaagttcacaattggaatctagataatttcctcaatccttcacatatatgaagatgccacaactcagcggaaacacaatgcttaggctacccaattagatcttttgatatgtgactggaagaaaatggcagaatggagtgtagaacactgcagaatggtttttataaaaagatgtagctaatttttcaatgtacacagggagaggttaattccaaggatgctctcttctcattaggctaccatgtctggtacatttaccatgcctgtcttgggatatccattcatccctacacaatatctggggacggatttgcaagtaactctcattattgtactcaccaagttttcaggctcctattcctatgccaatgttgtatatgtaatgaataatgatataattaacaaacaataacaaatgtaataactactgtttattgagcatgccaggaactgtgttgagccctttattttattctgtttaaacttggtaacaaaccaataaactaagcattgttctcatttaatagatgagaaaactctcctgtgcacacaattcttttcacatagttagtgaggtagcgatactccctgatttactcataagcccttcaatcaatgttttaaaacctaaatttttacatcctgtttaaatatgttcttagggaaaataaatagagctgttttgagaatcagttttgggagagatttggtgctgcagtcaaattggcttaaatgaattaactcatctagctcttcctgctatgaacagaaaatagagagagcggaggatagcaacaaaattcagttaaaaaacccccagacaaatgcttgttagtaatctgatgggaaaacttactttatttatactttctccaaacagagcttggtagtaagaagtgtatttgtcttaatataatttttgcttacttttttggaggcctttgcttgagatacttttttggaaaaaggaagatgttcttagtttccatcaaagacagtgttgcctgtgttgtcatccttactgtggagacgataagccatcaataaggctgcatggtgggcaacagctttccaaaactgagtggtgaatcacctcttttcaattatatatctaaacttggtaatatcagcttgtaagagaaggtcatgcagtatcttccatccaattaacatgtatagaacacctcctccacaactcattcatcctttgctataatttacaacttcctgttgtatgtcaatggttttaactttttcagatcttatttgatttagctgagaaataatgccataagataggatgtaggcctaatgctatatttatttcctttctctctgtaagatttacattaatagaaaatgtcatttcctcttagtctatagatagggtccaggaaagtttatcaaaaaaattaagttaaagctatctttctttctttttttttattatactttaagttttagggtacatgtgcacaacgtgcaggtttgttacatatccagaaaagtgtatctaccttcggctttaattgaacacccttgaaaccaaaacggctaatatgttagttattgtcttttctagatctcactaaaagtcatgatttaagagagtacatgggataatttttcatggtatagaattcctgctgtcattcttcctcccactttttctagcccgttttctcatactgcagattttccctatgctgaaggattccttgactctaccatacagtcaacattcaagaccataattaaatgaaagttcattaagatgtatacctaaatgccaaacactagttttttttcattgttgtttggttttttgttttgttttgttttgtttttgtttgtttacaaaaaggaatatgtgtagaatgacattgatcttattttaaaagaactaatattccagaaatggtctgtaaaactcaagatgaactaattgacccattcttgatattaaacataggttattgtacatgttttctttgaccatagaaagccacacggtttgctataaatttttcctatcttggtacaaccaatatcagatcagaagatttccccaaagtaatagctactattttttctctttcagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcaggtaactaagggctctactgtcaccaagtgcttgctttgtgctttgaagtcagtttagtctgaaagtgaattaatatacagcactgatcctctttcactagtgctaggactgaaattccagtcagtcagaggaaataaaagaagagaaaaatcatggcaactaacttgacatttccccacattatctgtattctcaatcccattcccctatttaatttttatcacgtgaatttttgcaggctgagtatatgtatgttttgctagaaactgtcagcattttaactcattgaaagaaaactttacaaatagtttttttttaattctcttaaatgaccttggacctaaatccaatggattgattagaagcatattttttagagcagaaaaaagcaaaatacgtaaatacatactgtaatttttttaatccatcattcaacaaattacagtttagcttttctacatgcaaggtgttgtgttagcttctgtgccagtgcatgtgcaagaaatggtcccagaacttcatgaatcagatgatcttggagcagacatgagacttgtgcatatgtttatttggatacaaagcataacatgtaagtgccacatgagcagtatagaaaggcaaagtttaaagcagattatttctgctttgggccaaagtccccaaattgtgcacaaaatcatcttatcatcttggggtgctgcagcaaattcacaagaatacaacaaggtattttaaatatttaaggggaacagtgataatatctgtcaaacactgcctgaactattagctcaagatagtttacagtttcaacattacattacactatattcctttaatatgtcatatctttgcaaaaataggttttcagcagttgttctgataaaagcaagtaccctgcagaaatccatgtgaaatggaagaagagagtgatagtgtccaacctgattccagggtttgagatactgtgcagtgccccacaggcacatacattcaattagtatgaaattgtggttgagaataaaataaaaatattatttgcacatttcatggttacaatgaggattaattaagatagtaaagtgtacaaagtgaatggctcaagaaataataactgttaattaattttattattattggtggtagtggtggtatcaatatggatgacatagcactcttgatcaagtaatatttttctatagctgagtatacacaactttaacagggtggaacttgggtgtcaggagcactaagaggattttcaagggattgcagcatgaggagatgagagcatgttatagcatattgattgtgaggaagaaaagagttagtatgatatgtcaaggtttttttcatcatcgtatcttgcagcattagaccttcaatattccataaatgtgtgttgagtgagcgagtgaatgaaggaataaatgaataaattcaaaaagaagaaagtcctcttcacattaatgatgaaaacaattgaaaagtcttactttgtcccttgggctctcgccagttgactctcagtgcctgttatgaaagcttgtaatacacaaaaaaaaatcactgcagtgtgcttggtcatgcagtaaaaaccaacaccattcactatttcatctgttcagtggtcttaagtatttgagagcatcagaaaaatctatttgtcaagtcagtgtattatcaccagcttctctgagaaaatgatatacatttaaaagaggctaatagacgtttcttttaaatgatgggtttaggaacatccagagttcattttaaattcagctcaatgtgtatcaaacacatttggtattagcttttggagattgattacaaaggttttgtctgtatgttctgagtgacaaaaattgtaaacagtcagccatgggctaccagagtgatagtcaatccaaactaaactatggtgtgatttttaaattaactttcctctagaaataagcagccaagtattgaatccatgagatatgcatgtgtagaaatctttagaaaaaggaaaatgtaaaataatatcttttcatgtctacagaggatgttccagtgatgagttaatatgcaattaaatttatttccaaactctaatttaacaaataacaacttttatcattcatggtttattgacagctgtttcacaaattgtgtaataaaaatcatctccagcataaacaaatgctcttaaatcccaaatatggtatttagaaatgctatcctttgatgatggagactatagatatgagctggcgtaatattttgatgtgattattttaaaaaggaccagggatctatacatcagctcactcttttatacaatctaccagtgtattacatttttccctataaaggatatttctcaggacactgttagcgtgaggcacttctcagtgacatcaggtccacagctatatgttgtaatatccaggacattactgattaaatcaaagaatcttccctctactttccgtttttgctatagtcccctctttgcattttaaaataatattttctccaagtttgtttctttttaatcatttatataaataagatcacatgataaataaaatgcaatcgtcatcttcttcccccttttctccttcattagagtgggctcacttcaaccaagatccttacttttttccccctcatccactccttcaatgttcatctttattatgggcaataataatttttaaagatgcaaacccatagtcagtgtatccttgatcttatgcactgacaccagagggtgggagagtggagaatattagaaggcaataataatttaaattggctgggtgcagtggctcacacctgtaatcctagcactttgggaggctgaggtgagtagattgcttgagcccaggaattcgagaccagtctgggcaacatggcaaaacctcatctccaaaaaaaaattagccgggtatgatgtcacacacctgtggtcccagctactcaagaggcaaaggtgggaggatcacctgagcccagggaggtcaagactgcagtgagctgtgatcaggccactgcacttctgcctagatgacagagcaagaccctgtctcaaaaaaaaaataataataataatctagattttgtccccttttttatgatttaaaactatccataaaaagaattatttgctcaactgtagcataatttttcattccttaagattttttcttaccactaaagtgtgctttttggaagccatgccacagaagcatgaaaaaaagaaatgagaaactattaagcatctagccacttaggaaagctgtcgttataataagtctaaagcgtaatttttatctttatctttgttttttgtttttaatttttattttcatggattcaggggatacaagtgcagttttgttacatgaatatatctcataggggtgaagtctgggctttgagtgtacccgtcacctgaatagtgaacattgtactcaataggtaatttttcaaccctcacctctttcccaccctcccgcctttttgagtctccaatgtctattatttccatatttatgtccttgtgtattcattgtttaactcacacttgtaagtgagaacgtatggtatttgattttctctttctgagttatttcacttaagataatggtctcccgttccatccatgttgctgcaaaagatatgattttattcttttttatggctgtgtagtattccatcgtatatctacactacattttctttatccagtcatccactgatggatgcttaggttgattccatacctttgctattgtgaatggtgctgcaataaatatatgagtgcaggtgtctttgatataatgatttattttccattgggtagatacccagtagtgagattgctggatcgaatggtagttttattttcagttctttgagaaatctccataccgttttccataaagactgtagtaatttaacattcccgtcaacattgtttaagagttcctttttctctatagcattgttaacatctgttgtcttttgactttttaataatggccattctaactggtataagatgatatctcattgtggttttaatttgcatttccgtgatgattagtgatgttgagcattttttttcatatacctatttggccatttgtgcatcttcttttgagaagtgtctattcatgtccgttgctcactttttaatgaggattttttttttcttgttgagttgtttgaattccttagtccttcgttggatgcacagtttgcagatattttctcccattctgtgggttgtctgtttactcttttggttatttcttttcctgtgcagaagctttttaatctaattaagtcccattagtctatttttgtttttgttgcatttacttttggggtgttagtcattataattctttgcctagggcaatgttcagaaaagtttttcctgggctttttttctaggatttttatagcttgaggtctcacttttaagttaaagcatcattttaaaattgttttccaaagcgtaaataataagagtaatggcttgtaataattctttcctctcttttctgtgttatctttattgaagaaagcaagaggaatgcattttggtccccacagagtttcagctctgaagataactgggagcctcatccttaagtttcagttccagggttggggcccaaactcgtattagaacttgtatcaagatcttataaaagggcaaaagggattatttgtaaaatttgtaaaatattgagtggaaaattattttagaaaatggaaagtgacctttcaaattttaagggcacagaaaagcaattgatttctgtaatcattgtgcatgtgacttaacagtgtaattggttttgacttcatctagtattcccttaacagtattatatcaaatcctatctttactgtgcctgtttatagaatcattttgaatatggtactttctagcagcaaaaacagggatgtgcaaacaaagtggtggttctatgtttctgaccttgctctaaaaaagtaataattttgctgttgctcacttttcatctaaagagaggaaaaaaaaattattattattactattttttttttgagatgaagtctcgctcttgtctcccaggctggagtgcaatggcacgatcttggctcattgcaatgtctgcctcccgggttcaagcgattctcttgcctcagcctccagagtagctgagattacaggcgcctgccaccaggcctggctaatttttgtatttttagtagagacggggtttcaccatgttggccaggctggtcttgaactcctgacctcaggtgatccacccacctcgacctcccaaagtgctgggattacaggcgtgagccactgcgcccggccgagaggaaaaaattttctaatttctattcatccctcaagaattgcttacaaaactattatggaaatatatataaaactacagcttagaaatgtgtgtagaattgcaagctgccatagtgctcttcagtttataaagcaccgtcatatcttttatctcatttcatctttttgcaatttccatgaggatatctgtcattagtgtcttctttttacaaataagaagactaaggcacagaatggctgagcaacttgcccattattacacagtaagaaagtgagagaggtgaattgtgaacacagtgttcaggaatttcatgcaactctcttctcaactgtcctaacctcaagaagtggtatggatttttttttctatagtttataatttacttggctttataaatatgctactcattgtgaaagctttcaagactcttttagatgagtgtatttttttttcttgctctcaggattaattttgcaaatgtcaggatttgttctttattagaaaatcgtggtgaaattagctacttttctatcacagttgtggatgatgtgattgaaagctggaagggaccagtgagatgacttttcacagtagataatatgactactaccagaatgcaagtctcttgccctacagaccagtgctgtttccactatccccatctgccacattcagaacagcagttagttgcagcagttatcgattacaggcaaagcagacaattcttctattccagaactgccacattcatgtaattttaagtgatatgatatcataactttattcctagttttcaatctgagtagacaaaaaggggaggcaattttgagatgtttattgatactaaaacatttttaaagtatttaaaatcaggctttagtgatttttgactatcttgaagtacagtgctgtgaacactagtaaaaaaaaaaaaatgctgatcacagaccgggcgtggtggctcatgcctggaatcccagcactttgggaggccgaggcgggtggatcacgaggtcaggagattgggaccatcctggctaacactgtgaaaccccgtctctactgaaaatagaaaaaattagccgggcgtggtggcgggcgcgtgtagtcccagctacttaggaggctgaggtaggagaatggtgtgaacccaggaggcggagcttgcagcgagccgagatggcgccactgcactccagcctgggcgacagagcgagactcagtctcaaaaaaaaaatgctggtcacagtagaaagtgcctacgtgacgatcaaaggccagtatcagcaatccccttgggtaaatgtaaagattaaaaggcaattcctcactataatccccacaatttaccaggattcctttgtctccccatcatttccaggcatgctatccagacctacccactgccaaagaggcaggaatggaaaagcttttccaggctttgcgttgtcactttttcagggagctcaccatgggagctatgtcttataaaatctggccctatactatcacatccacataactccagcagccaagtgaccaacactcagttatatacatttattgttgctgcaattttttttttttttttttttttttttgagatggagtctcgctctgtcgcccaggctggagtgcagtggcgcgatctcggcacactgcaagctccgcctcccgggttcacgccattctcccgcctcagcctcccaatagctgggactacaggcgcccgccaccaagcccggctaattttttttgtattttttagtagagacggggtttcaccgtgttagccaggatggtctctatctcctgacctcgtgatccgcctgcctctgcctcccaaagtgctgagattacaggcgtgagccaacgtgcccggcctgctgcaattattattattattattattattattattattattattattattattttgagaccgagtctcgctctgtcgcccaggctggagtgcagtggcgcgatctcggctcactgcaagctccgcctcccggattcacacccattctcctgcctcagcctcccgagtaactgggactacaggtgcccgccaccacgcccggctaattttttgtatttttttttttttttagtagagacagggtttcactgtgttatccaggatggtcttcatatcctgacctcgtgatccgcccgcctcggcatcccaaagtgctgggattacaggcgtgagccaccacacccggcctgttgctgcaattattaagtttgaaaacacatgaaggaaaagtttggcagctctcacatgcaaaaagctgcatatgcctttaaataaagcttttctctctgttctgcttttcaatctcagaagattcaaatctatcttttctcacctcgccctttctcccctgcctccgtttctagatttgcgatttactaataggagtcagcatcccatttaaaatatggcctattctatgtaatatattaatttatgcggagcaaaatagcactgagccatttctcctgcaaaatgactaaagccatccacaccaaccccccaagcaaataaacaagctcgcctaacaatgcgagaggttgcagattttcctttcctagttgccatgccaaccactcattgctctggctgccatttccctgagctccgcagagagaggagtgtgcagagcagagttatttagcattcaagggtggatctgcagaaaatcacacagcctcactgcgaagcatctgggcctggtggcaccgatggatgaggacagaaaatggggatcttttcagtgttttccttctaaaggttaggcatccggggctagaaagagtgagaaagacaaggattgatagaaaaggcagttccacgaggtttgtattgtcacgtttgctttgtcctatgtggtctctctactaggtgaagctggttgtggggattagcttcaatcataatatttggcttggcttgttgatgaataggatttgaacctaatttagggctagcttatatggatattataataaagaattgtgtcttttattcttgatacaatatgaggttgtatatagcaggtattgccagccacagcgtttgatattttacaaattagaggaaaaaaaccaacatcagataaagttttgtttcattgtacagctataaggtagtttgtcccataaaaatctgtctttgctctgtagtccagtcttaaggtaggatgagattttcttaagacggtaattcttaatcgatatatgaggaaaacttggtttctcaagacttgtttccattaaaccctatgactcaacaaattaaggtatgattttattccttggaattttaattgcctacaaacacttcaagttgtgaagagcaaggctctatctaacacaatataataggatatttaaaaactgaggttaattgcattcacatgtacttctatgtgtgttcctcaagaaaattcctcccatgcactgtggaaatcagtctcgtttcttgtctcgctttgtgctaaatgtcagaactacatcacaagcgcaaaaagtatttcctcagacgttttggtccactgacattttaaaaattattttgttgaatttgaatcttaacgaaacagatttttgccaatgacaattcagacctatttatgaaaattattctttctagtttgtttttaagtgcaaatataatttaattatcattgtaatttttacttgacctttctctcatcccattttttccaagatcttgttaagttttctctcctctaatatgctgtcatgttttgtcatcatatttttcttttaatgtttttcaatttttttgagatttaaaaaacctccatttagataaaaatttaaaacaattcttaaattctttttttatttttagcaaacagatgaaagtaataagtaatgggagtgagtcttctagactcatttttggactgtctaagcctttgttttggttaggattatgcatggcctttatctgtcctttgttatatttcggagtattttctcctcacaaaagagaaaaagaaaaaaaagataagataaaaaatctaatacttttgaacaaataaattgctcaaatatcttgagactatatttcttatcaagcaataatgtgtttttaagtgtgagatatatatatatatacacacatatatatattctttgattatattacttgtgtaggtctgagaaaaatgtttgccactgtatgccaaatgctgccttgcggtttagaattgggtttgattttattgcggttgggaggttattaagtagactggagagtacccagcagttatcactcctcttttttcccctctaagctattgagataaactgactctttctacttcagtgtgtcaagcctttttctcttcctctcattccctcacacttcactgctccccagtacattacataaagcacgtgctttgactgtcaggggagtctggaaatcatatcaggagaggatgaacagaacaactggtgctgcattgcagacctggtagcttcagcattatctgacctggcatcgtgagtcctgggggaaaaggacactaaaccgtgtcctgccggctcactgtgtagctcgtctcactgaatgagtcaccattcagcaacactcatagaaaatacagttcaaaaaccagccaagctgatgagcagaggaaggggaaaacatatgtcataggttgtcatgcaacttttaacaatgcttttaacaatttttgcaaatgctgggtggttattagaacacagaaatgagagtaaaatacagttgatttcaggaatacgcaagaaggcattaggcaaaaatagataagaaaggaggaatcaagattcagagaaaaatcatcctaaatacatatgattcagtttaagcatcctgaaaatccatatttttaatttgtaaacacaggtcaaagtgatgctggcatatgagcacctctggttcttgcaaagcatctccagcatgaatgatcagtcctccgattggtctaaaatgttctcttttgtgacacgttgcatttgccgaatgtaaatgggcaagtttacattgtggtgttttcattcccatgcagtattgtgcaagaagtcataagaaaaacattttggaagggtaccaccctacagcaaaggttctcggaaatctaccattaaagataaagagctgttgttgattttattctctcaaatgagtcttcctcttctgaacacccccaagtaccatgtttatatcttgctaatacaattgatcatagcaatcattttactgaggttacttgttatttgtttttattacagtcagtaggttggaaatgctttggggtagaacctgtgcttcattcatctttcttttcctttttgtatataacacagtgcttattttctataatatgtatgtgctaatacatattttttgaattaatataaagaagagagggctgggcatggtggcttgcgcctgtaatcccagcactttgggaggccaagatgggcagatcacttgaggtcaggagttcaagaccagcctggccaacatagtgaaaccctgtctctactaaaaatacaaaaattagctgggcatggtggcacatgcctgtaataccagctacctgggaggctgaagcccaagaattgcttaaatccaggaggtggaggttacagtgagtcagatcacgccactgcactccagcctgggcaacagagtgagaccctgtctcaaacaaaaaaacaaaaagaagagagagtatccatatatagttctgagaatggaaatcacataaacaaaatggtctacaaaatttatactacattgtgaacaataaatttgcaggaaagactgtattagaaaggaaaaccgtggctcatgcctctatcccagcactttggaaggccaaggcaggcaggcagatcacgaggtcaggagatcgggactatcctggccaacattgtgaaatcccatctctactaaaaatacaaaaattagctaggcttggtggtgcatgcctgtagtcccagttactcaggaggctgaggcaggagaatcgcttgaacccaggaggcggaggttgcatgcagtgagctgagatcgcgcccctgccctccagcctggtgacagagcgaaactccgtctcaaaaaaaaaaaaaaaaaaaaaaaagaagaagaagaaaagaaaggaaaactgagaatgaagaggtaatcaagaaactgaaaacagtctagattcaaagtaaggactttaaaagtgtcggttagaacagaaagaaattaggtaggaactccaaaatactgtagtgaaagtatatggtggaagacttgacttgttctgaaattgggagtgagagttgggagtaaagaaaatatatctttgactgaagatagcagtaagatatcaaattggagatattttcttgatgatgaaaattactgagctgaaaataatatgaaaagtccagataaatgaactttctaaaagataatctagtggttaagaaatacatagatacagaaaaatttttcatgttcatttctgcagaattgaggccagtgtaataattggcttaggttgaaaatgccactgaaatattctgtaaatggaactctataatgcatgtcttttttgatcctctgactataaataaggattgctgcactgttctaggtcaagtaaatctcatttctgacaaatgggcaatctaaatcttaaagcatttggatattctaagtcatggatttaatatgtgcctcctttaaaggagtataccagtatcgtcttggaaagatattatgtatcctatttttgaagaccaaatgtcaccaatgccctttattttctctatttcatctttgagtgcataaaattatttgcaaatgagttcttagatagtaaacaacattatcatatcaaattaggaatttatacattaactttaggaaaatattgtgatttcagttaaatataattccttagtttcattttagttttcatttttcacttaataaaaagcttcctgtgatccataattttcttttcctttgacatatttgaatgaaaatgctcccatttacattttctaaatctaatcattaagtatttcagtgtttagtgaaattcttctccaaggaggaaactaatagtagtaataataattattgacttacttttataaccacttttaaaaaatcaattcactggatactttttctccttgttgaattttgcatcttcagctcatgtttatttatgtctttctttaaaaattggctttggttgtttttctcatcagcttgaaaaatagaatttgtgactaaagcattaaaaaaattggaataaacttgctttccttcgagctttactggaacacaaatgctgacctggggaaagtggctttttctccaaatattgcactaacttggtgtagatcacaacgcatgtaagatatttattttctccaggccagttctcatctaattctttataaatcctgattgctataagaaaagaagcaaatgattgagtttgatgcaaatatagtagccacttaacaaaagtcacattttaagagaggaagttcattcagttgggataacagtagaggataacagtagaggaataacagtagaggaataacaagaggataacgagaaaggaagttcattcagttggaataacagtagttcccttctctcatctgccatcctgaagaaaaatgtgttatgaaatgctctgcagaccacatttatcttgctcatatgatcctaatacaacatcaaaaatactgctcaaggaattggctattttggtgacacaggtttcctttctagttggatttcactctttaagggtgaacttaaattactctagctgactatcatcttatgatggaattactagatacgtttgaatttaatttttttatgtgaagaaaaaaattttatcatcttatgatggaattactagataagtttgaatttaattttttttgatgtgaagaaaaaaactcccccaaattatacttatttttaaagtaaattttataatatcgagcattttttcaattctaactagaaatgcttgaatctcctgaggcttgaataatggcaagtttcaacttttgcctgtgttctttgatacaactgaatgtggaaaaactacagtatgtaaatagaaagtggttttcttcaccagttctgtgggaaaatgaaaatacgatatttgctttttaaagagtattttggacactctaaactctatttaaaatgttgaggtatttcttgtattttatgctataaaatttcagtaagacactttaattaacataatgattgtattaaaaccatacttctcttcctatagcttttgatcaccttctagttgttttcagatcatgtcattcctgcctctttgtttcatgtgtgcatttcagaactgtccaagaaaaagagcaaaaacaacaaagttctctggtttcatgagagtttttacttttacagttttttttaaagaaaacaaacccaaactacaaactcacataaaatatttttggaaggggtggtctctgtaaaagttgggagaaaagtgactgataaactagcaaagggaaaggaaaggaatctgagaaaccaagctatttttaggcatattcttagaaccgagaattggtcaactgcttcatgatcagggctcctgtacatgaaatactgacattgtaatttcattttgaaaaacaaaggtacaagtcctgatttagaaattttccttatatgttgggaagaaaataatatatttttcatatattatcatagtaaattgaattttcattgtaatattttcctgaaaatttcagggccttttaatgaaatctgattttccatatcctcaacaagccccaaatgtctattccataagattgtgattctcattccaaatgaagctctgtctttgtagaccaagtatgttgtatgggtatagtaatatctgcctacctaggaccggccctatgcagaattagaaagtaaatgaaacatgacttcagcacttttctatctgcttccccaatcccttctcttcattttcttcaagtcagcagtcatatgctcatatgcctaaaatcccgcataaatcccattacaaagcttaatctccttgccctatatcaggctacctacctagatagcatcctgttcttacatttttctcaactctaccactccatcaaattttatctacctttctctttctgctgggctcctacaataggacaaccagagctatttcaataacaagttacagttttatgcttctagatatcatttctattctgatataaaacttcattgtcttcaagtaaagagtgagttctttggcaagtataggtataatagagatggaattcatgctttgaaggtatttctagaggtgtgcttggtatcaatgagaagcaatacagtggagagatgcagctatagaaattgacatgaataaacaacattgaagcaaaatcatcaatgtaaaattttatttcaacaaacgccccagagatattttctaaagatttgtatgctatttgcaaatttctcaaggtgcatttgaaattattatttgttttttatttgtcttacataatgaagaaataaaattgaaaaatgtatttaataatattttccatggggtgcatttatcaatacagagtctaaaagaaatcgtctttattctagaatatttttgacatgaagaaattttaaaattctattaaagtctttgctttttactgtcataatggcatcgaaatacaaatatgacattgaccttacccttcttgctgtaaaaagaagatttgcaaagtctgttgattttgctacgtacaggtctggcaaaaagtattttaactatcatcaattttacatatttagaatttttccagtgaaggtgctccccttctcttgggttgtggctgagcttttattttacagcattattaaagaaagaatagtaggatggttcaaatttactttactttcttttgctttttcttaagtaggtatttcagttttcagaagttcatagtgtaattgatttcactgtacttccccccataagattactgaaacatgattatctgattatatattcagttatgatttgaaaattacaaagaactaccatgtctatttaacattgacttttaaagtctgtcaagtcatttcaggtgctggtgtaaagagaatctttgcggacaatacttttgtagctataatgatataaaatatgcaggtatagaaaatgaacagtcacttatttacaacattaatagttaatgagaaacttgctaagaagaaagcagataaggttgatgattgctgctatttgcgaattcttagaaacgttataggacgggaaggaggtttaagtgaaatctgattacgcagaagtcatgttggtttttccatgtgaacattgagtgtaccttctgatgtattttgaacaaagtgatttttcccatcacatggttcctaaattccatatgcatctaggtcacaaggcttccaaagatttctaagttatgttggggatgagagagaaggatcaaacaaaagttagctaagctgctgatctttaccattttattgtaacaaatatagtttctcctagaagaaagatctgtgtttacagaggtaactagtaaagactattcttggtatatagagaacttaatttcaaaagtttattccaatgacatccttttagaatgtagaatttttttccatcatatcctgtctcaggccagcattggcattcctatgttttgcagctatagaagcattgatttctccataagaaaccctagccttgctccttgtgcctaagacctgtgaggtatccatgtacagatgagactttaaaagcatggacagacctctatgtgcatgagtcctaacatgtgcatacacacacacacacgcacacacacacacacaaaattgcttttccacaaacccactatattttatattttgtttatctcacagttactctttctaggggtggatttattcaaggtctctttgttttattgatattttattttcccactaatatttaaaatgtatcatgctacattcctttagcaatgtgatgtattttaagacttaatgaagagaatataatccaatttccccacatctacaaagagtagtacaattgtaacagttttgacgagatgcaaaacagaacatttcaaagttccaaaagtactgtcaattccctcagtgccttaatgattggattcaatttattggtgttaaaactattgaaaatttcaggggagcaaacctctctaggaatttctctttctcaagttaagattgataaaatattacaaccttagttaattagtaaatatgtaatataggggctacaaacaacataaacatgcaatacattactccattggacacccccaaaaccaccaccagcagaacactttaactagaacatgataaatataaagctaaattgtaacgatactggcttaccatatttcttctgcttaaatgtgttttctgtttcctactttcagctgggaacttaaaattagaagcaaaattttccagtaggtactatctctgatctgtgcttttctaattacctttgactccataatgtagtgtttttaacctgtggtgtcctttcactgataatagtattaatttactacattttcctccttgaccaaatttaaatgctaggccagttctattaaactctaaagacttcatttgagtacattaaggtataatctaaacaagattgtgggtttgagcatgtacgtggaggtagaggaaaaaaaagagcaagagagggagaattctcctatgattatacactgtactcacaatcctagtctaccaatttgtaaatccgtttcagaagaggaccatatgagtgactgtggcgggatcagtcaaaatttgtggccactactagtaaatcttgaagaagaaaaataaaacatgtccttgaacaagagtgcccccctttaaacacaacttaaatgtaggaataccatatcttactcatctttctatcccccactagtgactaagaatagctccattgtctatagcaggtgcaaaataaattctcttaaatttaagtacccatcagagctgaattttgtgccatcataattcttttatcttaaatgcatttgtcttcgttaactaacttcgcctcaaatgcatttttccccataaaccaaattgatccttgttttaatcgctaaatctttagaagaaatatctggaaaaaaaaagctggtggggaaagatctgtagctgcaatgttggccagtgtgacccctgagattaacagaggtctgtctagggtgagacatgccaatgctggcctctaaataatgcaaaggtgccagggaaacaaacaaataaaaacccaacaatttgctcttttaatttccttcatcatcagttgattacaggaaatagtttcagaggaaccatttactctccaaattgagcaaggagtagaagcaaataacttttcttctttccctatttttatgaattcatctagggtctttgtttagcagagtgcttcaaactacacagtgctttccttgttgattagtttccatcagcagcagcaattagcatcggtttcctaggaaaccattctgtaccctactgagaaaaaccttttcttgacaggagcattctgtctaaaattgttttgttttccttcttccacaagcgtacggtaagcttatttgtcgttttctttgaacacaacattattataccaaagattcttaaaacatttacaggcttttatattccatatggttgaatttacaggcactgtctcttacttttctctaacaacctgaaagaaatcaacaaaaatatgttctcaagcatatgccaaggtgcttggattttttttattcacagtctaattggtgaacctttgcacgttcaagtaatcatagctggtcctgctgaaaaaccacagggtacgaattcaaaatcaaacttatgggtccaccaacaatgttacatatcactcagaatcactcagaaacaagttgaaacttccaggatcattgaaaaagtttcatctccattggttatttttaatcaaccaagcaatattgatagataaatgtaacacaataactttaaaatgcgctaaaagcaaagcctgaggttgtcttaaaatttttgttgtgacaagtagtgtgatcagaagagcatggcaatggtgcagcatgaatcagcattagggaaaaaaccagagggtcatgatggctataaatgctgagtagtatgatatgacagtagggcaaaatttaccttatgttccttttagtttaaataataagtggcaggagcctgatgtattgtctgttagggtcccagcagtgacccaacatttcagcaaggaggtactcattgggaaaaatgacagaataatctcagtgtctgacaaaaactttcagatcttacctacattttgtcaatcaaattatgttcatagatttcatgataagagaacatcaagagtgattaaaacagtggtacctaatttaaataagcacttgatttatattattttatttaattgtcacaacacaccaaaagatgaatactactcttattcccactttacagatgtggaatctgaaggttagagagattgttacttaacaaggtcttttggctagtaagagatggagatggaatttgatcccaggttttctgacactagaacctacttttatataaaatactgatgtaaatcataacaatgtctaaatgggacaagcatatctttatccattattttgctagttttcccatctggactatctgtaaatatgtgtattaaataacatcaacaagaaatgaaagtgcctactgtaacaacttgttatacaaggttgcttaataacgttgtataacagtgtgatgtttattcattagttaggtgagatgtaagtagcctagcatgataccgtttgggtttcttcaagtagtttttggtggatgacagcatttctcaattagtttctcatacatattaatctcctgtatgtgtttccaccaatatatttccttaataccaagaaaagatattatttgtttccagaggactgctttgattctcttttctaaatactgaccccatctttgtttcccaggaaaagttttcaagacagatttcactttttatcttcagatgtttacctggatagtggtgatctgctatcatctattgctctgttgcctagattaaatatttaaatcctttattcttatcagcctttaaccaataacatttttagaaattatgagatgaattttatttagaaaggttcctttttaatgttttccctctaattgatttgtgagcagatccaagttgtcactcatgcatagccatgacgtgactttacaggcatgttataatattttttattacttacagaaattgtctcattatcatattgacactaccgataaaataataacaaattaacattcaaataccaatgtaagggtcttactgcaatgcaaaaactacggttaattacatcaaaaccctgacattcattcacaaaagacagaatggaacattcacaagagaaagaatagaaaaacatattgtatacacttattaactaagataatttctaacataaactaaaaaatgtccagtgccagaacattttataagttcaaaagaaagataattgagcctttcaaaatatcagattacaataagcagttttatgtttgtttaatattttcagctatgaagatcagtgttacctttcaattacatataatgaataataattccccaatttatgtgtaatctagattcatctttaatcttctaacaactaagtcctggttgttataactttacacctatgtttggaagaaaaagcaagaaaaagagaatagaaagtataaaaaggaatagaaggtaggaaaagtaagcaatgaaaaattaaaatgtagtctaatctctgacttcaaaaagaatttttcatgtcaccaattgtcttcagaattagacaggattatcataccttttagagccctgtctagaatagacagtcctgaattgggacttgctggatggaatcttgagcagatggtagcccaggacctatgcatccaggaaactgggtgtgaagccagaaaataaataacaaagacaatatttacttctctcatatctttgccttggaaaaaaaaatacttcccttgtccattaacatagccatcaacatcagtgatattggattaactatattttcagatggttataataacaatagcctagttgggctgacctttagtgcatatcactattgctctttctttaaagtagaaatattaaagtagaagactcagaaaaatacatgactaggggaaaataaagatgtgctggtgaaggactatatagaagtttttattttatttgtattccaggcctgttatataattatttgccaggcctgttatataattatgtaattgagtccccacaacaacctctgagacagatactaaaattatttccattttatggataaggcatcgaagcaaaatgagactgaatacatttcatagtatgaaataactagaaagtagcaatgctggaatttgtacccacattttcctgaattaaagtctgtgagattccctctgatgtgtgctgtaaaaaaacagcaatcagtaatcccctaaatatatagatagatggatggatggatggatggatggatggatggatggatgaggtatttaatagacaaatgtagaatcagtgaagaaattacatatataatcacacacatcataatcattacatttatatttttataggtctgattttttgactgtctttccttgtcttctaagtttgtttggaacatttaccattaatctgccctgaactttacacacactctgactgaatttgctcctgtcccagaagccatgctataaggatgaagctcacccagtagatctgctgatgaggcttccaatgagagaagcccatctcttccttccttaagaatgcttctgtctctgctgatgacagcccttacttagaggaagattttaaattaattggaccagttgaaattcccagaacaatcttaggctcctgtttccctaaattcactgtgaactctatattataaaatgtgacatgccctatttgaaaaagtttaacaatattattctctaaaaagtcttaaagataatatgtcaattaagccaataactttgactatgctaaaataatgtttctcaaatcctcttaaattacttcaaagaagaaaaaatttaccaattctcccttggattattttttttaacaacttttggttaaacatatacaaaaataaaattaacttgttcatgagttctaattccattatgggacataaacacacttataaattcattttctctgaaacaacaaaaccagtaaaattcaaactctctgctgcttcccatctacaataaatgatactgctttgctgaaactaaattatcactcacgattagtactggctgatacagtgcctttgtttaagttggacatttctatactgaactggagacaggtaatacttctattctccttttttctctgtttcaatgattttcaaagtctatttatacagtgtaccacaatgttatttgggctacacttgtatgaatacatcctttatgtattaaatccacctctccttttttattagctctcaacacttaaataattctccatggatatcaaaactgtatcctaagatacaatcccaaagaaaaatactgaaataatgtagagttgctcagttataatttgctcatataaccaatggatacttatttattttggattatcttcccaatctaaaaaaagaatacatataaaacactctcagaccctaaaaatatttatcagtaattaaacaagaatgcaggacccccatttaagaaatactgttttgatatatatatcaaatacttaataatagagtaaataagataattttaggttttaaggttactaaatgtagtaacaagcatgaattatttctgaatgtttgtaaatattatgaacaaaacctttcatattaattttctattctgtcaaaaaaaattctgttaagcatccaatctgagtaaagctcaataagagaagcttcaagagttgtgcattgcaacactattcacaatagcaaagacatagaatcaacctaaatgcccatcaatgatagattggataaagaaaatgtggtacatatacactgtggaatactatgcagccataataaagaacaagatcatgtattttgccagggcatggatggaaccattattcttagcaactaacacaggaacagaaaaccaaatattgcatgttctcaattataagtgggagctaaatgatgagaacacatggacacatcaacatcaaggggaacaacacacactggggcctattggaaggtggaggattggaagagggagaggatcaggaaaaataactaatgggcactaggcttaatacctgggtgataaaataatctgtacaacaagcccccatgacacaagtttatctctgtaacaaagctgcacatgtacccctgaacttaaaagttagaattgtgacaatgacagaagagagtccctgacttgggaaaccttatatagtgtgggagataagccatgtgaaccagcacaattccatgtgagatgtactaaatgccataggaagacactacagtttgcatacgtgctaatagagagatgcaggaatgatccagaagacacaaaggtcatatatatatatatatatatatatatatatatatatatatatatatatatatctcccaatttctgccatgattgttccacctctttattacactcaatttttccataaatcactggggtgctagaagaagctacctcactctactgatttttaaatattttaattgcattaaaaattaatatatgtaagcggcaattctcaaaacctaaaataattctttttgtaacattattaaacaatttagacgtctaagcatgatctttacagctaatttaattttctgtagccctttttgtatactctttcccatttaaaaaaacatcactttaggagcccagcctttcagagaatgttcagagaaaccccacccagcagcctggctttatgaaaacaaacagcctttccttctctactgccctcttcactgagtagcatagcagataatcctcctcataatgctttggtgactgttaatgttatttatttaactgctgtaactgtgaaaaattctattccaacactaaaacaaatatgctaataagatagtattatctcttagaaataaaatagtcatcttctaaaggtaaactatcacaatatctaacatggtctatgagatatataggtaggtaggcaggcagataggtaggtagatagatgatagattagatagatagatagatagacagacagacagacagacagacagacagacagacagatagatgttgctcaattgtggctcatcacttgttgcatagcttccagctataatcaggaatggaattacaatgatgtattttagatagacatatagctgagcaggtctgatagtgagtatgtttccttcattcataccactaaaagagttgatatatttctgttagtcattcactcacgactgttagaaagttttgtgattatgtgtttgttatttcttccattgttctgcttaggagaaagaatattataatagtcaggaatgctaaaaactagttatttggtatctcacagaccaatcattttaattttgagccctccttttaaaaaaaatgaaactaagatgatttgatgtcatatggctttaaagatctttaaaatatcaactctctagaaaaatactagttctttagaaagagaccatctgacatatcattgccatgtatttcattaaaacttcatctttccagattccttataatttatcttattttcactgatcctggataatgctatttaaccataaatagattttcagattttaaataatggtatttctgcaaatcaagcacacaagcttatataaattatatttttagaatagtataaggaaactataaaacaaatttaagttaaattcaaaatgaaccctctcttctatccttgaatttgttttactaggtataaagaaattaaattgtttctatttttgtaaacagcttttacaaaataaagtaccaattaccttcacattggaggttaggagttcaacatatgactttgggggcaggggatacaaacactcattctataacagagatgtcatagacttcagagttgaaaataaatttctgttgttgaagccaaaaaaatgttcaaatactatgtaagtattttttctcagttctgtgctcattttgcttgcttagcttagctcctagaataccaacttcttttcttcttcttttttgtatatatgtgtttatgttttctctgcaattaaaaaattatgttgtactttttagggggaagaaaatgaaattataatccactatactgtttggttacttttcctctttgctttctcagacttctcatcgttatattttattttgttactgtttattacagaggaggtgtctgcaaggatagttcaagtagtcactgctgaggctgtagcagtcctgaaaggtgaacaagagaaagaagctcaacataaagaccagactgcagctctgcctttaggtaaataagaagattctcaggtcagggactgtgtctgttgcaccctgatcacaggataaagtcttcatgttcaaaagataggccatatcttgtacttcatccttacatgtaacattcatcagacaccttgactgggtatgcactaggacctattttcatctttttccactggtttgttgtagtgtttgcatagtctttcgttagggtggtgagcttacagttagacttttccctaagtggcccttaattttttcattttccagaccactagaaatagttattattaaaataaagccaatgccttatttcatgacctccacccataaggataatatactaaaactttcataagagatgattatttccctttacaggttttggtgaatgattatactgtagccttgtttgggtcttcctgaaatgactacacaaaacctatagccagagctttgttataatcgtgagtgactttgtatcttatatgaagtactgaacttcacttggttcatctaagggcgctgagagagtgctgctctctcccttagtaacaagacaaatgccctccatgccaagcaagtcatttaacgcatgcttgccaaaggaaacactctcagccaaagccttgctgcccctactcatagatagatagatagatagatagatagatagatagatagataggcagatagatagatagagagatggatgtatataggcagatagatagatagagagatggatgtatatacacaaagagatacaggaaaggagactctcttaaattcaatatatatatttatttcacaggtatatacacgtgagtcatagaaaggtgtgtttttaaaggcctaaaaaagtacatatccatttccctctcttacagtctaatatatccatgatatttgattttttgatcagtattcctttaactgtctattaaaaagtaagtaataaaaataatctgccctcccagaataataatttagaatacactcagtattttcagtactgtgggtttttttaattattaaggactatttttctcttaaaacacatagagaattatctaatctaaaacattaaccttcagtttattgttcacttttattccttgaaagaaaagaaaactcaattttttaaaacttgaaatcttaaaatacgccatgcagaagcccatagggtaaggaactaaaaaagtcacctgtcatcccaaatctgcctctaataactactttatgaagctgaaattcccctaatatttaaaatagatttaaccactggccttaaatgagaaatatttccttttgaaatttcttactgtcatatgagggggatcacaaatcatgtaagtgtcttgaaaaataaaacttaacattaactgtaaatgaattacatcttttagaacctttttctctggttccttttcatgtgtattgattgctaagaccagaagtttactcagcatatggtttttgtctgaaagttcactcaggctatgaaagcttatttttccatttctgagaatacatacagaagatgggttttgaaattagactcagtgaacaaaaggttgtttaaaaaatatattccctaaaataactattagtgatcaagataacacatgtttccagattgagcagttgaacaatagagagttctaatagttttttcagtcagtagctgaatccagactaaaaacacctgcctgcctgtgtgtgttttcatatggtaaattagggccaaaatgaaatattttattaattgaacaggtagacacattaatgagattaatgatggaattttagcaggcatctctaatctgtttttctagagatgataaaatcatttttttttgaaaatatcaaatgcttgtcttattttttaggttttcaaaaatgcatgaatcaggtaatgggcctataaataaaccaaatgcggcttactattgaatctttttctgaattttatagagaggtctttttacaaatggcagaacttcctacacatctaccagcctaaaaggattaattattgcatctcatttttctattgtttgatctttagcagctgaagaaacagctaatctgcctccttctccacccccatcacctgcctcagaacagactgtcacagtggaggaaggtaaggcctattggacttttcagggtttgtcttctgttaaagtgtgaacaataaacttcaatcaataagctctggactttggtattggttagtatgtgaccaagctttggagctatctgtttcaaataatgaagaagaaacaaagactttaaataaataatcacttatttttataaaagcaaaagtagaggaatttggtaaataaaaaagaaatctgcttgattaaggaaaagaattttgtgttcagttgctaaaataactgtagagaccccattcactttagaatgctttaacagggaagatacaattctaccttgtaagtgactgaacaaaaattaaaataaatataaatgtaatctccataatagtaggggtcagatttatcaatgaaatcaacacttccttatgaaagtgtcaggaattatctctgttttgctcactgttatattgccaagaccttccccagggcctgactcatagcaaatttaataaatattaatgaataaatgaagaagttaatgaatgaatctgatattgagagcattgaactggaagctgagctcatgactctttcctgttgagacctgttattgtccatggatctttttatgaacttactcaacatggaatgtcatgttagcttttcaattctcattgatacaacagaaagatgcctttgaagaattttcattcagaatctgagatgaaaggcactacttaaaaggaaaccattactggttctccgacttagtccagttaacctttgtttattgtttgagagtcacaggaaaaggcagagaagaactagggctccattgttgtttcaacattacttagttttcatatattaaaaccagaattttaaaagtgtttattttattcatttattcatttatttttcctttttactgtgttaaagactgaagaacatttattttaaaagacttgtctttttatcatttgtaattaggttcatttaaaatattctttgatttcgtaaatacaaaaatttgaattagtgaaccatatattatcacctctaatataattttattttgtcacagatttataaacctaaatttattttagcaaggtttttctttcttaaattgaagctttttttttccaatttactgcctgaaataataaacaaactaaatttttctgaggaataaaagaaactttggggataataatcagtgcatagcagccactgattattagttaatgtgatttaatcttttaatttataggtttgaaaagttccttttgaccttatgtttatccattcactgggcacatatttattgagccctacagtcttccaggtactcttcaaattctgagtatatactagtgaacaaaacagacatgatccctgcttttaaagagtacactatagccggtaatcccagcactttgggaggccgaggcgggcagatcacttgaggtcaggagttcaagatcagcctggccaacatggtgaaaacccgtctctactaaaaatacaaaaattagccaggcatggtggcgtacgcctataatcccagctactcgggaggctgaggcaggagaatcacttgaacccagaaggcggaggttgcagcgagccaagatggcaccattacactgtagcctggtgacatagcgagactccatctcaaaataaataaataaatagtacactatctagtggagaacagaaatccaataaataagcttaccaataatttcaaattggattagcattgaagaggaaaagaatagggagctttaaaatattacaagagaaacctgattttattgggtggtgaggggatggctaagtagctgagaccagaagcatgaggaggaagtgttggccaaataaagatagaaaaaagcacaagggcgctcaggtgcccaagaagatgaagtgacccaggaactgaagggggtccgtggctgatgggtagtgagaaagggtagagcagtggagtgtgagagtaagcagtggtcagctggggtcagtggcctagatttcattctgaatgcagcgggaagcctgacatgacccttgtacctccttcaggccatggaaaatgtttctaagctcctacttaaagcttttcaagcatcagagaatcctcttaacccagagagggatatgatgttgacagagcaggtttactccaaaagtcggcttgaggtcaagtcatttaatcttcttactctatatgggatttggaacagaaagggaagaagcagagtcctcccatccatctgggaattcacccagcctgcttcctgtagggtaatatgatggatataatgaaaacataaataaataaaatgtagaatcaccttcacattttggtaacttaggtgtcaactttccagagttccctaatattttggaattactttcttcaagctgtttcaagatattcaaggaaaataccacctaacctcttattgaaagtaattcaaagttattttcaagccaaacttgtgtttttaactttttgagtattgaactatctgaagttctgattatttgattttaaaagtataaccattttttgagttttaagaaaaacagatgtatatattttataaactctatctctataaagaccagataatattctcaccttaaatatgtaaaagatttgtggtctagacaaactactgtttctcttttatgttaagccacacttaagtaatatacaagtattttttaagtttagttttgtcagaaaataaattagtgacaagtcacaagacaggattgaactgttcaatttttcaaaccaagtagtttgtaaatactcagcccaaattccatcaatatattgcttatagcaggtcaggtggaaagggagcaggtggatttttttgccttatctaggggattatttaccctccttgataccctcaaagcaactttaatctgagggtatagtgactgctgcagtctgatccttttatacaaatggaagaaagctcttttgttagattaattcagcgattttgaggatacattttctttttgttaattatcaaactttttaaagctgttctttcccaaaggggaagcatgaaagcttccactaaaaatttaagatgttaattactataatttatgaatatttattataattaatgtaatattagtaattcccaggatatgtgcttattctagaaaacatttacaagggattttgatgaaaaaaaaggaaacaagctgcacacttagaaaaggatctacggtacagtaaaccaaacctgtactgattatgatgttttcaaattaacctcctttttctttttggcctaatcataatagttgtcatttggactgagctattagaatttggaaggctgtgaaggaatggaataatctgaacacagaaccaggattctttctgcccttttaggtttgctccagaattctagggtggtgttttcctgtgtcatggatgtggtgacctaatcatcgcgcatctgaaagtagttttctctttatgtcattctggggcagcagtaacagtcagcagactgagaagtcctcagtcaaaagctggcagaatggaaagggcttggaaatggtggagaacaatgtaagtgcggccagcagccatcgaccatatgctgtgatgccacaacaagcaaaaagtaccgaatcactaacattccacaagatgcagtctccaaaggaggctggtatactaaggctgggttttacatggcaaaccttacattagcccagtgtaaattttcaaatgctttatttaaaagaaaaagtttcaatgaaagcaaactagggaaactttattcctccattgaaaccaggtaagctttatttttgaagattataattatgcagaaaactatgcaaaagtccaaggtgtataaggttaccctgtttttagcataacacgtgattaaatgaaatagaatattctgtggcaaaagcagagtccccagaagcatgcccacttctagtaaaaggatgcatgcattcaatcctgacctcaaacagcaaactaactgttgtgaaataaatttaatttttaatatatctctcaactccaactttgatgtgctaaatgaggggaaagaacagaggtacctgacaacttgtctgagtacactgaagacacagatgctaagatgtatggagtcagacattgtgcttggcattttcacagatatcttctcatttaatcctcccagcaacccacagagatagataatattcatttccactcctttgcccaaaatgttatggtttatgtctggagaagtggcttatccagaatgcaaatccaaatctaaattctgcaatcacggttgcactacatccctaaagctgtttcttatcaaggttcttactgtgagactatggaagtaaattatcttcaaatgagagttatttgttacaagctactatactaatttcctttaagaaaaaaaatcttacaaataaatattccatttattatttatttatttaaaattattatgtcttccatctgcattgggagtgatccagatgcacctgccatacacaacacaataagaaatgagaatctaatgtcttctgtcattatcattaaaatcaagtgccctgtttggcttagccctccctggtccccataaagcatagcttccctggcatatctctagagcttgtaacgtagatggactttaggctgataggtcttaaacagagacttggagtacagacagcttacagtaccaagagaagattggactttgccagacactctttttgaagttgccttggtcccaggccagatgaatactaaaaagaagctactttttccactagatctttcaaaatttgtgttgttctttttgttgtttcctgattagagtgaaagttttcagaatagaaaataccatttaccatttttttaaatgctatagatctgaagcaaggctctggactgtttttaaatgttggcactttcacaaagaacaatgacaacaagaaagaggtggccagaatctgcaaaaggttaaaacatccaatgagtattgcctttactctcagcttgaaattctttaattttatactatagtctgctgtacctcccagaaaataaatgttgaaaagcagagaggagcatatcccattttcatttattgatcatgaaagtaccctactgaacatatcaggaattttagaagtaacttgcatacatggggaatttacagccccagagatccactgagagaaatatgaatggctaggacatgtgacaagccagggctatgattcagtcagtgttgtaggccagatcttggacaattatctgctcagctgcgaaatcgtgccgagttgaactaagaatatcaaacgttattttaggcttctgctatcccatgatataaaaagcattgtggctgagaaagttctgagcatccatccagaaacatcttccatggaacaatcagtaaataatgtgcttgaaagattaaatgtattctctctacaaaatgttattttagtatcctcatgatttcagacttatttctagttgtcagcacttggttgccaaaaataagttactgtcctaaaaatacagtatatttgcaaattaatgctataattttgtcttcttaaaatctgatataaataaaaactgtacagatagatactatagattttgttcttattattgagagtcatgaaattttaaattgatatctcaatataagtaaataaatagtgattagcaaatttagcaaccaccacataggcctgagatgtaacgtctgcaccacatcagaagccaagtgctcactgagttatacgagaatccaaatgctaagcagactgatctacagttgtatatttaaggagatatgtttaaataatgcaaatttcctaggcaagatacaggaaagaacagaaatgagagtagttactttagcatttcaataagaaatatgcaataagaggtttgaaacatgaaaaacagccaagagccagtggtacaaatgaaactacatggaataaagtcttgatgaatctgcagccgactctgcagaaatttttagctaattgtatctctgctaagctttcagaaggaaaacaaaacataagaaaacaagtttataatattagaggctttcttaaaacagtatacttttagtgtcctgcaaatcagaacctggtttaaaatgatgcctctaggtactacattagccttagcatccaaagaaagagctatgctgactgcgcatttcttattaaggcaggaaagaggcataatgcattgtagatttttcttaacaggattgaaattaaaaatgactttctggttaaagttattaactagaattaaattaaccaaaacactacttgtgcatcctagataattaagactatgttttaaacaggactgttttcttcataatcttacaggcgttaaatcctaataactttcttctttttaaacttataaacatattgatctaagcatgagtagagttaaccttcatgaaataatttcctccaaagaatgcatttgttttgtaatgctttgtttctattccaacgttccttggttattctgacttgtttgagaggaatgtacagatgatttttattttgccgcagggctgtcaatgcttttggttcacttagatcaatggcaaacttgcttaagggataggtggaattcagcagttactgaggcatgaaacattcactgtctcccatcctccatcagcttgatcttgctaatttcccttcatcctgctgtgctgcttctgtggcccttcctgcccttgtgtaggtgtttgtttcgtccgtctgatcttgtgtctgtgttgtccagttctccctgcagtttcttcctgtgtgtctgtttgtagatgaaggggctgaggatcaagtgggtcctctacacaggttccccagccatgaacctgccaccagcggggagaggcgtggactcctagccccctccatctcagtgtctgtgcctgatgatgacccttacaattccgatgaggagtactatgagcatcctttgttcagctcagaacggaccacctctagtgtgctccccagtgtcacagcgcagagtgcagaggcccacttaggccaggagaaaggtgaaccaagcatggtccccttttgctcctccgccccggcctacagctttgaccacctacatcatgttaagtgtgccttaatacagggtgggaggggcaggagcctgttttctctgcatgaaagtgaagttcctatataagttgaatctatccaaatgccttaacaatttatataaaagaagccttactagaggcatgtgagcacttcctttttctgtatcattgcttctgagaaggaagaaaaagagagagagaaagagagagagaagcaaaaaaatattccattaaagtatggcttctttctgctccctgccaataatcagctggggaagaacatattctttacccaaaccaaagaagatgactctgaatataatttttttcctccttagacacataatattactattaaatagcatctttaaatagcatctttaaatagcattagctttctttttagtgctatattaatatgatagatctttaaaagagaaagaatgaagaatctgtttagagcagaataaatgttatggaaacaatttatttccccatatcatgtaatcatctacagaaactacagaggcttccccaggtgactaaatcttggctcacatcagtagagctggactaaaatgaaggaaatgattcaaagcctttgtcattctagccttataaagctgggagactcaagtgtataattggttatcgtgaggataaaataagtaggtgatgggctgcaatgtgtctcattctaactaggtagttttggtaaagaaaaaaaaggtacagctaaatatatttttgcttaggcgaagagtttatttccaaaagggacaatatttaatatgaaagcagatagttctaaagcaataaggaataagcttacagctcaccaactatggtcatcataataaacgtcttcaaggacccttttgaaaacagaacaccaatagctcaggttctctgataaagaaatataacccctattaagtgaaactaagttcttctaaactaaatttctaaaatatgtgagtttttaaattaggaacaattgtagtggaaataaatatgatttatactaaatgagaaaatgaaaagctaaaaagctacatggatttgaaaacatgtaaattaacttgattagactttatccaaaaaggtaacattataatgcagttatattaaaattcttttaactgtaatcaaaatctatggcattataaaaattttcttaaaataacaagttagaatttaaatttttaaaatgctacttaaaatgccataattaaattacaaaactaaaaatgagtgctaaatgtgaagagattgataatgtagatttttttttctctctctgtttctctctgaggatattaatatttctaaaaaacaaaataaaagaaaattccttttctttttatctgtagtctttccctcagggccgtttaaacaatgcacaattatttcataagaattttgtaagaatcttccatttacaaaactataaaacagctcatatatttctctctaattccttaagtgaccaaatggaatttacttatttttactgacatttcaagtgtaaatgagaaacaaattagtgcaataactcatgaacttgaaaagtttatctttacatcttaaatgttaacttttttatgtgatatacatggtttggggggtggttattttggccgtttgattgccactcaattatctttccttggtgattttgttttgaattacagaaataagactttattactaatgtgcatattttttctttagtgtcaaagagaattatacatgaactacattactgatatttcagggagtttaacaatatgataatagttgtgtcccagaggtagacttttgtaaacagatttaaatttaaccttgaccttgtttttaacacattttattttacttactttttgaaaatgttcattttctccaacatcatacaatgcaatgaagctaacataacttgacttaggtagtcccttaccttggaaatgctaaataaattatattttaagtaaatttggtggactttgtgataaagctgttaaggtagttggttggatattcttttgaagcaaggctttttttattcccaaagatttctttagcaaaatttgcacattttaaataaagcagccgggaattcttatgtaggggcttcctgcattggcgaaaacagcacatgtctaacaaatttaaaggcttttttttttcagtacatcagtacatccatcttttcacaaccatctgttatccggcagtaccatctcttatttccagcaagctttccacatgcgtgcaacttactgccgtttccaataagggtaatcaatcaatacaaccctttcagctctcaaactttaaaataaattgccttttaatgagactttaaaagtcatcactattagcagattatacatcatagttttccaaccagtacctaatgtatgttgcattagaatattaatttgttcatcccaatggtaaaataaaaaaacagctgaggtcttcatgaggtcattctaatggagctgaaagtgttcctttagcaatatttctgtcgtttcatgtattgttctgtggtcatgatgtcaacatctttttcatccctaagaagaagaaacgctagagagtcggatggctgaggaagagaaacctgctgctcttcctgagaaagagtgtggggctgctaagtcctcagaccaacccaagggcctcagtaagggccaaatggagtctagtgcggaggcccaaatagttcccgaagagagtgccccagcaggggccccacatgagaaaagtgtaaaagaggtcaaggaggtgtctccagaagtaaaaaccccttcctctgctggggaaggtgtgtctttctcaggatttgcatgtgttttgttgcaaatgatctctccagtggcttaccaacctgatgcctttccaacgctatttcgctatttcatcgctgggtcttatgataacaagtccactgttgtaggcttaatgtgcagagagtgtggcttgcgcaagtgctgtgtggcagctggttttccagtgctgcagctgattcctggttttcctttgccatgatacaatacgctttgcagccaggctgatgatgctatgtgagcttctttttttattttatttttttacccgccccccctcatctcaaatgtttgccagtcacattgctaatacatgtatatttttgtttttattttggggacagcaattcatatgcttttatttcaaatcgtacagttggattttggcacatagaggcttaaatggtggaatcgtttttgtttgcaaccgaaatgtgctatattttttatgcttcaatgaatactggtttgattttcttgacctcctgctgatgcttctcatatcattttctccccatggcagccagcccttctgatcatccccatatctcttgagttttcattcatctaacctttattagaagttcatcaagtatttttttttctattgttacaacaggacacataagtatataaggtaatgatgatccatacacttgctcttttagagatgattgaattttattatttttccccaaatcttttccagataactacatttagctctaatgaccacagtgaactactttgaccttaaaacacaagtgggacaataaagccttttggattgttgaataaataaaagtaaaaatgtgttatctaatttctgtgaagcacctctaaagccaatactggccaatgcttcaccagttagtcatgctccaaggattgaggtcatgaccatgggaataaagttatttcaatagttgactcttttgaaaagtttgttactcacatgacttcccagtatcaacagtgtaattcagattttcttatatctaccgtacagactaagtaatgattaggaatttaaatttttaaatatgtaatagaaactggcttgtaaattcttaagtcatatcatataaaattgatagcaaatatttacttatatttctgaaatttatcctcagatgaattctaaaaatttatgccagtaacctgtggatgcctaaagaattggccctgacatttgttaatcaagttaactgcaactattaacattatatcattgtgcattacttggccctctgcccatagcctaccaattcatttttaaatgataaaaccaatgaaaatgttcagtataaatcaattctttatctatatttagtccttactatatattcttttgtaccctaacattagctgcttactcaatattcattagcttataacttttatgtatagaaggcacatgaatttgtttcttctgtaatacacatcacataatgtttaggagagaccaaaaaaaaaaaaaacaaagaaaaaaagagaaaagaatatccagaaatatactgttcttacaattcctttgcacattaatttacaaccagagttcattttagtaatagtacacatatatctcagtcctgaccttttcatattgacttttacatgggtagcatgcttgcatgttccataatttttgtttttattctaccattcatttatcacttcaaaatataattttaagcttatttcctgaacgcacttgcctattatttgtttaaaaatcaacccgattacttcagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacggaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagtgccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaagagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaaggtgtgcattattattattattattttaactcaaacacaataaccttatgggaattttttttcacttaaacattttaaaatacctctttatctctttattttgtattttgttaaatatacaaaggattttgtacacttgttactaatgttttcactgttgttgttgttgtcatgatttgctttgatccacagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaaggttcatttaacaatcacttctttaaaaatgtttttgaagtaattcattattacttttttgcagaactgcctaacagtggtaactaattatttataaaatttcgttcggttttgctccacgtgtttattttttcctgatggtatgctttttgtgttttcttattcatagcagtttataagaaggctgaacttgctaaaaaaacagaagttcaggcccactctccctccaggaaattcattttaaaacctgctatcaaatatactagaccaactcatctctcctgtgttaagcggaaaaccacaggtgactgttcaattctgcaatgtgactggcaaacatagacatgtattttttttttaaatctcattactgtagcagcttcttcattttgtttttcttccaagaatctcagcagtcatgaacaattttgctattaagtgtcttgtatcattattcttttttcccccctccttacagaaaaggtcatgaccatctgtttctttgtcatgctcagacataacagtgcgtgattgtatcttggcattgtgctctagtgtcacgttctggggattcctattttcattctgtgtgtttggttagacgatggcgatgaatttaactgtggtatgcattctcattattttgcttatttatctctctcatgcttaaacccataaatatttgtcctattttctacattgttactgccaaatctgttactgatgttgatgaatttattgaaaaccaccaagaatgtgtagtgatttagatactgaaaatgaaaagcaagccaggaagtgaaattgtggtttgcaaaattactattactttgcttttgctgaaaaaaagaagatagaaaacaaaattttctggtaattatatcagattttattcctcatatccaaaattaacaagattttcactctactgaactacatctcttagctgacattttgtcatggagatttcttaaatatgttggatccaaactgctcgacttttctatataatttagtttcacaaatttgaagctaaaactcttccttttaggaggaacttcagttagaaataaacttcggtttatttttactttgctgtctactttttttttgtttcccaagacggaatctcgctctgtcgcccaggctggagtgcagtggcacgacctcggctcactgaaacctccacctcctgggttcaagcagttcttctgcctcagcctccggagtagctgggattacaggcgtgcacccagctaatttttttttttttgtatttttagtagagacggggtttcaccatcttggccaggctggttttgaactcctgacctcgtgatccacctgcctcagcctcccaaagtgctgggattacaggcatgagccactgcacccggcctgctatctacttattactcttcttcaaatacatattttttcctaagtttataaaactggtaaaacaaaggaatgaaacttgttggaaaccatcataaaaacccctacaaatatctgtaatgccaacttttttctaaatttcagggcaaagtatttattttatatgtttaattatactaggataatcttaccttacactatattttattttagcatttattaagtggcatgcttgtagtctacaaaatgacagattgctaaatcagaaaagaatgtttttctttccattgtacatcatcaatgcctctatataaatcttcggatggttttaaaggttaagaggaacattagcctttgtgagaaagagaaaatcaaggtaactgatggttttattttagccattgaaaattccaagtattttgtatttgtgttcttcatctagaaatcatatcatgtgctttccttcaaaaacaagaatctaaggcaggatttgaaaatagaaggcttgtatatacgcacaccttgataaagcttcaggatgaagaatatatctgaagctaggagttaggaattaacgtgacatacctcaattcattttctcaggtttttagcttcattaaacttagaacttcattaaacttaatagcaaattaatagcttcattaaacttagtagcaaaattgcttgggcaagcagaatctcttgatttagcataaaaactctataacctacctaaaaggatgaaagatgtcatcaggattgtggaattttagagaaaacgtaaaatggtttagtaaagtgtttacatgtcattggtattcaatttgccacatttaaagtaaattgtgtttttattcattctttgaaagaaatttaaaatctttgaactaatgaagattttcctttattctggtctaatgttaagatactttaggagaaagcatgtatcagatgtaggtgtcattggtttgaagcaagctatacatgtcacaagaatttgagttatattacagagatagtagtaaggcatcgttttcactgcttccttaaaaacaatgagtcctagaatctgaaaaatctcactagctagtcctacatggcataaagcatattgtagacagttattatgtttgtgtcagaactgtacctgtcataaaaatacctttttagaacttattcagagggcttataaggatacattttttttctgagggtttctattttatgaatgaaaattaaggaggaataaacacacaagcttgattattttatcttctaagcccaattttcaaacatagatggttttccaaaccacaaaggattgttttaaatcatgagagctaagctacctcaggtaagtcatcaaccaaaatgtgctagagataatggagtttaaaattgaatccagaagcataaaacagcagcaagagaaacaacagtaacagatgtggtaataatttcatacaggaagtgcatgtgtagaacatgttctgtatttactgaacttaaattttctctcgtgttttctgttcttgacaagctatttttcttcccttctcatgtggcattttcacatcaaacaagtatgtcattcatattgtgaaatgaagggatacaaagggaaaggggttagctgatcatgacagtttgaaatgtaaaataccgaaatatctatggttatgccagtggcttccagaacaagaagagggtttggaaatctctatgaaccctcttctatatatcatgtgaaccccagaaaccaatcagtgttctttttcttaaattttgcaacattcacattgctattctgtaacttctgttctaaaggatctccttacgtactagtgattcaaagatacattggtaatcaatagaaaaattacgtggtgtgcttacctgcactttggtagacaatgggttatattaattagcacacactatttgttggagccacatgctatgttattgttattcatgttacttgagttattgaatttgagtctcataataagcaaacttttgctttgcattagtctgttgacacaacagaatatcctacaggtatttaaaactgcatttatgactttttagcaactaagtttggggttgtttgtcttttattttcaacagcagcaggtggggaatcagctctggctcccagtgtatttaaacaggcaaaggacaaagtctctgtgagtaaaataagtttttccttgttcttcatttgaagttcctttggtattagctgtaacatcagaataacttttgatattgtttagatatttactcttaaaagtcactttaaatagttcgctcacccagaagattctccgtggcatccaggcatggaaggatgaacgtcttctgggatggcgtatgatggtaattggtgagggcacagctggactgcttccttactagtaagacaaaaacatagaaagcagcacaatgatatggcaaaagtaaggaagtccagtttagttacttttcatagaatcaaattaaaccatataatcaacagtaactgtattttataatacactttcattgtttttgttacaaaatagaaatatgaccaaatgaagcactgcacacaagcagaaagaagtagaaatcaattataatcctcttatcataaagataaacacagctatcattttgatgtaaaatcctaatttttttctatacatttataggcttaacaacaaaaatgagaacactgtgtatcactttttaaattcaacagtaaatgtacttccatgtcgttgaacattttgtaagttttaatgactacgtaatactgcattttatttctttgcaatgatatacttaatcaatttcctattatttgacttttagaattttttgttggtattttaacaatattactgtagagaactttttggctaagttcagtttgtatgctatttccttcattttctactagtgaaattattgtttcaagaaaaatgttaatatttaaagtttttgctgcatattgtcaaattgccctctggaaaggttctacccacttatacattctgtataaggagagtgttcatatttgttattattactacatattttatattgttgttgtatatttgccaaattatagagatggcatatattattattttaaaattttattttggttgtattaatggtgtttaacttcttcatatgtttgtaaatcttttctattttttctgtgaattttatttttatattattaactgtattttaatgaccaaagccaacatgaagtattttcactcctttatgattgaaagaaaaaaattaaaaggctactaatgaaatcctaaaattataacaaataatttgaatgatattaattagtagcttataacaacattctgagactgagcaaacacatgtaatatgtaaatcacaattcttagcttacccttctaaaaaaccaataagattttagacttccacttttatttattatgaaaagtagtgagtgattcatttctttgatcttgaacctgaggggttttatgttgataaaagatgatacttgatttttatacaaatgtttcagatatattcctgaacatatggcaagcaacagaattcatttattgctttggtgaatattaggctttattataaacacattgtgatttcaagatttgtatctctttaccttctgtttccaaattaatgatgtatggtggttggccgtagggctatgaaacaaatcatgttcaaatcttgaacatctattagttatatgatccttttcttcctatttcttaattttctaaaaataaaggggaggacaaaattcctgtctcatgagttagttataaaaattaaatgtaatgatgttataaaacagtatgcagtataatgtttagaacatagcattcatttaataaatggtaatagttgttagttattattttagttaactgaatggtggaagttttcaggagcagatatagaaaataagtctgacctttcctcctttaggttgacattatttggaacatttttaggaaatttttaagccccttggtctttgagtaactcgatagaatcagcacttggaacagaaccataggcatcgtctgacacaaaacaaccttttttccttgtaaatgcccgtcttgtctttctgaagcaaaattagcccttcattctttctttttttctcatttattagtctttttttcttcctaatcccatatccttgttctataagttttctaaaaccccgagtaacttttatttgatttagctctaatgttcagtatatccatcagtactgttctctgattttttttggtagttgtatgctctttcagattcactttttttaacttaaaaattttttttctatgggtacatattagttgtatatatttatgggatgcctgtgatgattttttaaattgctctttattaggaaacagacccacccataatcctgcatttcacgtgggtttttctgttgtttgtttgtttagcattaatagttgtctttcttaactacaagcaatccaatttatttttctcttctatatcacgcttttgaaattcactcttttgtgggtaggatcaataaaaaaagaatgacttgtgctgacccaattacacttcccactcaagatactgggtctataaaacaagaagtgatttgtacagtctgtaaatacttatgtcctgttgtagccacagaggttaaaacttgagataaaaatctcagttttatctgtcatttctgtaacagttaaatcaaattaattatttgaagataataatctccttggctttgtcatacttatctatatttttaacagtcacccatgagacatatggcacgctggcatagctttctccaaaagccatacatccttcccaattatacttgcagacagtctccccaggagttatcaacacctgtaaattaagtcgtgatttttattggccatcttttcagtcctgactttcctttttagaattcataacacatcatgcagactctagtctttgcataaaaatgttattagttctatggtataacttaatccacagtatgtgtttcacttataaaatgaacaaattatatataaactctgaaaaattctgttgaagtcaatgtagatgacgtgaaaataaattttctcaatctttaaaaatacttttttcattattaggcttcaaatataccttgttccaaagttcttgaaacatgattaagatatggattatatgtacaccttaaaggctgtgtttattaaaggaataattccagcagataggatattgaaagatatttccaaatgtgttatcattataaaacttatgaattaattagagactatatacgtagaatccaaaaagaatattttatatacattatccttaaattagagaactatgtatagaatcattttttaaacaacaaaatttaagcactcagcattattttttaaacctgcaaaaagagagttttgctagtcacttgtaacattctttctatattaaggcttattgtatttttaaagagaaagagagacttgctttggtctcaggatttcacaaagctaattccttcatatctaagcaatattactctttcttctgtccttctatctatccacccactcatcatttattcagcaattatccgctggttctctactgcgtaccaaacataaacaatcacatttggaagtaaagaagagcaagtaataagtaataaacatggatacctgttctagacctggttaatagaaaataaaatggtttagcattatttttgtgttttatttgtataacagattttttattttatttttaatcagggtgtccatgtgcaggcttgttacaagggtatattacgtgatgctgaggtttgagcttatattgattccatcatccaaatagtgaacatagttcccaataggaacttcccaataggaagtttttcaatccttcccccacttttggagtcaccagtgtctattgttgccatctttatgtccgtgtgtacccattgtttagctcccacttataaatgagaacatgtgatatttggttttcttagacatttttctatgactattattaagttagttttggctaaaaagaactgtgaaaatctcttctcatctaagtacacatctctatcattgattataaccatttatcatgtgttcttattaaaaagactttgagtttcttatatgtttatacttcttttttatcttccttttactttatagtttggtttattttgtgcttttgtttgttttctttcatggctagaattctaccttgtcaaagattcctgctttacagggtagcacaaagtccccaagatacagctcagcctgccctagcacgactaaaagggctacattttctgacagtttattaatacagcccacctcagcaggctccacagaccgtttgccatactcaaaatcagggaacaaggtaaggcggcaggtcaataaaaggtgcagaaagaaatagaatttgggagaaggttatgttatagaacctaattcaggaaatgtatgaaagcaaatactttactctgaagtgtttgacacataaacagtaggcccttttaaaaacaaatacaaatttaaaattttgataaacagtatacctattttttaaatgtagaaaatatgtctttttctagatatgctacccattattaatttatggtttgattatctggtaaaatatcaaatgcaaactaacaaaacaaaatatattctattatatataatatataagaaataatattgtacagtacaataataacaaattacattgtatagaatataatagataatttaaactaaacgtcatatacatcagggtttaatactatctctgacacctaccaactcaattgtcttgaaacaattatataaactcattaaacttgtttcttcagctttaaaatgtgtatcatgttttgtggtgagaatcaaatcataaaaggatataaactataaagggttcctgtcacatacacgcacaagatatggtaatggtcattgttagaaatattatgcatgcagtgagctactctcagtcctttctgattaataaattatcatgctaatgaagatttttcaataaaattagtaatttgctgaagattgagtacatttattttaccaatattatcatttagaacttgaacttcacactcagttattagaactccaaaataatgtatttttacaaaacatctaggcaaatatgcactctttctaagttataaagtagaaatgtttataaatatatgaaatccagtagtttgtattaaaagaaattcatttattagcacaggaggaaaatagcaaaatcaatatcacttcgtataaattaaagagttacaagaacccaatgttctttttgttttctccaatcaggacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccagtaggtttattttgatttgaattcctttttaagcactttttaaatcctttaagtggaatagcacttatatttatattttaatttgtaaaaataaaacatgcattaagactagattatatttgccataaggatcagaaaatccagaatgtagatggctgcaaaatagctgtttgagtaaaaacaactgatggaggaaatggtaacatattaccctattatctaagactgatataaagttatttctctaagaatatatttttctttttgcttcaaatttagagcagaaaagaaaattctaaagaagtaatcaatgtagaaaccaagtcaaggattttaaaaacatacatctataaaagcttaacacttattagatttccaagttgtaaaatctaactagaaagtcgacattcaaaacttaggatcctgttcaacttcttaagaatttgcattccaaatgagctataaatatagcatagtctatgcaataggttcaaattatcttgattgatggcccattcatgaactgattggcaattgtaacagtttatataatgctccaaacattacacacttatatgttgcattgtggcaaactatctagtaaagcatggattcaaattacttccgtaaatatttttctgttgcaaccaaaatagctaccgtttattgagcacatatagatactaaactcttaagatacattttttcactaatttaattagcaagactaatgactattataataattaataaactcaattcattctactgatgagaaaactgaccctctagagagggtaacttgtccagttaccctctagagagggtaactgcttcacagttcgcaagtggttgaatttggttttcagcctactgataacttcacaacctgaagtcttaatgtcttttctacatttattgggaggaaatagtactagagaactgctctgtagaattatttggagaagagtatctgtgtcatttaagaaccattttaaaatggtggaaattgctaccactatcacattatagttgacttcaacacttattttgataataattggcccacttaaatatgactattggcatttaaacagtgtttttgcctacaagaaaagtgtttattataataacagtaattgtgtccaacattatttagtttcctagagtattagcatcctttgaaatatgtgttaagaacactgaaatcacaaaaactcttttatcatagcaaaaataaattatttgaatgaattagcaggaaggtcatttaagatttagtactctccagggaagagactttaaatctctagagttgaaattgaacataattaataaccccaaggatgtatgagacaagacaaagataccaagtactctcgaaaggaacatcttgaattatacttgtatttgttgctataaaagcaaaatggcactttctccataaatccacttcttcaaaccactgtgttctgccttttaaagtgtatctatatatgaattgattcattaaatgttcagcaccaattctattttgactttttaaatttactgatgtttacaagcattttgcattgtattatttgatagtgaacataactaacacattgataattttaaaacataggatctgttttacctctgcataccaatagctgaaaggcataaagacgattggaaaagcaagcactctgcccacttctacttgtgcaccatccccttaatggtacacagggatgttctaacattttgtgcagctattgaaaagatttgaaggaaacaatgttgtgcaggaagctcatccgcccaagaggaaggaaatccattgtcattgaggagttgacaagataaataaaagcacagtttaatcaattaacttgtaaagaaatatcttaaaagttgttttagatcttaggcttaacctcttcaagttcagaacaaataagaaacattcaaatttattgttttgatgacaagaacatatttattacaataaaaattggtcatatatattgaacagcagtgtgaaggccttaatatttgtagtttatcttctttctccagatgtaacataaaaccttcttttataaagcttaacgtgttttctacaagtatggaaatgactccttagaagtttagaaaaaattatttcatatagtaaaaattgttattcacatccagaatattgcttcaattcagtctccatgaagtcaaaaaacccctcagcacactttgatgaattctgaattattaaaaaaatatgttgtctacctactgttttcagctcacatgaaagtcaccagggctaggtacaatggcaaaaaatacagggatgatccctctccccagaatatctgagctattcaaaactggtgaagtaatagagaaaacattcaagaaagaaataatgtttctggagaaagtattcagacagacatagagacagacatctacgttacaaacttagtccataacaaaccaggacatggaagttacaaaatgccaagttggatgtggttgtgtcatcctagtcttgaaattcttgtgaaaagcaataaaaatcacagaacacatgctaatttctcactttagacttctcatatcccatttcatattatcaattgaagagtctaactatcttgtgccctgtgttagaagaccaaaaagacacagggcactttcatttgatacttgaaaactgttcactgaaagaagtaaaattcttctgtgtttctccaggagatagaacctatggtgatgggtggatttacattttccatagattacaattgtccaagaagctctcctgagctcacatcttgtaaatatttaagcaaagattacatgtccacttctcagaaagaacttcctatatttatgatcaattgcattaggtgacctctgagattcctttcacttcagtggctttaaaattgttatatatttattctctacaaaatttcagaagattcattgatttttttacttaagcagcagtaaaaaatgaaaattatcccttttctataaaatatgttataaatgaaatttgcatgcttaaaaatgtaaatcctcaggggctaaatattgtatctggcttagacgttagtagcatctgggtgaatgagcctcaatgttctcatttcttaggaataataagagctgcccctaacaactgtattgtgcatgtttgtttggttatcagttggttggtattcacataagtgctttgaaatttataaggtgttgcattcttatttctatcattctttcaggaaagtatttgaaatgtcattcaaagcacattcaaaagatgaaagaaacatagtataggaaagtggggggtgggaataataataatatgaggctgagctcaacttgaggcaaagaaatgcatctcagatcctgtataattaatgtggttttggatttaactctaaactgccaagctagtgatgaaaacagaggagaaaacacaatcaggtacgaggctcactgggaatatattgttgagacatcccaagtttctaaggcaagaaacagactttttttttggtttgaagcactgagataattttccttatgaaaagaatacatgatatagtatagcagtgtctgacagcttccataaacacatttacacctcatagtgttcctcagtataaggatataatattgaaatgcagatctttctatacaggccaaaactatgtgtcctaaatacatggttctatattgtatgttcacctggatcccagaatgaatttactacatagaggaatgaatgatctacatatcattcaaggaatcttcagtaaatatgggtctgcatacgacactaagtgtaaactctttccaactaaaggcagatccatttgccttaatagtcacacaagtagaaaatagtttttgacacattcataatgaaaattacggagaacaaatcagaaaaaaaaaatcaggtttttttctttgtgttgatagcaatgcatgttcaaaagaatgccaccgggttatgcacctgatttcagaaacgagactctcagcttcttgagtactatagtgataactgtttctaaataccttagaaattaaacgtattatgacttctaacaatctatgggaagagggatgttttgaggagaattgtctgactctggtttggttttggtcttgcttgttaatacagggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtaagaattgcatgaacacatatttgctgccagaaataattattacattgccttcttcatattgaaaactaacagttcttaaaagggaagcagaggtgttaaagagcttggttacaatttattgctaagagtttggactttacattaggaagatagcctctgaaatacaacgaaaatcacatgacatgcccattccttctgtttgttactgggtaaaaatttttaccaacttttagttgattgactaactttttttttttctgaatgtatctctattgctttgtgttttttaacttgagattaaagttatatttctgatataaaattgagttttctattttagtttctgaccatgagctcatttggctatcttttagtgattccaattttatctcctttcttccccaaggatttcctatgacattttctaccatttcctcatgtttactccaaaataaggatgtttcaccgagtttcaattctggctactattgcctaaatgttgcaaaggggaggtattcgtgttgataataaaagacacatggttctgatgaataaaattgtagactttgaacttctattcaagattaattgtattaaatagagctattagtaaagcttacttactaactcttaacttcagctccccagagcaaacattcatatcttttcaaaccagggggttttgagttctgtcttgacctgaaccttgcttatacactacatgtttggacaaagcaattagcctggaaggaaataatacaaatattatttaatgtttatctcataatattgatctattcaggatagtttaacttttgtcattgaagagatataaaacaacatccttttttgaaagaaagaaggacaaaaacagtaactttgtacataaacgaacttataatgccctttcagtattccaagaaagtctttcctttttaacgtcaatatttttttctgccactctttttcttgtctcttgtattttgtgccactgctttctggtatctctccttcatgccaaagaaaatctattttcaggaagaaagatcttgccaaaatgtaaagctatcaggcactcctactcaccaatgaagcaacaattcagtgttgctctttcatttagcaacaaacttctttgctgtctctttatggctctgtaagggaaagcccaaagagttaagaaaaatcaaccaatggggcaggaggggagaggtcaatatgcccttttagaacaatgataacattctataataatagagtcatagaaagatactttttcacagacagatgctatgaaaactagaagctacaagaaacatttttaagcaaaaagtagaattataagcctataattcctaaaaaactcaaactattcttgcgttcatcagagttttgcacatgcaagagaaggaaatattttgagctttttggaaatattcaaatgttgcatcatctttatatttatacataaataatttaaaagtgtaaggtgaataaaatcaatttagtaccatttggaaagttctgcattttagccttggacaagctatcctctaaaatagaataactattatgtatatttaaaaatcagttcttttaaaataaatattcccatgtcctgttattctcctcaactagatatggggtttacttaattatattctggaaaacattaatacttaaaataatttgtttcctcttagaatcacaagaaaatacaaattatctccaagatattgtattaaaactaacaaaagtaattaaaagagaaaagtattattttaagttgacatagaaattttataatatatgattttctttgaaggactccttaagaaaggcaaaaagaatggttttagccccagctttgcaggaacctctaagattcaatcaacccaaaaaatgtgaagacgtctgttttctttttctgattctttatcatatctggtttggagtatttttatgtcttattgtaattgacttctatatttggtaattcataaaattgatacaaaatatctcatacttttgagctgaactaaaacttccttagagattatggtggttaaggactagtaaatacatatgacacaaaaattacagaaagaacaaaaatagcttcaaaatcacagtgtcatttgaagcaaatatgtttttatcatcaggcaagtgttaacctgctacaaaattatcctacttcagcaatgatgactttggaaaaaatccacaacagtggagttatgaggtaacttttttgcagaagtaggaggtatttcctcaccaagataaacagatgaaagatatttgccttctattttgtgatagatggtataaattcacttaaagggtaaaatgaattgggaaataatagcgcattgcaattgaactgtctttgtaggaaaaacatatcattcaacacttcagcactctccccttaaaagcctccttacagtgtgtgatctcagatatagggagtgaggagaggttttttccatacttgtaaaactgaagatcttatagaacgactgaaggaaaagtattttagggcttcttagaaattatcaaaatgacatgttaaagacctttattagatgatcgagcatctatacatgcataccgttgaagaaattgaagccactagcacattgttctcaattgtaaattgattttcctaaggcacttgaatggattggccaacgcagaaacatttaaaaagacagaacaagagctatactttcttcacgggccaggttttgtaatagtgatatatggtctctaggaattgagaaaaatattcatgtaattcttattaaagaagatgggagtaaaattaaagatgtaactttaattcctctgcacagggtctattgtggtaaaatttgaagcaattaggttgtatacaaatgatttaattgtgaaaacttcattattggggttttaaaatttgtgcaatctctaaaaattggtagaggaaatctataataaagatatatgcatcttaggaactcaacagctttccaaattatttgcctgcagtttgaacattaattgctcttctgtatgtacaggttttgtgcttaacagcagctatctcttctgttaaggtccaatttctgttggcagaggggctcagctcagtgagtcacatcaatgcctaatggaatagataagctagctgaagatacaaggagctttacagaaggcaataaagctaatcttttcagctaaaacaaattcattctattggaaagaatatgggcaatcatagattcagtgtagataattagcttgattgatttaactcaaggcatagggaagactatcttattaagtgtattaatttgaaactgctctatgtagctagcctctcaatctacattaaatctaagttttagaataaataatgttagcttttgaagaacacagctgcttcagttaaacaaaggtagagaaacaagcaatttctctaaacacgtagcataaaaaaatttaggtaacaactcaaggaatagtgctttttgccttttctatctaataatcaggttttaaaatagttacttggatttatatggaatgctcctatatgttttgacagatatcttgtttttctccattggctttatgaagatgagtataaaaagcacaagttggccaggtgtggtggctcatgcctgtaatcccagcactttgggaggccaaggcagcgggtggatcacctgaggtcaggagttcgagaccagcctggccaacatggtgaaaccccgtccctactaaaagtacaaaaaaaaaagaaaatagccaggcgtggtggtgggcaccagtaatcccagctacttgggaggctgaggcaggagaattgcttgaacccaggaggcagaggttgcagtgagccaagaccacgccattgcactccaacctgggcaacaagaatgaaactctgtctcaataaataaataaataaataaaattttaaaagcacaagttatatgcgcttgtaataattgaaagttactaaagaagtggtttcacagatgttgttttcattaactgctcattggataggatagtcagttagagcataatctctgcaaggccatgtctgtggatctgattgattgcctctgaattatgtgcttttgctccattaatgactacagtcagtcattttcaggttagctaggctacagatggtggcatcatcatgcaagtcactcctttttgaagaaaaaacagtactcactttttaaataaagaactttgtaaaatttgtcagcatattgctttcccaatcagcattggtctgtcatctttgtaaaatttttatttagataaatctattaaactagaacctgtaaaacatatcattacattctagaaataaagcaatcttagtttctatatctcagttctatatggatctattaaactaaaggatattagatgtcagagatatccatctccttctaatccaaccctcacattttcacagagtaagaaacagaagttctcacattacctgcatcttgcatataggacattaaatatcatccttccatggctgagctgtgaagtcagagtctatactttgtctttaatgaataattagtcacttatctgcaagtatgtaattttgtataccttagtcttctttgtttgccttacctttcatttcataacatgaaaataaatggtaattttatttagcagtgttttccatgccaaagttttttttaccacgtcaggattgaaatttgaagcttctaaacttttattatattttcatgaaataatttaatgcaaatagcatgttatattgatacactattaaaatacatgttatattaatatactacattaaatttggaaaggtatgttgcattttatcatattttttgttttctcctataattgacagttattttttaaataattctaaaaattaaggttttaaaatagaagctagttagctttttaatttctaaggataatataaagaatcaattatgaaatattatagcatcaatcttggcatcttaaaaataacatggggagttgtctcctattactttgataattccagaaatacaaagttttacctttctttacttgaccattgagtcaacaaatatttattgagcacctactacaccatgctatgttctacatactgaaatataacaacaaacaaaatagacatagatttcttaaattcttgccatcatggaatttacattctaggaggaaaggtgagcaaaaaaaaaagtgatataagaaaaatatgtaaaaaagtgctaagtatggagaaaaataaagataagaaagaggctcaggatatgttaagaggaaattgcatttctgataagatggctaggaaagtcccgagaaggtgatatttgaatagaagctccaaggaagtaaagaagtaagccatttggataactaggtaatgagcctttcaggcaaagggaaccacacatccaaagaccctgaggtagaagcaggcctaacatgttctaggaacagcaagtacatcagtgtgactgatgccacatacatctttgagtatagaaagtttatgctattattacattattatttttagtattattacatctattcaaataacaggactttcatattgctaaaccaaaaatctaagtgttgacttttcctctcactttctctcatcccatatcctaaccatctgattttgtgccctgaatagctcttaaatctggccatttcactcagtctgctctgcactaccttagcgcaggatacatgatctcttgctgatattgtcgcaattgttattaatttttggtttccctacatctgttgtttgctctatctgatgtactctctatactgtaaccaaactttctcaccacatttttcattaaatattccattatataattagtaatttaatgtctatcttgtttcacttactagaccataaggtccataaagtcagagatgaggtgcattttgtccataatgtcccatacatagtaggtgctcaataaatatgcagtgaaaattgaatgaatgtattatgccatattcatggagagatgcattcttttagtgacaccgttgaatgattatgaatgttttatgtcatgacagttattatccaaagaaactttccatgtttgtctaaaacaagcttgtccaacccatggcccttggggccacatgtggtgcaggatgactttgaatgtggcccaacacaaattcataaactttttaaaaacattttgagattttttgtgattttttttagctcatcagctatgattagttttagtgtattttatgtgtggctcaagaccattctttttcttccaatgtggcccagggaagccaaaagattggacaccctgatctaaaagaatattgaactaggatttaagagctgagttagtggtccagctcttctattaaagtattgcattaccttaggtactgattttttttttgtccttatttgtagaatggaagcaacaaaatcatgcttgtttttgtatatagcaccatttcatttaaatagactcttaaatcattttaaattctcacatgcatggtactacttggagcatgatagtagttatgcattacagttcatcaaaaaacattcatttaggtattctaatagattccatatatgtttgtgccacaagggccagctgaaattgagtaaaagagcaggtttctgaaatagaagaaaggtgtcataagggaagaaggagacatagagagggaggaagaagggaataaaattagtgaaatgtagggtggaatctttttaaatatattcttataaagttttaggcattatctgtattagtctgttctcacattgctataaagagctacccaagactgggaaatttatgaagaaaagaggtttaattgactcacagttccacaggcttaacagggcgcatgactgagaggcctgaggaaacttaaaatcatggcagaataggaactttcactctctctcctgccaccatgtgaagaaggtgcctgctttaagggaaagcagttccacacacttttaaatcatcagatctcatgagaactcaccgtcttgagaacagcaagggggaaatctgcccccatgttccaatctcctcccaccaggtccctcctccaattcaacctgagatttgggcagggacacaaatccaaatcatattgttaccctcggattatttgtaggccctttaaatgctaattacatagtttaccttcaattttatatttaagaaaatggattaattctggaagcaactaataaattatagtgaaacagaattttccctcattatatgaaattataatggttaccactatgaaggtctactgggtgctattaacatgtaagcatatttataacatataagatgaagagagaaagattgcaatgaatctttttctcattcacatatttattctttcatcaaacatttactaagattgctgggcattaaatgacaaaagggcaatgggagacaatgaggcatggtctctgcaatctaggcaaaaaggaggttttttgttttttgttttgtttcttgtcctcctctaatgtcttccccttatttaattttaagtttttttccaagccatttcttcacatcttcttagagctacaataagggctaaataagaggactcataaaataccctacgaacttgtaaaaatactgttggtcaacacagcatgaagaaatttattacaaggcttttgtttgttttgttttgttttttgatatcaaagtcatcattatatcagagtgaaagctacttaagatcaggactctgtctttatgcaatagaattttgtaactataaatcaaatgtcttttgtggagtaatgaaaaggttttgagctaggttgagtaaatactaatttttaaaaattatgagaaaattaccactttgggtttgcaaagttgaggcttgttgagcctttttatctactgttcattcacaagccaaacaaagacacaggaactaatgaggttattttcagataactgagcagactatttaacaattactttctttgatgacttcgtccactattccttagaatttcttaaaaatttaaacaagaaaaaatttaatgtcaaaaaattataatatacaaatttgaaaaagttcattagctgttcattttcatgaatcaaaatgactgttgtactcataatgtttcttccagcgcccactgagagaccatttacaaatacgtaaaaatgggtccagtgactgaactcattaatgtctattccactaaaacgttctttccaaattcttcagcattatctattcaccccgggcttttcagtgtggttctactttctgtgccatgcgactcagcttgcgtaggaaaattggtctctccaacttttcttttagagttttgtggaattgtgcattttgacataaactgttatttcttcctaaatgtgtatttaaatatacatattgtttatattggatataaaaaattttaaagaaactattgttcaatgtaggcagggatgattaaaattctgattataatgtctgcatacattttaaccagagtgcaaagtttttaacagatgaatctttgaagaacatcatgtgtgccagagaactttcaatcttcgggaatatctgatgtagtcatagtttgttttactataggatacttgaggattttatagaggcgaaatagttttccttaaaatgaatattatgaaataaaaaatactttcgaaagagagagaaagtattttcataatgcaagaacaaaggaaggcttaattttatgccatcttgagaaatgagggaaacccaaaggagaaacttaatcccctgcaaggttaaagggaagtcagttgagtgccactgttcactcccccttctcaaaagcattctttctgatacaactcagatggaggaagagagaaacggtgttgcaacctaggttcgtacctaatggatgcctgagggggtctagacaaatccaaattatttgactcctagtcaccctccacatctcaccacgttgagctgacgtgtgggtcttttgttaaagagagcagtgttagagtcaatttaaaaataaatcaaaatctcattgctcaagaaattcaagttgacattgggatgaatgcctccaacttacaaattgttttactaaaaattgtacattaagaatgtattttctttcattttacgtttcttagtaagagagatgtttttttcttgtctgcaggcatatcctgcattttctgtttcaatcctttcctagagcaaccctgttttaggggaacaggttaatttattgaaagaaacaattaaatatatgcagagagagagagcaccgtggcagatcacttcaattaaaccgtggtgataaaatccaactaaagtcacacaaggaatatccagaaagaaattacaatattcttctctatcatagtggaagaatagaaagaattagtaaaattaaaataaagcaattctaatgaattttttaatgtcattaacctatgcttatacaactcttcatgctatatgacccttatgtgaatggaaagccaactatttgtgcaaataaatcaccaatgtttgcataaaattcatgagactaaaatccttttttgcaagctcccactggaggtattgattgcaccaaaccttaaagaataatctgttacagactcaaattggaatgagagcaccctagggagagataataacataaaacacagggatgaactttaaatgtaaacacaggccttaaagtatagaatatagcagagtctggccaaaatgtaaagtaacagagaagtctgaagaatcagaattgctgagacctctggctgcctcactaagaagttttgatgtatttaataagaaatagggtgcttgggggaattttgaataggggagagctataggaagatgatctggttgattaatataatatttttcacttctactatgaattatgtagaaaaaaagattgtcacactctttcaaattacactactttgtattaatagtgcaagtaaaaattttacttgaaataggccgggcacggtggctcacgcctgtaatcccagcgctttgggaggccgaggcgggcagatcacgaggtcaggagatccagaccatcctggctaacacggtgaaacttcatctctactaaaaaatacaaaaaattagccggacatggtggcgggcgcctgtagtcccagctactcaggaagctgaggcaggagaatggcgtgaacccgggaggcggagcttgcagtgagccgagatcgcgccactgcactccagcctgggtgacagagcgatacttggtctcaaaaaaaaaaaaaaaaaaaaaacttgaaataaattggcagagattaaaatgtgatttagagaaaattttgcgcaattattattcagattttttccttcatatcatgagcacggaaaattagctttttcgttaaatagtagttattttttttctagacaatctctaagatgttaaaataattttctcttgacataggtttttaggaaaacaaatgtttttctaaaactgaaaatcccttcccaaagaaataaatatttatttagatttatccatagaacccagagttaaaactataactctttgatttttttttttttaaactgatctggaatatggccttctccttcacagcagccacaaatttttctattttatgaaatggcttctgaggactgctgttatttgtggaatgaactctaagatgctaattatttgtaattgaccctagagatctttggtgtgaagtaatttgtaattttgctacggcataaatatgagtcacgcggaataggcgaacattcaggtgcaagttgtcaagctagagtgtaactcttcatgagcactaagtgtccactatccaaagaggtttatgcttctttctaccctaccattaagcgcgatggaaaacaaaggtctagagaggccagttacatttattctgtcataattcacctcattttagatgaaaaaattataatataaagctattgcatatggaaatatgtaaagaaagtgccactaatgcatgtgaaaggataggattgcttcatattacaagttgagcagatataggtggagaaagtctacctgcaagagaggcaagcaggtttttttgatagaatatctgtgattttctagaaaatctgggtaaaatcaacagaagttagcttttaagttgtaggactttaagattctaaataatctcttaataatgctggcaatgtgatcatttaggattgaatcatttgttttggaaatcataaaaatgatcaaacagttgattaaatgttaatgtcaaacagatttatgcaactgattttagaatttccatttttgtaacaagtgaatcagatttcatgtttggcttgtgatcacttggcaatgagtcaccagattggtactctaatgatctctaagttaaattttttaaacatagtatgaaatcctgtatattctcaaggattagtaaaatagctcacatcatgtctatgtcattgccaaaataattagatacttattgagaatcctttaaagtattattattagaaacagtaagtcaaaattatttgctttctcccatccgagtactaatcaagcccgaccctgcttaaattccaagattagatgggaatgggcacatttatggtgatatggccataaataaaatgatttgcctttagaaaataatttctctgtgaggttttacatgtaatggtctttgttggtttaaaactatctccgtcttatgtgaaacatttatagtgcaactacacttattgttagatacagactctgtgaatatcttcaagcctgtttaaattgcaacttttattatgccctaaaaagtagcccaatcattctgtcttctgaattcaaattttgacaagaggctctccccgtgggttgctgatgagagatatcaatgatatttccctgcaagggacaagctatcttgtcaatgttaggcaggcactgtgaattaagctttgcctagttaaaaatagtcaggattcaatgtctttttgaattatttattcttttttggaaataccaaaagatgtggcaatattcttgcagatggctgtgtatctaaggtaaatttatttagaattttttaataagaggataaagtgtcccctaaagcattgaaaatgttgtttttttttctttagctattgcagaggtggggaagagaagagagtagaagtagccaaagtaaaacaaaatgaacaaataacgacaataacacaaataaagctttctttccatgcttatattgcttatgtgtcctccaaaagatgcaaggttcaaaagacatatgaaagaagtcatgaaagttgtaacattttacattaaaccagagtaatgtccttccagatctggatctgctgttgtcttcaagatgaatgtttgacttcccaaaaatagaaataaaacacctaacctcaaatctgctggcctcaatcaaggcctgacctatgtctgtatgacctagttacaagtcagctaaccaatgggcatgggttttctttcctctaaaaatggaaataatgcttccatatgatcatccatggaaaatggctgctcttgagcaattgccagaaaggggccttcaggatgtcgctgaaccacctgcaagggaattgtgaaacccaaagtttcttcgttgaccctcctgggaaaccgggggttcttaccctagatgaatgagaactctgatgtagagcattcaccatgtgtgagccccatttgtgctgtgtggaccaacagaacagtcaagtgtacgaggtgattaataattgtgatggctgactctgatggggcgagggaatggcatatcgtctagggtcctgtgctgaacaagatttagtattaaccactattgaaccttacctagagtgagcctgagtcccagtgttgctgacaacattggtagcctccccatcacagatgactcaagttttatttttcaatccatataactgtttccagatcatacctaagtacagtgggatttcttagcctctctcgcatttgacccttgtgggtgcagaagaataggggctcagatttacatgatagaacagttcttcagttccagtgttagattttctcttaaataaatgtgtaggtggaagggaatctaaagcctctttgatgctacccattctggttccctttatccagcatcttgatagaaaaatgcacagtgaagttacctccaattccttttaggttaggattttaaacaagaagatcgattttagcaaagttcagtccagatgtggttccaaggataacatcaaacattcggctgggggcggaaatgtaagtagaagcgccttttagaaagctgtcctgattgcgtggagccacctgcacagccagcaccctgccttctttcccacctctttccaacacactgctcctttctcactgctgttccacatgtctccctggtatgatagcttgtagccttgcattttcagtgatggacttcccatccttccctgtaagatcatcagggaatttcctgctttgatttgggaaagaaaaccttgatgggatgcaccatggttttctggagaatggcaaaaccacttcacttgccaactttgttgctggccttcttgtcttcaatgtattttctcacgttgtttctactccactacaaaagtcagctgggcacatatttttctagctccatttaaattacccatgaggcaaagactgatatacttgtaaatgcccaaagtatgtaatgtcaatcttcagtggttcattattcatgaaagtaaggatatcatttagaataatacaaaactggtggagcatggttcatttataattcaaagtgaaaggattcaagtccagtgtacactttagcttgatgggattttttttcctgtctctttcatttagtgtaaataatgtcctgtgagaggaagggaaagatgattccatgttttttaagtgtgattgaggcagaattgaaatggtcagacaatctcaagctaaaggaagcatggttctttataaaacaagaatagtttttcaaaggtgatcaggctaactgtattctacagatcctatctctttaaacttcagtttctgatcatccatgactcaagtaatttacagggtgtcgagtctagaatttcacctgtctactaactctttggctacttgcttcccaactgggcagaagtagaatcaagcagtgaagagagagagagagagagagagagaagcaagtgccttctacaagcagctgttgcctgataatcaaagtagcttcactgagcataaaactgtcattgtcattgaaagttcatagcaatgtttgctggcccccttcaggtatgctaggctaagcctcagggttaaactttacatttatgtggttgccactcttccttattccccagactgtaagtatacaccatgtggtactctcataaaaggagccccagtcctggtaattaccttgagggtatcagaggatggacccagctatcctttacacaagtgctgctggacaaaacacctaagtggaaaaggataaactaggataattaaagatcttaaagtaagtagaggagctttatctcccaaaacaatagtcttaaattttcctctaggaaagaatcccttgtttaaatatgcagacatcctggccctgtcctcatgatatctgattcagtaattcccaagtactctcgtgcagatgacaatggaccaaacttggagaagcactgcttcaaatattgggagaggaaatattttcagtaaaccacacagaagaaaaaaacctgttactatcattttataatttggtatgaaagaaaaatttcatctagctaagatatgacaatgtaataacaatttaggaaagcacattcagaacttcttgttgtatcttaacgttggtcttcttgtaactatgagcaacattggtcacttttatgtaaaaatcactttataaagaataatgcagctcttcccttggctctttgcttatggaaaggttaaacagtgttgcttagttctctgagtggaagcttgccttattaatatgtttctatcctcctgtgtcataatctgctttcaactaataaaatcttctattctagggttttctttcacttgggttcttctttccaatccaaacatgtgggagaatatatggaaaattatgtcttcctctgtttgtgtgtgtacttcaatttgggtttctagctatgttgttgcatgttgtgactttgggtgtgtttctagatcttatgtatgagcttgggtttttgtccatgtttgaactattttaagcatgttttatgtggttcacataggtacaaattgttaccaagaaaatagacctaagccatgtgacatccaaatgtggctctctgaagaacatccgccacaggccaggtaaataaataatttttagtagtttgagaaatatttaactggaatcaagaaagggatgagaaaattttttgttgttgcaaaatacctaattggaaggatgttttaaaatatgggtacttcacatttttattaatagaaactaaaattgaaaatttcaaggcatcttcattggggaaaagtgaacccaattacaatgaagaggacacattttaattaaaaattaaaaggtacataagacgcatttatctttatgtactcaacacgcttattggagctcctttgaaatacgtagtctataaaatacatcagatcatgtattcatatataataacattgggggtagcatttccaaggttttttttcctaaaattggctttctacattatgtaaaataaggattgtgctttgcaaagctgaagaagtgtatttatctggtgaatttctcagattctttattaggtcagtaaacaccatgaatacccagcagaatgcaatgtttcctcaacttatttgaccatgaaccccttttggtttttcaaaatatctcatacgactagtgccctaaagtagaatttatattcatagttactgggagattttctccctttaaagtgtgaatctaacattatgagtcactttttctgaatatcatgtattacatgtttttgttaaattctacctccatagagtgggcatgttggctcatgcctgtaatctcagcactttgggaatccaaggcaggaggattgcttaaggccaggaacttgagacagactcagcaacatagggaaacccctgtctcaataaaaaataaaaaaataaaaataagccgatatggtggtacatgcttgtagtcctagctactttggaggctgaggcaagaggatcacttagtttcaggagttagaggctgcagcaagctatgatcacaccactgcactccagcctaggcaacagagcaagaccttgtcacaaagaaaaaactctgcctccatagatatgtaataaaagatgactgtcatatttgtaattttcttgagaatattttgacacaattcatttatccctttgagaacaaaaggaaagcaaatggttttaactgtctgtgtttggcatcttaacatgaaaacaaagtaataggtttttttccatgaaacaaggtataataacaattgagctgttagctgacaattattctgctagtcaggagaaaattattaataaattattggttgaaaaacaaagataggtagaataaatttcaaaatggataaatgcattgaaaacatctggaaatcaggattcattttgtcaatgagtattcattataaagcaagtcaaagagttacaaactacatttatgatgtcttcacttacagtttcagaactgctgccatggaattagcttctctactattcatgacgcagcaggaaggttgtcccatacttcatatctttgaaattctcctgtccacagctgaagtctacaaacactaaattgactttgtactgctgtgtcaacagcatggctggaatacttggcaacactgcctattttctttcagaatgcaaaagaaaatgctggactcttcaattctagacagtaaggatatagttagtcaaactcacctgtgacctagatgtacggaaaaattttatatagataaggaactattctgtgtatgatttgttggtcataaaaggctgttgtcatggactcccacctatttctaaatctagctcttgcttctattataactgaatcaaatgactaaattcataaagaagtgtaagcataataatccttgacagcagcaaccttttcacaaagttactttggaatgtggaatatctaaagagaaaataaagaaaataaacatctggaggcacacactgaaatatctgttcttctcaacttcatttataaagcttgacaaagataatagtctttcacaattactgctcctgatgggtgccagaattcttcgaaaatcaaaggcatggatctctgagtttaagatatctggattctctaacagttgcataagaatttctagagggacttcatcagaaatagacttcttaagcttccttttctgaatatgttttgggtcaataatacattattatttttccctctcagaagacagttcatagtgagagtccatctctacaaaaaaattaagaataaaaataagctgagtgtggtagtgcacacctgtagtcctagctactcagagggctgaggagggaggatcacctgggcccaggaagtcaaggttgcagtgagctatgatcatgtcacttcactccatcctgggcaacagagcagaccttgtctccaaaaataaaaaggacattttagcaaaaatttaacacgattatattgacacaacatataatcagaaaagtaaatgatttctatcagaggctaccaaaaatacaaaaataagatcacaaagaagttgttcttatctagttgaaagtccagtatcctctaacctctaaccaagataagtctgtttttatgaatcattgcaaatcatgttcatctcatcacaatcaataagtgagacccatatggccaggtaaaatgtgggaagaataacactctataaaatgaggcatattttcagggaaggataactacatctctaagcatgagttaaataacatcatacagtttctaagccttaaaagaagaacgaatggatgtttctccaaaatgtaatctaattatgtaatataatttcaagaggcccctggccaggcagttgggtattaacatagatgtctagatattgcatgagaaaaatacctcatggcttaagagaccgtgaagccttaacaaaccttcctctttcgtctacagagatacatgagcaacaagaatccaaaattgcaaaatctctttcatatttccatacggtccatcaggcattttttcaaaatcaaactcccaagcaagatgcactttatgtactcaacatgtttattggagcagctttgaaatatgtagtctgtaagatacatcacaatcaacaagtgagacctacgttaccgcttctttccagaagaacgcatgtgctcaaaaccaagttgctgttaaagtgaaagcaaatctcttaggtggtgatgagcaaataaggagtccaatttcactttttatctagatcaaatacatcagcagacactcagaaatggtcaaggacaggctcaaggacaacgagtaacttgcccagtgtagaagaactttccatatttgagagcttgagaaagacgtgtagagatggggaagactacactgaagagtgcagcatggcactgttataatcagcagatcagagttctagactggttagcattagggaaaatggcatggtcaaaactctgtctcaatattatcagatcaaggtcagcgtcatattggtcctatggcatccatacaagaaagagatgatgatctgtcactccatatatgaaacgggaggcttttaaagcttactagtcataaacaacttacctcccgactcatttcatcagtgaagctttcaatgttgaacattcataaatgaatatattgcccacatgtgcaccacttccagcctaaatcttctttggataagtaacctgttaccatgaatataaagaagagtttcatttaaatttaatttggtcccttagaaataagagactaaatgttccaacttttagaaaggattcaaataagatattttcattttgctaatttttagagttcttgttataccaaaaagaaaagcccctctgatttcttaggttagacatgggtaaaggagaaaggtattaatacgtgaagcaatccatataatagtataagaagggtgttatggtcttgcatcatatgaggaaatgatatgggctagaaattctaaaagactctttttacatatatggttggagggatggtaaagttaataaatttgtggtttgccgtagtctatctactgcagtcatttttgggaaatagttaccacgaatgcaaggtatagttaaatcaaggtatttcttccctcataggtggcggacgtgtgaaaattgagagtgtaaaactagatttcaaagaaaaggcccaagctaaagttggttctcttgataatgctcatcatgtacctggaggtggtaatgtcaaggtaagaaacaaggttatgagccaatcttgtcttttttaaaaaaaattcttctgaaatactcttcatcaaaataggtcccagactgtagacctggacaaataagaagtggggataacagaggtgaatagaagtcattaatgtcagccctgggagatggagaaagaggtaggggccagttaagatgcatgagttaacgaggactgatgcttgtcttaaacagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacctaactgctagttttggtttcagactgtttaattgcttctcctctggaaaaaaaattttatatatatatatagtgatatagtgcgtgtgtgtgtgcatgtgtgtaatacaaccaaagaaaaattgtgaaaacaaggctattattatggctgagtttctattatgtgtcaggctctatactaaatgattttatattagctcaattaataaggaaatttatttttatcactactgtattagcaggatgctatcttttgcaagtgacagaaattctaattaaacgggcttaaacgtaaaggtgaatttgtaggctcaagtaactgactactcaggtgtatctgcctcaggcatggctgggtccaggccctcaaacgacgtcatcaggaatcttcccttttccaacttttagttttgcatcctctgtgttggcttccttctcaggcaggcaccccttccgtgatgggcaccagaagctccagatttcacaacctatcaaagaaagcccctttacagtagctcaaatccagggtctgaaaatcactgaacgattaatacttggatctcctgcctacttatgctaattgaccaggattggctcacgtacccaactctgtcacaggtggttggagtagaaggagaataaggggagaagtggctttattctcctccatactacctgagctaatcgtggagaggaaacgtttcccccaaagttaattcaggctactcctgccagaagagaggaattgatactgtacaggccacaaaaacaaatacgtggtatagctgcacccctgttcatcttttagctccttacagctcagattatgctcaggcttcaccagggagcttgatagaaatacaaatttctggactccaccccagactaactaactaacattcctccaggtgattcatctgcactcaaaaatttgagaaacactaagctcattcagtccctgctaatgtgtttaaggagaaagagctccgttgcaggtctctaatggataaaagttatcccaaagactatttgagacagcatccctacctctgatgtcaaactaggaaccaaggcatagaaagctgtgactggtaaaagaaatacttatgtgtgtattagaggttttccagccctcagactattttaacttggctaaaacctacttctcttattaatggcatcacttctcattcagtctccttttgctaataatgcagattttgtagaacctagcaagaattattagtgtatctctaataattccttaaaatcagcacacatgttgtccttcagagtcttcaaaccatgaggattaaatttgtccagtagcatgaatcaccataaaattgttgattttcttttttatttgttaacaaggcaaggaaaggtttatttgccttgacaagagacaaccgtaaataatggaggatgacaggataacattcagtgtaacttacagaaagataaatgttcctcttcttgtttatgatgtggcacttccttgtagacctgagacttcaagaatttagggctagaaaattgtcaaaagtatacagtctagcaacctaaaattgtttcaaaatattaagcccttcactcgactttcttgagcatgataaagcagcatcatggacacactctttaaagccctttttccacctctcatgcctttccctcacaaatatgcctcagctgtttccacttctactcccttaaattccaagacaatctctgtcccaggcctcagttgaggtaataaacctgtggcctccagataggctttatttggcctgcaaactgttttcaaatttcagaaacttcacatgcacacacacacatcccagatttggatcttcgctcttggtgaccattgaccagagctgtccatgggtacctctgagatggggtttattcccttgacttggccaccatgcccagctaggcttattattttctcccacccctctgctttcactcattacgataagcattaaactacagattt

SEQ ID NO: 14774 - DNA, 113060 bp, Human; identical to SEQ ID NO: 14773

SEQ ID NO: 14775 - DNA, 8302 bp, Human
gataatagatttcaaggcagcatctccagtgtgcttcctgcgtcttgtgatgattcctaaattctgtccacttttactcgtttgtatataccccattcaaaaacagccaacatcagcctcgaaactatgttgtttaaactcaagagcagttttgttccatgcttatattgttgtccataccttcagcaggaccaagccataaataaatacttgctggtttgtgttgactgaatgatttaagataaataaacaacctcaaatgcctactgaggccagataatgtaaatgggaaaagcaaacagcggggagtgtggtgaacaggagcaccctaggttcctctaaagggtgtggcttcgaccacacttcaaacctagtttgcacttttggaaaatggatcccacgttgtcagagattctggttttccaagagatgctggaatctgggtttttcatgcaatccctcaatgtttaaaatgttggtaatcaattcaaatttttacaatacattttgaaggccaatactgtaaaccaaactaagcacttctagggagcccatgcaacgaatttgcaatcttttcattaaacagcacagctaatatgaaaacacgctttttttttctttttcttttttgagacagagtcttattccgtcacccaggctggaatgcagtggcgcgatctcggctcactgcaacctccgcctcccaggttcaagcgattctcgtgcctcagccgcccaagcaactgggacgacaggcgtgcaccaccaaggccggctaatcttttgtatttcagtagagacggggtttcaccatattggcaaggctggtctcgaactcctggcctcaaacgaaccacccgcctcggcctcccaaagagctgggattacaggcgtgagccaccgcgttcggcgaaaacacacattttctaagaaactgattgctgggaaggctacagtgggtaagagctcttgctctctgtgggcctgcctggttcggaatcagggcagtgctctctgcctaagtgaacttgggcaattttctacaaacctcagtttctgcacccgtaaagtagcaacggttgttctgaggacggaatgagaaaatgcatgtcaaagtccttagcatgaagcggctctcagtaaccgttaaccactcctaattactcctcttcataatagtagaattactcatggcctcgccaaacattatgcaaataatttcacgttcccaggtagctcagccctcccacaaaagatttgaacgttttccatatgataacgatccactcgtttttgctaaacatccacaatgggcgatatcgacctatctggaaggacacacacaaatcccttcccaactcaaacacgatgttctttctggctggcaccagggcttctgtttgcagtgacttcctgggacccggagctttctcacagggcctctggcatctcctctgcggtgattaaggttcttctcatttcccttccctgttactgcccatactcttcaagttcgaaaagtttccttttccaatctcttttctgggcttgtttacccaagtctctaattgccaaggcctctggtctctccccacccacaactttcctcctggttaaacccttcccctcccgccactcccagctcccgccactcccagctcccgccaccactgccgctgacgacgtccagcgtttgcagatggtcaaagccgacccccttctcctcccacctcgttttgtaaggaagtaatttcggggccgagcgctctgcgccccccgccgcgggtcggcgccgccgcgggtcgggagcgtgtccgggcaggtcgcgctcagcggggtacttccccgcccgcgtcccgcgtccgctcccataacgccgtctgcggggcggggacaggggcggggacaggggcgggccgggcgtctagtttccctacgtcaccagggaagttctcactggacaaaagcgtggtctctggcgcggggatctcagagtttcccgggcactcaccgtgtgtagttggcatctccgcgcgtccggacacccgatcccagcatccctgcctgcaggactgttcgtgttcagctcgcgtcctgcagctgtccgaggtgctccagttggaggctgaggttcccgggctctgtagctgagtgggcggcggcaccggcggagatgcctgggaagaaggcgcgcaagaacgctcaaccgagccccgcgcgggctccagcaggtaccgacccgctggggccagcgaagacccaggccgggcggggtcggggccggggtcgaggtctcggctggggcgggctcagctcgccggggctcaagcacagactgcacgggggtcaaggtcgggccaggtctgtgccctggcgcgagccttaggggcgcctccagaaagttcttcggggtttttccccaggaccggcgggtacggcgggtacggcgagggaccaagccggatttgcgattgggatgcagctgcgtttcaccaggggcaaaaagctcctttcctcctctctttcctcctcgccacttgcccttccccggggccacgaggaacaagtgcaagtgtaggcggctgtctctaggagaaagtcattgtcgcggcagaaggggcaggagagagccccggggaccgcctggactcccagcgcttccagagacggccccacaagggcccctgtgttcaggagcctagaaaatcttgtaacatttaaataatcgatattgtgggaggtggggataggagaataggagttagtccgctcctttttttcattcattcattcgcactccccaccccgatacatacagctccatcgtaagttttcaggccagcgccccggccccatgctttttctaaatctaaacagagaacccagtcactgcccagagcccgaagtctgtgtgggccatactgctgttgcatcagacgattatacgccccccccaccttttaagttactttcattttatagagctcctggggcgtgcgaaggaagtggtgcattgcaaatgtgaccatgcctaagttggtaacaggctgctgtctctggcgcttgtgtgggatggaaaaagctttgtctaccttttgtgatgtcttaggattctgaccttgtttctttctgaaggatcttacttatgcatagcactttctggtccgacttaattcccaagaacaggaagcagcacaaagtccctcttaaacttgatttgattgatactaatacatttataggtgtgtaatgcaatttttaaaaaattaaggaaatgaccgggaagtattttctgccttgttttctacatttttggtgaaagggataacttttccacttagaattcagggcttccagtgtcggacgctgaatggtatttggtttttcttttagaactgtatattaatatatctcaatctctgtagacaacatgtctatgtaaatacttcccaacatatttgatcttgtagcccataaagaataacaccttaagggatttattaggtctcttggtgtaggagttaggaaagatttcactcacttcttgtagagagaaattggttgaaatataggtttaagattttgctttactatatattgacagctttgatttattttgagcctaaatacggtattttcagggtcgatttataaaatagaccagattttaatttgtaatcatgattttttaatgtttgtaatcatgaagtgtacccgaaagacctcaagctgctctttgaaatattcaagaaaattgaaattatagtcagtatagatacgatattatagtcagtatagtgttaactgcacttactgaaaaaaagtgtacttggaaattataagcatcatttttcttaatattcagttagaataactcaattccaaaaagtagtaaacatgtgaattaaacattgcttattttctgctcctctcatttccataaaggcaatggattggtacataatggggttataggaagaagtgggtttacattaaaatagaaatgtttaaattattttagagaatgtggacttaattttagaataagattttatgagtcttttatgaaaaaatatcagcgttttttaacgagaaaaagaatacctctagatttgcctatataatgagagtataacctaagctgtaaattattgccatttgaaaatcaaatcctacttgaaagccacacagaacttgacttctgtttcccagccaaccttaaatgaagagaaaaagatgacatcatctaaggctggtgacttatgctactctttgtagcattgcttttaaaataaacaaagtggttttacaatgttctcacatcccaaagaatgataatgctactctttgtggtatttgacatatttgaaagtaaggtaacacttgcctcatccaggatgcgttttttaaaaactcaaagtaaatgtctttattcttaccttaacgattgctttcggtgagtcacaatgtgtgtaagtgtgtgtgtgtgtcacatttggaaaacaggtgcacataaagccaaagttaagagaaatgcttcctgggatactcaatttgtcactagtgtgggcgtattaggttttgctggttacagtctgtaatatcatcaatgttcatgtccatgttttgctttccttctcagagctggaagtcgagtgtgctactcaactcaggagatttggagacaaactgaacttccggcagaaacttctgaatctgatatccaaactcttctgctcaggaacctgactgcatcaaaaacttgcatgaggggactccttcaaaagagttttctcaggaggtgcacgtttcatcaatttgaagaaagactgcattgtaattgagaggaatgtgaaggtgcattcatgggtgcccttggaaacggaagatggaatacatcaaagtgaatttctgttcaagttttcccagattatcattctttgggatgagagaacattataaaaccactttgtttattttaaagcaagaatggaagacccttgaaaataaagaagtaattattgacacatttcttttttacttagagaatcgttctagtgtttttgccgaagattaccgctggcctactgtgaagggagatgacctgtgattagactgggcggctggggagaaacagttcagtgcattgttgttgttgctgtttttggtgttttgcttttcagtgccaactcagcacattgtatatgattcggtttatacatattaccttgttataatgaaaaaactcattctgagaacactgaaatgttatactcagtgttgatttcttcggtcactacacaacgtaaaatcatttgtttcttttgactcaaattgtattgcttctgttcagatgatctttcattcaatgtgttcctgttgggcgttactagaaactatggaaaactggaaaataactttgaaaaaattggataaagtataggagggttacttggggccagtaaatcagtagactgaacattcaatataataaaagaacatggggattttgtataaccagggataataaaaagaaaaaagaagttaatttttaattgatgtttttgaaacttagtagaacaaatattcagaagtaacttgataagatatgaatgtttctaaagaagtttctaaaggttcggaaaatgctccttgtcacattagtgtgcatcctacaaaaagtgatctcttaatgtaaattaagaatattttcataattggaatatacttttcttaaaaaaaaggaacagttagttctcatctagaatgaaagttccatatatgcattggtgaatatatatgtatacacatacttacatacttatatgggtatctgtatagataatttgtattagagtattatatagcttcttagtagggtctcaagtaagtttcattttttttatctgggctatatacagtcctcaaataaataatgtcttgattttatttcagcaggaataattttatttattttgcctatttataattaaagtatttttctttagtttgaaaatgtgtattaaagttacatttttgagttacaagagtcttataactacttgaatttttagttaaaatgtcttaatgtaggttgtagtcactttagatggaaaattacctcacatctgttttcttcagtattacttaagattgtttatttagtggtagagagttttttttttcagcctagaggcagctattttaccatctggtatttatggtctaatttgtatttaaacatatgcacacatataaaagttgatactgtggcagtaaactattaaaagttttcactgttcttttctgtgtgttaattttgtcttcatcttgtaagctactaattactaagtgttcattatcaagccaaagtattttaactgatttccatcagcagacatcctctgaccttctgaccacactgtctcctcccagtagttggagtagaaaatataggggagtttgcatgatttctgctctcaagggacttacactttaattgggaggggaaatagtgaaaaataggaaatgaatgcccaacataggtcctttttttttttttttctgagacagagtcttgctctgtcgcccaggctggagtgcattggcacaattttggctcactgcaacctctgcctcctgggtctatgtgattctcgtgctaaagcctcccccacacgccaccacactgggtaatttttgtgtttttagtagagacggggatttcaccatgttggccaggctggtcttgaactcctggcctcaagtcatctgcccgcctcggcctcccaaagtgctgggattacagcctatacagattcatgatctaattagaggtgttttgtgagctggcatccttgactgctcctgggtctgtctggcaagaggagctgcagtgcagtttcctttttggtgacctcacgcttcttcctctgcttccagccgtagagtagcaaagattgcttcatctgaggttagtcatgtgcaaaagtaggtgtaactcaatggccttcctgtttgagtgtgagaactaaaagatacccctagtttttagcttcaatctggtagccacatcttcaccccacctctgccaagggaaagagtcagctgacaccttagaatgtaaattgccttcctaacatgggaaacgtgagggaagaaggaggagttactagaggaaaagaagaaccagagagctggaggatgcagggttatgggcaagatacataacaatctggagggagaggcttttctctgggaaagtggggtggaggtgggagcttggcttcagaaagggtggggacaaactacatgatttgatttgagaatcactggaagagtaactcctgtctctgagcctgctcgcatagccagaattgttttgctaaaagtgcaccttattagttctcgccaccactagaaaacaaggaaaaaaagtgtacctcaggctcttcttttatataaagagtagcacatgaaggcttaggcacagattcacaatcttcagatattagagctatatattttttgagaaccatattttaatgttaaaaaatgtccaatatgttcaggcaattctaattatatctgttgactgacaaaaactgctagcttttaaatttgcatttatattataaaagaaaatgtatctatccgtgaataagttgttcttcactttaaagaactgtgtgctgtgatttgggttttggaatccattgcaataactctacaaactcctccctgccccacttcctctcaatcacggagcagaaaccacctaaagggtcaaaaatcctgtaaatctcattgtcaatcgtcaaaggggacgatccatcaggaagagaacaaacaccttaaaaatagaatagtgactggaagtgctgcggtacaaggagtatcccactttagaatcttgaaggtggactttcaaggcaaaatcatgaatgagctgtgtgaccttgggcaagacaacctctctgagccacagttaatctctgaaattgagacttagatcatctttaaggtcccctgaagtttgaatcataaaatgggatggcaaaggagtctgaaggtctcccaccatagttccaagtctgtcggcccccactcctgagctcatttcagacactaagaggaaagttaagggtttgcaaaaagaagcaggggagtgggattttaaaagaccccccccccccaaatttctgttttctggattcttcccccaaacattgattctaaatcttagaggaggttgagtgggaacctcttggacttgtattttcttagaaaggggagtttgcta

SEQ ID NO: 14776 - DNA, 6752 bp, Human
tccgggctggcttttccctctggccccagacctgccctccagtgtctccctgtctccaccctctttggcaaggtgcaccacgacgcccttttgaaccctggatcccagaccctgtactgccagagaaactgaggcaactgtgggctccctctagctctgagagaggaacctcttcgctggggagactcttgatggggtgagacgcagggacatctgccggggaaccagaggacaacccaatcctggggttcctcaggtggggttggggggctggggatggagaattctgtggggaggaggcttaagtggagggtgatttgggggagaggaaaaagatgactgggagattctggagaaagagattctaggggctgggcgcggtggctcacgcctgtaatcccagcactttgggaggctgagatgagtggatcatttgatgtcaggagttcgagaccagtctggccaatatggtgaaaccccgtctctactacaaatacaaaaattagccgggcgtggtggtgcatgcctgtaatctcagctactcaagaggctgaggcaggagaatcgctttaaccggggaggcagaggttgcagtgagcagagatcatgccactgcactccagcctgggcgacagagcaggactctgtctcaaaaaaaagaaaaaaaaaaaacaaaaaacagagagattcggccgggcgtggtggctcacgcctgtaatcccaggactctgggaggctgaggcggatcacatcacctgaggtcaggagttcgagaccagcctggccaacgtggtgaaaccccatttctactaaaaatacaaaaaacgaccagggcgtggtggtagacgcctgtaattccagctactcgggagcctaaggcaggagaatctcttgaacccgggaggcggaggttgcagtgagacgagatcgcaccactgcactctagccagggcaacgagcgaaactccgtctcaaaaaaaagagagagattctagggtggggacggggaagaggttaattcttgggggagggtctcttaggagagggggattctaacggagggaaaactccagggaaggcagttgctgggaagaggagtctcggaagggaaataaactcaggagaaaggtagattttgagggacgggtctctgagagaaaagtttttgtggatttgcggggcggggtgttctgggaaagggggatttgccgggaaagggggatttgccgggaaagggagattctggaggagggagattccaggggtactgggtcctgacaagagaaagattctgggaagggtgactgaggggacgaggaccgaatggagggagattcagggaaaaggggggtctaagttgagcactcttaagagggacatttggggttggccatctgagagaaggatgggaaacattctgggaagaggaaactgaaaggaaggacattctggtgaaagggagattctgaggggaaggggctctgaggggaaaaggattctgggagaggatccccaaggagggggattctagggaggataggattctggaagtccttaatctgagaatccagccagatttcttgcagtagattccaaaggaagattctgatgcgggggattcggggaggagggagtccagaggggagaaagattacaggtgttgggagggtgggaactgatttaaagaaagggcgaagggagattattaaagagccagaatgcaaagaagagctgcggtagtcgactacagaggacgcgaagcacactcccgcagccttcccttcagtccgcacacgacactcccaggccccgccccttccgcccacagagcccgccacttccgcctcacagggcccgcccgctctgagcgcctaagggccttcccgccgctgaccagacgccccgcccgttagccgcaacagaagccgtaaagctctctcccgtcgcgacgcagtgctcaaggcgcctgcgcagaccctgaaaagcggccagggtggcccctagctttccttttccggttgcggcgccgcgcggtgaggttgtctagtccacgctcggagccatgccgtccaagggcccgctgcagtctgtgcaggtcttcggacgcaaggtgagccagacgccggatgggaaggggaggggaaggagaaggccagggtctgggagaggtcggtgggcaggaatctagggggtaacatgggagctggagccggagctcacggggcccctgtttctcttgtatcttacagaagacagcgacagctgtggcgcactgcaaacgcggcaatggtctcatcaaggtgaacgggcggcccctggagatgattgagccgcgcacgctacagtacaaggtgctgggatccggcaccggcgttgagtggatggaggactcttggagacagagatgttgtagctcttgaaagctgggggggctggcatcagcaacgggatgtttagaagttgtgttgggtgtagaacagtggggtatttggcaatagagctgggcttggggttcagaagatgtaaaagctgagatggggttgttgaagattaagggtttgctttgagaactgggatgttaggaagctcacctcactggggcggggggacccaaagggtgaagggacaccgactattttttattttatttatttgttttgagagggagtctcgctgtgtcgcccaggctggagtgtagtggcgcgatctcggatcactgcaaccttcgcctcccgggttaaagcgattctcctgcctcagcctcttgagtagctgagattacaggcatgcaccaccacgcccggctaatttttgtatttttagtagagacggggtttcgccatattggccagagtggtctcgaactcattacctcaggtgatccaccagcctcggcctcccgaagtgctgggattgcaggcgtcagccaccgtgtgcggccgaatttgggtctgtttaaatgcttgcttgtaaaaggggttcctctgttccctttttgggactctcaatttctttggctcagaatggaaagaaaccagagtctgatttctgccccttctgaactctactacttttaaaagaaagaatatctacattgcagggtcagttaaaaaaaatttttttgagttataaggttgttttttaaaaacagtatcttgctgtcacctaccctggagtgcagtagcacaatcctaatgaactgcagccttaaactcctgagttggagatcctcccacctcagcctttcggttgccaagactacaggcacatcaccacgcctggctcatttgagaaatatttttctgtagacgtggggtctcactttattgcccaggctggtccttggtctcatgtgatccttctgcctggactgggattacaggtgtgatcaccatgcctggcctagaatttaataaaaattctgagatttcctttgtgtagcagatgttgaatgttactgttattggctgtcactgtatttgaaggatttgtatgtgtaccctctgttgagttttggggacatagcagtgatccagatgacttaaggtcttgccttcatggacctgccagcctagttggggagaaggactgggcccaataccagaagctgatccaaagtggtcagaactggggaaggagacctgtgagctgaaagcaggtaaaggaagtatccagacagaggcactggtaaaagacctggagctgggaagggtctagggaccagggacaggttgtactgtaattctggaaacctgtgaggctcaaagaaagggcagagagctcaggtgggaaatagaaaaggcacctgaacagtccagggatggctttcgactacttgaaacagccttgggagtttcagaagctattggaatgctccttactgttcagccttctaagaaccagtcttagaggtagggtgtctgaggtccagtgagggacacaagtaggagggagcccagatcttgttccctttaccttgcctatatttcttaacaccacttcagcagtctcatatctggcttttttgactttcctcttctctgggtctgtagagggccttggagtgacaccctgacccccatccactagtacttgaaggccagtggtggcagaagccacagaaacaagaagcccagtgagatggctaagctgcccagcatgtaacttaaatccctgttcattccccattcctttagctgctggagccagttctgcttctcggcaaggagcgatttgctggtgtagacatccgtgtccgtgtaaagggtggtggtcacgtggcccagatttatggtgagtcccaggaactgggcgcatggaggaggtggctctgggagggaggccttcacagcgctcctgtaccctttaattgtgtgtctttctcacagctatccgtcagtccatctccaaagccctggtggcctattaccagaaatgtgagtgagcatgggtccttcccatgaggtaggtgggtgtgtggggatcaagtcaaggactctgtgtgattatctaaatcctcgtccctgctcttcttgccagatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaagaactgtgtgtggccttatgtgttggtattggatgtttaaccagacagaaatcagtaaacatcctggacctattgccagtctggattttgaccctccccagaagtggtcgcgctgggcttggtgtgggtgagtggaagcagaaggcagggggtctctgtctctacacctccagtagagtccagtgtgcaggcaaagctgagatggcagtcgtttggggccattagtggctgcagaccttggcggatatatggctcatccttgtggatgtctatttttttcaagcccagcctcccaaatagcttggattacaggtacccaccaccacgccatgctaattttgtatttttagtatcgatgggtttcactgtgttggtcaggctggtctcaaactcctgacctcaagtgatccgccttcccgggcctcccaaagtgctgggattacaggcgagagccaccacccccagctgaatttttgtttttgtagagacaggtctcactatgttgcccaggcgtggtctcctgacctcaggcaatcctcctgcctcatcttcccaatgtgtccaggttacaggtgtgagctaccatgcctagccaataatctttaatacaaagaaaacaaggagagtcgggcacggtggctcacgactgtaatcccatcactctgagaggccaaggctggtggattacaaggtcaggagttaaagatcagcctggccaagatggtgaaacctcatctctattaaaagtacaaaaattaggtatggtggcaggcgcctgtaatccagctacttgggaggctgaaggaaagaattgcttgaacaggcgcctgccacacccagctaatttttttttttttaagtagagacagggtttcaacatgttggcaaggttggtcttgaaatcctgacctcaagtgatcacccgactctgcctcctaaagcgctgggattataggcgtgagccactgcacccagcctaatttttgtatttttagtagagatggggtttcaccatgttggcaaggctggtcttgaactcctaacctcaagtgatcctcctgccacagcctcccaaagtgctgggattacaggcatgagccaccatgccgagcccaaagtggcattttggacaggtaaccgggctgtggaagaccccaggttctttttttttctttttcttttttttgagacagagttttgctcttgtatccctggctggagtgcaatggcgtgatctcggctcaccgcaacctccgcctcccgggttcaagcaattctcctgtctcagcctcccgagtagctgggattacaggcgcctgccaccttgcccagctaattgttctatttttagtagagacggtttcaccacgttggccaggctggtctggaactcctgacctcaggtaatctacccgccatggcctcccaaagtgctgggattacaagtgtgagccgccacacctgcccccccccccccgccttttttttttttggagacggagtcttgctctgtcacccaggctggagtgtagctgcacaatctcagctcactgcaacctccgccttccgggttcaagcaattctgcctcagcctcctgagtagctgggactacaggcaagtgccaccacacctgactgatttttgtatttttagtagagacgtgggtttcactatgttatccaggctgatcttgaactcctgacctcaggtagatccccctgccttggcctctcgaagtgctgggattaacaggcgtgagccaccgcgcccgacctagagcccaggttcttgactactagtttaggttgtcacagatctgctcaagaggccccatctctaccctgtggcccctcaacatgaggagctaaggagtcagggtggccgcttgtgggaaaagcacaagaggctgtgggactcaagcggtgcctgacagcctggaggagtcaggtggactccttgggggagaggacatgggaaccagggtctgctggccggtaggaaga

SEQ ID NO: 14777 - DNA, 22339 bp, Human
  misc_feature (1)...(22339): n = A,T,C or G
cccggcctgatgttcttttttttttaaagctaatttaatcgtttaaattgcttcaagaagctgcatgtatagatgaaacacttgtttttttttccccctttaagaactagaaatgaattcttttaaaaaatgtattaaaaatttttaatttgtaattgacacataataatcgtacatatttatggggtacaatgtgatgttccaatgcatgtatacaccgtataatgatcaatcaaatccaggtaattcccacatccatcacttttaatatttatcatttctttgttgcgacatttgaaaccttctcttccagctgtcttgaaatatgcacgagattgagatttgctgtagtcaccctactgtgtaacaggacaccagaacttactctttctgtcttactgaagctccacaaatgttctttttctgttccaggttctaatctggggtaccgcactgcatttaatacattattattattattatttaaattaacacagaggttgccccgtggactagcagtggatggaaaaagaaaggggcatagagaagtatccagaacaaagtcctcaggtggcctgtgagggaggaagccccagggtggtcacggggcacacctggcctctctgacccacagtctcagcacagcgtatgcaaagtgcagaggaaagacaccggtttgctggtagctttaacagttgacttgcccagcgcttgaggaagttgcatttccctttctgtaaaagtcaatgttgtgaacccagtaacttgtgtgaattgctctgaaaaggttcagcctccgggtgcctggtgggaatcctgcgctctgccagccagcaggccctggccctctgcaccctcctttggagttcctggcttgtcccgagtgacgagtccggggtgggtgaccagtggctcttcctctccccgcccctccgtcccttccccccggagctggaaaggtgtgtgggtggggagtgatagcaatgaacagtgaacttggtgccaactggggtggtcgaatattcacccgagtccacgtggagagccctcgtggcgaagggagcgccctgcaagctgcagaactcaggttttgtcccttcaaacagcagccggagccaatagctgcagcttggagaagagcttggagtcacctgagcctagggctggtttcaggctaggtggtcaaatgacttctcagaccctcagttttcgcatcagggaaatgggccacagttctagctccagggtgcctggtcccccagggcggcctcagaataggcttggctcctgtggggcactgcccgccacttcccctcaatgtgcccttctccatcagcggaccccaccttcccttcctgcctcatcgccccacatcctcccacccagggactcccacacaggcccttgcctgggggagcctctgggtcctggctcaagcaatctccccccacctggagttccctctttagggcgcacgtttcaagagccagctccaatgctagcttgcaggcccccagctctccatctcggtaaccctgaggtcctctctgtagattcccccgttgcctcaatcacttcctgtctctgttatgatctcccatgatgaagtcatgcctccctctctgcaaagggtataaactccagggaccagctgtctcttgcatcctgggatcaccagcacctggtactgtgcctggcacacagcaggcactcattaaatgctctgcttagaattgaagtgcactgaattcttggaaccctcaagttcttggagaacagcctctgggcccgccccgtggacaggaagtgagcctcccagcacagagggcccccaggtctcctgctggagcctccacgcagggggcctgtggggatggccagggctcagcccagcacctgagcgcccctcccaccagctgctctgccagaccgcatgctccgccccctgcaaacgaccgtggggagagcagcttgagtaagttccccttccgtttcctcctgccccaccaccgctgctcctcagcaggcgcctcaccagcctccacaccccttgcgcccgcagaaacgcgcctggccctgagctgtcaccaccgacactctccaggctccggacacgatgcaggccatcaagtgtgtggtggtgggagatgggtaggtacctggctggacttcctcacagcccccaactgggatgccctgagatccttccgccctggtgcccctggggaagcccctggccctgcagaactaggcgtccctggaaggcagcttggaggggacgcttccttctccgagggcccacagggagcacccgggggtgggctgaggggagcttcaccctcttcagccccaccccaccccagaagccatctcggtggagggtgcaggactatgggtgagagtgcccagggctcctcacctgcaccccaaaagctgggggcaggtctcccacggaggcaagcctcagtctttactctgtggatgcaggagggaagtgggaaacctgaaattcagcctttgtccccaggctgacctgggctgtcgtcactggcttggtgccgctgtgtggccttgggcaagtcacagcacctctctgaacctcagcttattcatctgggaggaggcctatgccctggggatgctgtggggtcgcttgagataagctgagtggctgtcttgcttgtagtatgtgccttctagcaccccctccactttctctcccctcccctcagcctaccgggttggggaggatgtgtgggggatgtgggtgaggagcagaagaggcaaggggacattgagagacagagagggaaggaggaggctaaaggatgggagggtgattgtggggtcggcaggggaggggcaggctgggctgagacccttctcagttgtcagatcccagtgacttcaggctgtcttgtcccctgggggcctcagtttcctcatctgtaaaatgacaggtccaggccaggtgcagtggctcatgcctgtagtcctagcattttgagaggccaagatgggaggattgcttgaggccaggagcttgagaccagcctaagcatcatagcgagaacctatgtctataaaaaaatttttttaagccaggagtggtggcatatgcgcctgcagtcccagctactggggaggctgaggtgggagaatcgcctgagcccgggagtttgaggctgcagtgagctataatggtgccactgcagtcggcctgggtgacagagcaagacgctgtctcttaaaaaaacacaaaataaaaggacaggtccaatttgtcaatctgtcatgcctgccagcagccacatcttagggtccagcctacaggctcaccctggggcatgttctagctggaagggggcctcctgtccagccttcccattctacagaggagcagcccaaggctttgagagactcagctctcctggcctgggccctgtggccccgactttggctgtgacccatctaggtgggggcgggcccatttgtccaccagcctcagctgattctgatgcatggctccttatctgccctcgcctgccccagccctgttcacttctgctttgtatctgatcggaggaggggcgggcggaagtcaagggttaacgttccagtcattcaaaattacctcggtggcaggcccaggggagggcgatggtaggaggagaggatgagctgtcttctctgagcaggaagtgacaaaaccacgcagggcaggggaaggcccagagctgtcccttggcctctgggcttcggctgagctacctgcacccgctcccagcctcgcatgctgagggtggaggaggcgcgcgttatcacttccttcctatgtaccagctctggggttaatctagccttctctatttatcctctcaccaaacctaataggtccattttacaggtgggaaaatgaaagttcagggaagctaagtaatttgcccaaagcctcacaggatttgaacccagaccactctgactcaaaccctgacctggtaactgctctgctccacgggggaggtgagagggaagagcagggtcaggtcttccctagcagccatcggctgctgccatgcatcaggccctgtgctcagtgctttgataggcctcgttggatttactcctcagcacactcctatgaggatgggctcatctctattttctagatggagaaactgaggcagaggcaggttaagtgacttgtccaagatcataccactggtaggtggtacagctgggatttgaagcccaggtcaggcgtcgggggcccctcggcattgcctgggtctgctgggcaccctctgtcccacatcactggcccctggagaagcctgtgggaaaagcggattgccagctctgcgcacacctgtggatcagaatctctggggctggaccctgaagtctccactttaacaaacatccacatgacttgcaggctctcgggtgtgagaacacagacagggggcatctcacatggggagacggaggcccagagggctaggctgggtggatgctgaggtctttgcagaggaccaggcagaaacctccccacgtctccggcagagcccatgaccgccgccctcttgcacttcctgtctttcagggccgtgggcaagacctgccttctcatcagctacaccaccaacgcctttcccggagagtacatccccaccgtgtgagttcctggggatatgtggggtggtgggaggaggggagagaccgtcaccaagtcgacccccctttcaggcacttcctgtgggccagaccctgtgtgggcacccacagcctccagcccagtggagctgcctgacagtccagccaagaaggcagcactggcgctgagaggtgctgggggctcccagaacccgggatggggtatggaggaaggggtagaagggaggaggggtggcctttaggctgggcctccaagcaaagggacgtggaggagaaggctggctcaggcaagagcaggagctgggagaggagcttctgcggaagcaggctgctggaggaggtgatccagagagcctgactccaaggaacagggacacctggggacaaggcatgctgaggggtggaacagagctgtctgcaggcctgggaggccctgcgctctattgcaggatgcggaggcagggctgtcatcggacgtggagggagcgtgttggtgtcagactcaggagggaaggatgactggggaggcaccagcccctccctggccagccctcaggggtccccatcactcctaggacatttccccgactccctagcatggcactcaaggctcctgatggccttcactcaacctcccacctggccttattacccattactttgcttcacactctgcctcctccggaccctactgttcgccacaagctccctgcacatttctaccccagggcctttgctcaagctgttctctctccccatagtgctttttctccccacatccacctgtctaaagcctccaggcgcagctccagtgccccctcctccgggaagcctttctgatctaccacgaaggggtctccactccccagagtgactttatctgatctctcccatgactatgagcctgtggagggcagggagccatggccagctctttgtgggtctcccattatctcagcacagtgtcttctacatggtatgacacatgcattaccttacacacaacacatgtgttttgagttgacctgacttggacatcgtggaaggaccacaggaagatcgatcatagccaccatctagcaaaggcctgccacatgctggcccctgcgcaagatgtcacacatgtgtgatctcatttgatccccctgggagatggctattagcatgcacaggacacccatggggaagctgagcctcacagccactaagaggcttgcctcccaggcttacacggtcctgtccagcttcagagccaaggtccatgcagaacctcgctggggccctcatttcttgatcttaatgaacccccctttcaggggcagggatcaggctctcctaggaagaggagggcaggcagaagggagaagagagcctggagccgagatgcttccaacccaccccagaggattcctcactacccaacccccaaccccagacttgggtgggctgggctctctctgctgctgtctctccccgggacactctgctcagctgccttagatgccctggcccaggctagaggaaggcaggcagccaggagagggcagggaaaccctagcagagagcctagaaagccgcttttgccccagctcggtcctgatgctggtgagtgcccctctctggtcctgtccttatatacaaaatgggaacaaggattcctgcccactcaccatcaactatcaaacgtttatcaggtgcctctaagtgccaagggagggctggctgcaaacctgagcagggagggagaattaggtgaggcagctcctgctcaaggccatggtcaccagcagtgtgttgtcactgcctctgtccctgggtctctggatgctggcttgagaccttgtcccgcctttgtgcatcttggctgagttgaaggacccacttgctgaaggaccttggaccaatcacttcccctctctgagcctcaatctccttttctataagaggtagaggcttggaagtcccaagctccttccccaggcacctcccttgtacgttgagatggatggctgaggctgctgaggccaggttatggccaggtgctctcagcagcctggaggtccctgatccctggtggcccctagtggactttgttgtcctggacaacatcacagaagctggagaaataggcccgaccagatctaccttcccaagtctctccgaaggattgggtgaaggtatcccagtagggccagctctatgcgtgtggccacctatccaattgcacagggccccatgctcagaagggtcctgcaccttgtttaatactctgatgtctacatcttgaaattcttaatcatttttgagcatgggccctgtacttccattttgcactgggtcttgcaagttctgtggtgaatcctgcctcacaccctcatatggcttcaggcacaaagtttctcagccccagacgagaccccagagcgggatcctgctactgccaatgcctgtgcccctgtgaagggagggtaaaatagtcacactgggcccttgacattggagggggaagagggagagaaggtgggttgggaaaaacaggcagccccaaatctctggcacctgagattaaggtggagagagcttctgggctgaggatggtaggtttgctgggggttggggaggcccctgctgcagatacaagatcagataagcctgagagctggctccccatgctgccagccatgaggggttaacagcaaagggatggacctgaaccttcggaactgacaccttcctgagcagccaatcagttgccaggactcgtggggctgcaccgtgattggctcttgccgcctgctctgttgtatagaccctatattggagccggcagggccctgtgagttctttgcatcaaatcccccgtttcgcagatggggagcctgagtctgctctgtggatggccccgtgctaggtgttggggatacagaaacatggcaggaagacagtgccctcgtgtgcctgtggcatagaggggcgcccccttacacctcacctcgttagaaccaagctcgacggaagccctggtgagcttttaaaactgaaagttaggctgggcgccgtggctcatgcctgtaatcccagcactttgggaggctgaggcaggcagatcgcttgagcccatgagttcgagaccagcctgggcaacatggagcagaaaccccatctctacaaaaaatacaaaaattagccgggcatggtggtgcatgcctgtagtcccagcgactcgggagactgaggtgggaggatcgcttgagcctaggagggtgcggctgcattgagctgtgattgtgctactgcactccagcctgggcaacaaagtgagaccctgtctcaaaaaataaaataaaataaaaagagcctcccaaaaaacaactgaaagttaacctggcctaaatctctcctgtggctcccttcacacttaaaactcatcttaatgcgcaaaccgtgaacaacagcccccgtctccccagcctcatttaccacaccccttacccacttcactccaagtacacagactgccttgatgatctctgcctcccccgaacctcttcactcccctttatgacacccagaaccctccctgcttcctgtcattcagttccctgcttaaacatcgcctccttgaccccctgtctacagcagccccccgtctccaacctgccctctccatcccaccaccctgcttggctgtcttcataggccccccgacagcccgacttcatcttgctgctcctttgctgccactcctcctcttggatggaagctccctgaggacggggcccttatctgcctcactccctgccatcgcgccagtttctagaacagagctgagcccattcctgttgctccgtcatgactgcctccccgaccccggggaggaaggcagggctcagctctgcatggaagaatgtgtgctgctaattgaggttgaatcatttggcacttaattttcactttcatttgaaatcctctcttcggtaaactggcgaatccagcctgggattccagtggacaggatgacatcagcctccctagctgtgtgcgccaggccccaccaggttctgcctggcctctcggcagccccatccctgctcctgccgctgtgtgtgtgggtgcctcatgatgtccagtggctcaagcctctgccttagctcaggcaccccttctgttgggtattctgttccctcctgctccacctctccctgccccgtgacacctccagctgccttcatctttcaaccaatagcacggtaagggcctcccctcctggctgatgtgccagtttccccctctgttcccctctggcccctccctaagacttctccaagagggtccctccctccctccctccttccctccctcccttcctccctcccttcctcccttccttccttccttcctgacggagtctcgctgtgtcaccaggctggagtgcagtggtgcgatctcggctcactgcaacctctgcctcccgggttcaagcgattctgctgcctcagcctcccaagtagctgggactacaggcatgcaccaccacacccagctaagttttgtatttttggtagagacagggtttcaccatgttggccaggatggtctcgatctcttgacctggtgatccacctgcctcagcctcccaaagtgctgggattacaggcgtgagccaccgtgcccagctgggaccttttctaaatgcaaatctgatctcatcacctctgcctggcttggccccttgctggttccccattgccctgagaaccaagacctgactggtccgtgcccctatgacatcaatcctttctcacccccaagtcactagccatgcgtgccctgtggtctctgggttccttgaatgcaccatccttcctccgtgggggtgggcttcggtggtggtcaggtgatacctgggtgctggggccccttccacctgccccattcccctcctccactccattctagggccaggcctcagagttctacaggcactagatgaaaacatggtctctgctctctccaactccatttccagccatgaaatagcagcgatgcttaccatgtgggcctttctgaattgggtaacaggatctagccttgctctgccacccactggctgggagatcttgggcaagtcccttcctctctgtaagcctcaatttcttcatccggaaaatggggtgagggttgcccatggtggtctgtgcataaggttcctctctggtcctggctgcctgtgggtctcttaagtaagggggaccctcaggggtgtcacaccattgacacattcctgcacctgtccctctggtcctctggggaggggccctgtggcaggggcatttggggacatggaaaatgagactgcttagcttctcagcatctcccagtggggtggcttgaacatcctctgtttttttggattctcctaatggctccaagaaataggtattttcccctccacattaaagagattgaggctcagagaagttaggtcactcacccagggtcacacagccaggatgtcctggcttcccaaggaactctgtgttcccgcccaacaagaaaggtccttgacctcttcaggcctcagtttcctcatctgtctaatgggggtaacttaagatccttttgtcttggatcacatgagacttcaagacctaacatacaaagaccctcagccccctgcctggcctcagagaaggtggctgttgcttctcaaggtcccagctctttccccatcaccgtggccctgagattccagggatgacccagaggagacaggtgaatcttgtggggcttcttggcactagcactgtggctggacattagaggagagagtgtccaagcatttcccaaaagtgtgtttctggtcaaaactggaaaaacaacacaggtgtggcttttcccatcatgcctcactgtgtctccctggacagcgccttcttcctgaaatcccacagcagtgtaggtggtacccagagtaggtgcacgccagcacctgctgtgcaccagaccgcgggctggccccagggtgcagcggcaaacaaatgaggcttagtgcctgccacctgggatgctgagttccccaaggagtgctggtttaggtggggtggtagccccgacatggctggaagtcaggaaaggcttcttggaggaggtgacattgagcaggggctggagggatgagtaaaagtcagccagcctggcagtggggaggaagagaagggagagaggaaggagagtgggaagtcaggggccactgtttgcaggcactttccagacaggcgggaacagggccgtttgaggaactgagaggtaaccaggaattctgtccagggctggacaggcaaagtgtattaaaaaggctgggctgcccactttttgggggtgtgggggactcctctcaggagaggtgtcttttgtgttactctgaagtgttagcgcttctgcagcctaacattgagtagcgttctctgaggacttcctggaggaggtggtttaattcccttccacctgcattcactgggtgacaggcctgagactgtggagaataagcaggcatcggcctggcccacacagaacccacagcccttgaaggggtggagactcaccaagtgcctgctcgtggtccaggcaaagtagtcacctgagagagggaaccatgggctctttacaggtagaggacgacgaagctccgccagagaggaggacttgtctgggcagggttttgaagcatgaatagaagttgggagtgaaatggggctggaagcgtattccagagggagatacagacaggatcaaaggcttggagggctgggcagcctggagggtgtgggggccagagaccaggttggtgagaacatatggacagctaaggtgggaaggacattctgggcaggggctttgtgtggaccagcacagggaggtgggcagtgtgagcctttcccgggaaacggcttggctggtgtgcgaggggaggagtaggaggagaagtcagaggagccggaggtctcagtggaccaggtcagggcctgtgtgggggaccacagcgggaaaagtgacagtgattccctaaccctcaggggcaggcggtgagggcattcccggaggcacagctgtggcctggggcagtgagcactggtcgtggtcactggtttctggtttcttacctagttgggtcactcactggctgtgtggccttgggcaagtcactgcatctctctgagccaagttttcccttccacagcgtgggtagccagcaccttcctcgcggggatgtgtgtagcaagaactggcttgcaaaacctcccctattccgagcttggagccctgggatggccctcccagcattcgttgggcttccccgtctctgatatttgtcaggcccctcaccccgtgtctggccttccgccagctgtgggggcaggatcaggcatgtactccttggtggccccagcgctggctctgcacccgatgcatagtaggtgcctagcaagtgcatctggaggctcgttcgatggccctgcagggctctctgggtctggcgggagacattgggagtcaaggtcagtgcctcacaccatctcctcggcagcatgtgtctttctaccgtttgccgtggcccttcccatggccagtgactaacagctttcacgcacactctggggtgggctgaaaggccccggaagcagccctctttccctggaagatgggagatgaatgacagcaccctagcttcctgccttctctggggacgccctgagcacggtccgttctgtctcccaggtggccccagcaggactgagagcagcagcagtccacagccatgacaactcaaccacctgccctgtgtcagctgctgtcccctcctttattcctccccactccccttctgcagcatcctggagtcacttcccgaataaacccctcacatcacctccttgtctcagggtttgcttctggggggacccagcctgagacgggatgaacattcattcgacaaaatattgcggctgggcgcagtggctcacgcctgtaatcctagcactttgagaggccgaggcgggcggatcacttaagttcaggggttcgagaccagcctggtcaacatggtgaaaccctgtttctactaaaaatacaaaaattagctgggcgtggtggtgcatgcctgtaatcccagctacttgggaggccgaggcaggagaatcacttgaacccagggggcagagtttgcagtgggccgagatggtgccactgcactccagcctgggcgacagagcgtgattccatttcaaaaaacaaacaaacaaacaaaaaacaacaaaaagcaaacattgagtggcagcatagggagagaggtaagtttattctcatcaagactgggaggaaaagttacacagcctcaattacctttccaaaggacaggtacgggtaggaaaaggattaagagacaatctttttttcttcttgttaacttgtattacatttttaaaaaatataatgaatcagtaatgaaacaaataaagaaacccaattgcaaatgctgtgtgactttgggccagtcgcagactgtctctaggtctcagcctccgaggaatgacatggagctggaccacaattcccaggttctggggtttgagattgaccttacctccgccttgcctgctccccacaggtttgacaactattcagccaatgtgatggtggacagcaagccagtgaacctggggctgtgggacactgctgggcaggaggactacgaccgtctccggccgctctcctatccacagacggtgtgctgctcccacctgccttgcagtcctgacctttgctgtctctgttccctctgcttgggatgcccttccagccagctcagcctgggaaaccctacctctccccttaaggcccagctcagggagtctgcctgccttgcatgtcccaggcagagaagggcttcctcttgcactccctcagccctgcattggttcccggtcctcaatgtgcccatcttcccaccccattgcctcctgggctctggcaccccctgtttccagtggtggggcaggtggattctgcacagggccccaggaggcagcccagcatggtgagccctgggagtgctgggggaggggagaggtggaggatgcctgcaggtggctgctgggtcctcgcccttcctccagggtatgcagggaggcggctaaggccggtaatcagatggtggatagtatatggattggagtatggactctagaatcccagatcctcccctcaccagagtgcacgttggcaaactctttaacctctggaagcctcactttccctgtctgaggaatggggctaccagcagtgcttgctgcagagtgacatgtgaggataaccacttcgcagaggccctggcctttagtgagcgtcctaacaaacagcagcctcgtggtagaggcgagaagggtatctctgctctgcccagatcctaagtccccagcattccctggggtgttccaccctcagggagccccaagctccacctctcggtggctgccatggtgggacacctctgggccctcctcactagcaaccctcgcttgctctgtccccaggacgtcttcctcatctgcttctccctcgtcagcccagcctcttatgagaacgtccgcgccaaggtgagctggacagggtgggccttgggggctctggggcaggtaaccctgagggacagagggaggaactggtgactctaggctggtccctggggcagcagaggtcgcatacagagagggtccccagtgtcaaccagggctggcagagggacttgagggggtaagattcagaggacctggggtggggggtgctgcgatagttagctatacccccactttccatggctgcattctcctcctccccacacaacctcatgtccgcctccgattgtcacataacctcatgtttgcttcttatgtctgcacaaaacctcgcctcctcctttcctacaatcatgcgccccctccttcctgcacaacgtcgtggcctcccctccctgtgccacctcacgtctctctctcctcaccgtcgtgcccacctctgatcttctggcaacttgctgcctctcctctccctacaccctcacactccctctgatccccgcacagcctcgcgccccctcttgacccatacaaccttgtgtccccccacccacctgcccagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattggtatgggcctcgggctcagaggggggatctggctgcgggggaggccctgacttggcctcgtggtgtgattgtaaacacgggctgcagggccaggctgtgcagtttgaactcagctgtgctgtgcacttgctgtgtgaccttgggcgagtcacgtagcctctctctgcctgtgtttccttatcagaaaagcatgggatagtgatagctcctgcctcctggggtggttgggggaattcagtaacttattccaggtggagctgccagggcagcacctgtgtgtgagaagcactctgtgttagtagtagtcgtcctagtagtatgagtagtatctattaatagatactgaaaataaggaggtgtgctttgagcagacagaagcagagattgagtgggggtgctgtggttgcttggaggacaagtggcaagtcaaacttgggtgttctgggaaggcttcctggaggaggtggcgctgcattagatctaaagggtgacacatttccttccaccaccttctctcctccctttccccactccctttggtttctcagctcgacccctctttgcctccaaatcactgggctggagaaatatagtaacttctcaaggtcacccagctagtaggtggcccagccagatttgaaggaaggacagcaaattattggctcactgctggggggtgcttctttgtagtggctcagggctgcctgcatcagggaggcgatgaccatgggtctggcttcatgcatggtacccaggcctgctggctgttcctgtccctgtccctggtaggtcccaatgtgtctgtagctcagggatccttgcccaaaagcccaaaaccaccagctgggtttggtcatatgagctgtgccctctgcctcaccacaggactctgcaggcccagggtttggcccccaaattgaatccactagacctcctcccgccccaccgccccagccccgccccacctccccctgccggaactgggagggccctggggactcacatctcttcacaggaagagaaaccgcagccaccacctccctccttctgtgactagcgtggtgacacagccatcttccccgggggcctcagactatggctcacaccctggctcccttcccctgtcctagggccacagctccccagcctgcaagtctttccttttaaatatcaaggattcatccctgccttctctttctgaccaaccagcacccctccaacccctgcccctggactccttctattcagggtgcagctctccagcctgtggcctggctgtcactgacctctcccttgtaaagcacatgctttgggatcatgtggagggtgctggaggcctggattctggtcctggctctgatactgattggctgtgtgaccttgggttagtggctgcccctctctgggcctcagtctccctctccacataagctgacctggacaatccccaaaggccctctctcctccataaggtggtgactcagagttcttgccttggcctctagccagtctttcctggctgaccctgcatggagctggggcaggggcagtgattttaactgtgcctcagaccagcttaggcctagggggagtcctggggggactggcagggatagtgagggaagcagcaactgcctctgcccacctggactccccagccctgggatgacaagttttgggggcagccctgagcccagctgataatcacagctgatgtggactgagcacttcctgggagccacttcattctcacagcagctatgacgaagagctcttgtcaccttcactttacagagaggaaacaggctcggggggacatgttgctggcttaaggccacccagccaggattctgacaggggtggactggctccctaagccacaaagctgagggccatctgtcctccctgcacctccactgcccccaccgccccctcaccctccttgccctctctgtagctcccctgccccctgcctcagcttgatgagccatcgcatggcaatgagtcctagacagatgggagactgaggcccggagagggggaactgactaaagtcctagagcagtgagaggccgagccaaagtgagccctggccccccagctcaggacccttgtcctgggtgagtgggtggctgggtgccagggaaaaggcagttggtggatgtgggggaagtggacgcagatgtggtcccttataaggagacagtggccaagtgcccagtgacacctcctcaacacagggggctgtggtgaccagactccgggctgagcccagggcaccctgctcttgccagccaagccccatgacaaccactgcccatgatccctggtgggcgtatatgcctccaggtagaggggagacgcccagcatgtgactcagagcgagtgacatcctctctgagcctcaggctcctcgtccctgccccacccttcctttctccccagcacctggcctcagtgggctcccctgttccaggggctgcccctcctgccatcccgacttctccccccagctctgtgccttcgggccttggcttccccactctgggcctgtttcctggtctgtgaaatgggaactcaccccggtgttgttggaagcacccagctcagtgcctggcacagggtaggtggtgaccagcgtccatccccttccatcctgccacagagaagcaagcgggctttggcggagggcccagagttcccctcccctcccttctccttcctcttggttctgacatcggcccccaggcctgcatagcatctcggcagaaggggttttgtggtttttcacttcagggaaactgtgcagcttgaaatggacatgggaagtcacacggactctttgcagaatgtcatggaacgccgtccctgggggtgggaactaggcctgcctttctcctcatctgtgccccgggctctagccctgaggggtcttcatgtgggagaaggctgggcctcccatggcaggacagaggagctctccaatgccactcctcccagaaggcccccagctgggcccaggttgagggaatacatccagcgtgtgagtttggatgagtcgcatactctccaggagcctcagtttccttgtctgtaagacagggacggtgctaaggaaggggctgatgatgttgggaagttcctggggagggggccctgagggcttcaggcctcctggggattatttgcaaccctgggagaatcctggagggatgggcaagacaattttctagaaggtgaggctcccagagatttggtcactgatgcttgagccctttccttcacagaaaagcatcaaaattcccgccctccttccacggactaagggctatgtgtccaagaaagacacagacctgccctggaggccttagtctctcactgagttcacgctcgctattacagacatgaggaaactgaggcacggtgacgttaaactccttgctcctggtgacacagcctccaggtgaccccactgggactggatggcggcccccagagcctggtgttcagttgtatggcttgggagggggtgtacggcatggaggggtgtatggcgtgggagggggtgtatggggtgggaggggttgtatggcataggaggggtgtatggcgtgggaggggtgtatggtgtgggaggcgtgggaggggtatatggcgtgggaggcatgggaaggggtgtatggcgtgggagggggtgtatggcgtgggaggggtgtatggcatgggaggcgtgggagggatgtatggcgtgggagggggtgtatggcgtgggagggnnnnnnnnnnnnnnnnnnnnggcgtgggaggggtgtatggcgtgggagggtgtatggcgtgggaggggtatatggcgtgggaggggtgtatggcgtgggaggggtgtatggcgtgggaggcgtgggaggggtgtatggcatgggagggtgtatggcgtgggaggggtgtatggcgtgggaggagtgtatggcgtgggaggggtgtatggcgtgggagggagggtgtatggcgtgggaggggtgtatggcgtgggaagggtgtatggcacgggagggtgtatggcgtgggaggggtgtatggcgtgggaggggtgtatggcgtggaaggggttgtatggcataggagacatgttggcccagaaccccccccgccacttaggccttggctctcctgtccatctccccaaccagactcggtgaaatacctggagtgctcagctctcacccagagaggcctgaaaaccgtgttcgacgaggccatccgggccgtgctgtgccctcagcccacgcggcagcagaagcgcgcctgcagcctcctctaggggtaagagtcccccactctagtgcccaactcccatacacagcaggccctggctgagcagtggcctttggttcactgtgagtggcatttaggccaggacagaaagaaggtgggtatggaggttgcctcagtttccgcagcctacttgtcatctgcctgggccagtctcactctctggagctcatcttccagaggcaaggcccaaggtatgaatgaatgcctggtaaccccccacccccgggccagggagtgggtgtcacggagccccactctgcccattcctgcaggaggtgatggaaaagatgccttggtccctggccctaggagagcccagtcgagccagggagatcctgcacccacatatgtgggtggaggtgggagagcctgagctatgatccccagggggcagatggtggggtcagtgagttggaggcagcccacaaggcctcctggaggtgtgggaccagaaggacagagaggactggtgaggtggggagagcagcattggcagtcctggtgggagtcaaaccttgagcaaagacctggaggtgggaatgagctgtgagccaggaaggcgagagctgtggattctgcatgtccccaaattctctttccctgcttatcttccttccaggttgcaccccagcgctcccacctagatgggtctgatcctccaggatccccacccaaagcctgatggcaccccggctggccatgctgtcccctccctgtggcgtttcttagcagatggctgcagagcttcgttgatggtcttttctgtactggaggcctcctgaggccaggaacgtgcaaatttgcaggtgctgcatcccaagcccctcatgctcctgccttcctgagggccagaggggagccccaggacccattaagccacccccgtgttcctgccgtcagtgccaactgccgcatgtggaagcatctacccgttcactccagtcccaccccacgcctgactcccctctggaaactgcaggccagatggttgctgccacaacttgtgtaccttcagggatggggctcttactccctcctgaggccagctgctctaatatcgatggtcctgcttgccagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctgcactcacaggatcctgagctgcacttacctgtgagagtcttcaaacttttaaaccttgccagtcaggacttttgctattgcaaatagaaaacccaactcaacctgcttaagcagaaaataaatttattgattcaagtttggagatatcgtgatttcaggtgcagcttgatcaagggattcaaatgatgtcatcgaggcttgtttagctctgggctctgccttctgctggctggttcattctcaggcaggcgacttagggcttcatcctcccaagttcaagttcagggttcatccttccaagttcaagttcagggcctcatccttccaagttcaagttcagccaaaaagagcaaatgtctatcccaggcaaagttctaactaagatttactgtgattggaccagcttaggtcctgggcccccttttaaccaatcatatttgtcagagtggtgcagtgctgtgctctgactggccaggcatggaccatatgccatgctggaacagaactgtggcaaccccagcgaaagtgtgtgtactgggggggagggtgagttccaaagtgggctgagagcctggtgggaatttgggaatttgggcgagaaaccctcaacctccactactggaggtcatgggaaagtgttcatttcagcagtgacatgaaacaatgctggaccccgaaggtgataagcaaaggggagtttctttaaaagagaggcggggttgttgtgaggatttaagaagttccgacatgggcacaacagtgcctgcacagtcagtcccacctcaggacttgctaagttctgtggaggtgccagacctccccctcctgcggacaattactctcctctatctcaacttctcactcattcatcaaacacacatttattgagcacctcttctgtgcctggcactgttctaggtgccagggatccagcagtgctcagaagtccctgccctcaggaggctgacactctagagaggctaagagatctaagaggctgcccctgacaacccagaagaccccaatttccagcccatgaaatgcttgagtttccacattgtgctttcccagagctcccagccaaccccactatccccattagtccccatgttctgaggcaggaccccctccagctcactcacctcctgggagccccccttaaaagggattaggtgcagaggggaaacccctttgcttttcttagtttcagctcagacaaagtcatgatgttttcaaagttacttctcttctgaaacagaaaggaaatactaaaccccacccatccatggcaccatacagatgcaggcggccaggaccccactccctagtatgttcgatgtctaagatccctgaggcaccccctgaggttggccagagtctgagggagcctctttctgctccctcctcttcacagagccttgggataaactccagagcctccgcaacaaaccatggccctgaaggtctggccatcctctgcctcccactcttattgcactcgtgcctctaccatcagactggactgtcatttcttccactccacattcatgcttctttcattccaggcctttgaacatactggacccctttcctttgctcctggaacttccctgcagggcaaaggtgggcccggatctccttccatgtgtgttcagcccgttaggtcgaccccagtagagacaatctttgcttctatacgataataatgtcagtaaataa

SEQ ID NO: 14778 - DNA, 22281 bp, Human
ctactcaggaggctgagacaggagaatcacttgaacccaggaggtggacgttgcagtgagctgagatcgcgccactgcactcccgcctggcaacagagcgacactccgtctcaaaaaaaaaaaaagaaaagaaaagaaaaaaaaaagaatgtggcagagcctagacttcaggtatattttctaataaaggagacatactaggcggctaaggaaacctatgtcaggtagaaaggatctgaggtttgaataaagtcatgccctcagattatctttcattgttttaaaattccgaaagaaagacaccaggaggaactccatagcctgggagttgctgagaggacagcactgttatctactgtagtaaagcagttcctgagtcgtcacttcagaatcacagctaatgcggagctcttgggctccagcataaacatatccgtataatctatcaaaatgagacccagaatctgaatttttaaaaatactatcctggtcaggtgtggtggctcacgcccgtaatcccagcactttgggagaccgagacaggaggactgcttgagcccaggagtttgagactagccttggcaacatgatgagacttcgtctccacagaagtttttttttttttttttaattagccaggcagccggacgcagtggctcacgcctgtaatcctagcactttgggaggccgaggtgggtagatcacctgaggtcaggagttcgagaccagcctggtcagcaaggtgaaaccccgtctctactaaaaggaaaattagccgggcatgttggtacacgcctgcaatcccagctactcgggagactgaagcaggagaatcacctgaacctgggatgcggaggttgcagtgaactgagatagcgccactgcactccactccagcctggaagacagagcaagactccgtctaaaaaaaaaaattagccaggcatggtggcatgcacctgtagcctcagctgctccgcacgctgaggcgagaggaccactttagaccaggagttaaagaccagcccgggcaacatagtgagacgctgtctctacaaaatttttaaaaatcattagctggccgggtacggtgactcatgcctgtaaccctagccccagtgggtggactgttgagctcaggagtttgagaccagcctgagcaacatagcaaaaccccatctctaccaaaaatacaaaaattaggcaggcgtggttgtgcgtgcctgtgtacaccaacgactcgggaggctgaactgggaggatcgcttgtacctgagaagtcgagggtgcaataagccgtgatcctgccactacatttcagcctgggcgacagagcgaaaccctgtctcaaaaaataaataaaaataaataaaaacactgttccagaaatccctgtcctacaattaagtttgagaactgcggaagtatggtttgaactctggcggttagaaccctaaactaacagtctgatctaggcaggtcacttggcacttctgagcctcagtttccacaactataaaggcggaggagtaacaataaggaccgcctaagacaccgacggacctcccctgcgctgagtttcacattaagcaggcaggtagaacaggcggggagtcgcgggtgacggtgggatacatgggggctgaggcgcgccgcgaagcattgtgggacacagaagggcgccagccgctccccgcctcgagcttcgattgcgcggccgccaagtttcagtgatgaacgccctctttgggcgtccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcaggtgagcggcgtgtttcataggttcctgcggccctccggagccggttcggactaggtccagccttcggggggcctcccggaagagacctctcttagtcccttcctgctgttgccgtccctccgctgggcggggcaggaatccactttcgggggccccgcgtcccgcacgctactgaacgcgggacacgaccttgtgggtgaggtccttggccctcggccctgctcagtgcccatgagctgggtgaatttgattgtcacttaactcacctgggttaagacggaggggtaacaacaaagtctttctgaagtggccgaaaactccctgactttttgagtgaggtcttaggggtaccaggctgagcggtgtttggcccctgttcttaggaattcacagtgcataggttatctttccttttttgtgaaactggaggctaggatagagaagtagatttgatctctgatcttaaatctaccccaccccctgttcagcgatggacggcttatgatctgtagtggcctgccaaccacagagccccttctgagtgccctcttggaacctccctatcctgcccctgtgactagtacagctgttacttcgtttttgctgagcggctcagtttctcctcctggttccgctctgctcttaaaaaaaaaaacatttattaaagccagggtatctcatccctggctttccagggaggtgatgcaggtcgagcctcgggcctcttcccttcttgagcttctgacagaacccgattttttaaagtgtgttttgagactcgttgtcttggtattatgatgtacggtctcaaacccctgatctttgcgggctgctgcccagctgtaatataatggaaagaaggctggactgacagcaggcaaccctggaaatcaaatctgttttgaaatgatgaggtcagctgcttgagtaggctgagcttcaaatttttgcctctaaagtaggggtgggggggtggtcaatggtgttaaattatctggtatagggcctaacacgtaggagctcagcaatatttatttaatacaaattgttctgagaccaccaccctttttcttctgtcctcttcctatagtttctattagaaagatgaaacttctaggttcatcctgtgttgctgtcacccaaatgtcatctctgaaggaagcctcaatctccccagcatggggctttgaggagagtttactaagttcagcatacctgttcttttgattgctctccagcctccaagaaacatttgatttttgtttttttgagacggagtcttgctctgttgcccaggctggagtgtaatggcaggatcttggctcactgcaacctccgcctcctgagtagctggtattacaggtgcccgccaccacgcccagctaatttttgtatttttagtagagactgggtttcaccatgttgaccaggctggtctcgaactgctgacctcgtgatccgcccacctcggcctctcaaagtgctgggattacaggcgtgagccaccgcgcccggcctccaagaaatacttgtgtagtgaattttcctctaggaactcgccttctaagcattttcagaaggttacaacggaagataaatgcataggtttttttatagaagtgtcgggcagccatctgctatacagcgccggttttttaattcccaagagggctatagcattatgcagagtgcagactctggggtcagactgctttggttcacatttttcatccactagcatttcaactttgggcaatttcttcatttctctgtgctttggttttcttatctggagagtgcggataacattggctcctacctcacaggattgttggcaggactgtatgaatgaatgagtggtaaacagtaagaacagtgcctggcagtattcgtgaacatttaacatggcaactttgggcctgaggtctgtggggacctccttggccctctggcagttcttctgcctggctttatgtccgcttgcactgcacacaggatttgcgttgatggcagaaaattgaaacaatgagaaaggaaaattgaatttcaggatatacttaaagatctttttttctcagcactctatatacataaatgcacttttgcaagtctgaatacttgtgtggcattatacaaagtgcttagaacaaggatcttgtttattttgcagatggaaaagactaaggtggctggacgtggtggctcacgcctgtaatcccagcactttgggaggtcgaggcgggaggatcatttgaggtcaggagttcaagactagcctggacaacatggtgaaaccctgtctccactaaaaacacagaaaatagccaggcggcgcttgcctgtaatcccagctactcaggaggctgaggcaggagaatcgcttgaactcggaaggcggaagttgcacgccactgcaccccagcatgggtgacaaagtgagactctgtctcaaaaaaaaaaaagaaagaaagaaaagactactaagtcttagggaagttgagtttgtatgaattggtgaaggtatatctcagaaccaaaacaaggttactatatttgaaaaaacattaggacattttatcaaatctgacaccattaaatttttttaaacacttatgtaacacagaaaaagaaaaactaccaatcaatacaacaccctgtcaaacacaaggtgcagcctcattttaaagatgttacagtaaaaagagagtgtcgtggaattaatgaaatatgaaaaatcagttttgtttgcattcttctcagttttaagtacatattcacagtataattaacaaaaacagtagtagtcgctcaacagttgagggttccattttgcgtgttgctttttgagttctatcatttatgtctttgcttacttcatatggagggtgttttgtactctgaggccttcgttcatgccgctactcacatgatttatatttttcagattttggaagatggcaaagttcatgacacccgtgatccaggacaacccctcaggctggggtccctgtgcggttcccgagcagtttcgggatatgccctaccagccgttcagcaaaggagatcggctaggaaaggtacatgcctgtcagcaggagtctgaatctttgcagctgtggctgctactctcgagtccctgtttagattttattgtctcaaaatcttaactcctgaatttcttatagggatgccagctgagaaaggttatctctgggtgtagtcatagaagagctgggcacttacagaggtgttgtgaacaaattctgagactcttccacgctgtcctctcgcgctcagggatttctggttctgcagaaacttgcctggttgacctgtgcattctctgtcttttcttgttcttcgtaggttgcagactggacaggagccacataccaagataagaggtacacaagtaagtgtttctgcaactgaatgccccaatcagggccttgggaaagttgttctttattctaatgaccttcttctgaaagctttttagaatgggaagaaactgccaacaataattcataacttttagggatgtattctgggctttaacaataaccacatttttggaaatagccctcaaaacttagaccattcattaaagaggtctagcctattaaaatggggttttgggcccttttaaaaacctgttgaaaacattagctgggcgtggtggcgtgcacctgtaatcccagctactcgggtggctgaggcaggacaatcacttgaacccagaagttagaggttgcagtgagcagagatcatgctattgtactccagcctggtgacagagccagatcctgtctccaaaaaaaaaaaaaaaaaaaaaagtaaaacccctggttttaagatcctggtaccataaaaaggctttttctctctgccacttcagatagttggaggtggctgcctggagaactaagttaggatagctgaggctgagattggcaagaaagtatatcgtgatctattagacatacctgccatgggcccctgataatggagatggtggttagcaataaatacctcagattctcacacaataacgcagagagtgaaatgggttagtttgagtccttcagattcttggcttagaaagttctttaggccagagttgttcaaaattgaatgtgcatatgaatcatccggggatcttgttaaaatgctggttctgattcagtgggtatggggtgggactgtgagtctgtgtgtctaacaagctttcagccaatgctacaggtctcaagaccacacttgaaatagcaaggctttagactggtgcatatctggtaaagtctgtgggtgcagttactacatgccatcacctttgcctccagataagtactcctctcagtttggtggtggaagtcaatatgcttatttccatgaggaggatgaaagtagcttccagctggtggatacagcgcgcacacagaagacggcctaccagcggaatcgaatgagatttgcccaggtaggccaagagccagcaaccacaccatcttggggctgttactgttggccatcacctgctaaaaaatgctaccttgtgactcctaatgagagagggaagcatattataggtcttttcgtgaatctcgggtcaccgttccataacaagtggtaccaaggtgaacttgcactaggatcagggatgcatttaaatagtttatatttctgtttgccagtagctaggacatcagacttgtatgctaaaaacatttgtgctggataagaaggtgcacctgtgcctgttaccacacttaattgctgtgtgcagactttattaagtagatggtccagtcagattgcctattattatttaaagaggcaaactcagaaaatctaatgagacccagtaaacatacttcaatgaaaaatatatcatgggagtataggtctaagcaaagtccaagcacttaccccctaacacccccaagctgttgatgccgtagagtgaaagcacagagtaagatgtgaaacttgggatttggcatcctaaatttactccaaagacctcccacttgttctgcctattgtgagccaaatctccaagattttaacatggatgtttcttgctgatgcccagaggaacctccgcagagacaaagatcgtcggaacatgttgcagttcaacctgcagatcctgcctaagagtgccaaacagaaagagaggtgagattttcatcctgctggaacaagacacccttcccagactggccgtatttggaaaccacaggaccaaagcaggaggatggttgtattccccaccactgcaaaaaaggaaaatactttctacaaccagttaagcccccttttagcttgtcgttctcaggctggttcatggcagatagcatgggcaggaaactaactccttgtgctggtcatgcgcactaaagggaaacacaggcaggcaagaagaggctctggagcttacctgggctcagttctgctgtgggtcaactctaggaagccccctgtatgctggtcctttgagcctcctggtgttgtgtggtccagcggccactacaccccagattggaactatcagtgaacagtcactatagatgaagtaaaatcatctggtcagtatttggaggcagtgtaccttttctaacacctccagtatgcaccgtctgggtctcttcctttctctaagcccatttttcgtagtttaaaggagttagtggtgatggtaaggtttagctgaagagaatggcagcgtgtgccttttgaagaagccactggtttaaaggtctgcactgagatcatatgtctgtctttccagagaacgcattcgactgcagaaaaagttccagaaacaatttggggttaggcagaaatgggatcagaaatcacaggtaatgtatttataccagaattctgccttggaatttggttctgtttatttggttgtctttattaatagcttagatgagatatacttcacataccgtacaatttagtggtttttaatatatttgaagagttctgtaactggtcaatttcagaccattttcatcaccctcaaaagaatcccttaccctttagcagtcaccctgtcttgatctgttttccgttgctagaacagaatacctgagagtgggtaagttataaagcggtttctttagctcatggttctggggactgggaagtcccagatcaggagccacatctggtgagggcctcatgctgcttgatagcatggcagaaaaagcagaagcgggagcagggtgcaacagagaaaagggctaaactttgggtagttagcccattcctgagagaagggcatgaggcatttattccttttaacgacctaatctcttaaaggccctacctcccgacactgccgcagtagcaaccagattgccaaatgaattccaggaggcacacccaaacaccagcacccccagtagcccagcagtaggcagctatgaatctgttttctgtctcgggattttttgttctagacattttacataaatggaatcatacaatatgtggtctttagtaactggcagcttttatttagcgtgttttcaagagtcatccatgtggtagcatgtgtcggtacagttttccttcagtatatgaaagtctacacattctcaagtcccacattcggcctgtggtagccacatatatgaaaagtcggccctccatatactcggggtttgcatcccaagaatactgttttctttttcttttcttttttgagacagagtcttgctctgtcacccaggctggagtgcagtggcatgaatcttagccaactgcaacctctgcctgctgggttcaagtgatcctcctacctcagccttctgagtagctgagactataggcatgcaccaccacgcctggctaatttttgtattttctgtagatagggggttctgccatgttccccaggctggtctcaaactcctgagctcaagcagtccacccacctcagcctcccaaagtgctggggttacagccatgagccactgcgcctggcttgtattttcaatccatgtttgtttgaagaaaatctgcatattaagtagacccatgtacttcaaacccatgttgttcaagttcagctgtgcttcatctgttgttggtttttttggtttttgttttttgtttttttaagatggaatctcactctgtcacccaagctgcagtgccagtggcgcgatcttggctcactgcaacctccgcctcccgggttaaagtgattctcacacctcagcctcccaggtagctaggattacaggcacgtgccaacatgtctggctttttttttttttttttcatatgttttgtagagacagggttttaccatgttggcccggctggtttcaaactcctgacctcagatgatccacccacctcagcctcccaaagtgctgggattacaggcgtgaggcaccacacccagcccagatgagcttcttttcttgtttattgccaaataagagtcctttgaattatacatcatgttgttttgagccattcacatgctgatgaacatttgagttgtttttcactttttgactattattgatgctgctgtgaacgttcacctgcgtgtgcttgtgtgggcattctgagaacagaacacatgtaagcaaaagtgaagctacattttgttggatatgatgctgtatcaagaatagttaataacccgagagaaatataaaggaccttctacatgttcatcaggtgacatcattacctgggagtggaaccccatttgcttttgaacttttgatccctttggtcctcttccacaccataaattcctgggagtcagggattctgtcttataaaacagtcagcactccatttattgaataaaagctctttttcttttctctcttttattgagacgcagtcttgctctgtcacccaggctggagtgcagtggtgctatctcagctcactgcaacctccgcctcccagattcaagctgttctcctgcctcagcctcccgagtagctgggattacaggcatgcatcaccatgcctggctaatttttgtatttttagtagagatggggtttcaccatgttggacaggctggtctcgaactcctgacctcaggtgatctgcccgccttggcctcccaaagggccactgagcccctccgttttatgtggttgttgtttgagacaggatctcgtgtcactcaggctggagtgcagtagtgcaatcatagctcactgcagcctcaaactcctgggctcaagcaatcatcctgccccagcttcccaaagtgctgggactacaggcatgagccactgcaccaggccagctcttcatatttttagcctgtcttttatttatgttttgtatggactataacttttttttcctctaatggttttcaactgcagaaaccccgagactcttcagttgaagttcgtagtgattgggaagtgaaagaggaaatggattttcctcagttgatgaagatgcgctacttggaagtatcagagccacaggacatgtaagcagcatcttttactactttctacactgctcttatgtgtgtggaccagctggtgatgggtattttcttaagccctagtatttccaaaaaggctttgaagccacttactcaaaacacatttcataaggttaacagaggtatttgaaaaaaatcaagaccggccaggtgcagtgggtcacctgaggtcaggagttcaagaccagcctggccaacatggtgaaacccagtctctactaaaaatacaaaaacttagccgggtgtggtggcacacacctgtaatcccagctactcaggaggctgaggcacgagaatcacttaaaccctggaggtggaggttgcagtgagctgagatcttgccattgcactccagcctgggcaacaagagcgaaactccatctcaaaaaaaaaaaaaatcaagaccaaggggaaaagcagaagttcactgactgcaaacttctttttaacttcctggtatcctgaggaaagaagaaatgagttatacaactcttttggcagaaagagaaagcagaatggaatttgctgattattaaactgtatatttctgtttcctggcatcctgagcaaaagagcaataagattaagttataaaactcttgtcaggaaaagaaacacagcaattcttcaggaggaatctttgcttctcctgacatttcaaatagcttcttacctcaaaggacaagtaggtggaatttaggtagtgggaaaccagagcaccagacgagaagtcagcctacccaggtgcttctataactagtcatctcctgtcttagcctcggtcaccctacctttaaaatgggggcgttgggctagatgagttgtgcttgctgtgttctatgccaggtgttaagtggacaggaactgagcaagcactgaggattcgtctctcctgctctggccagagattgctttccacctcttttagacttttggataagacttctggatgtatggcttaaaagaaaaaactgggggttatctctcttactttgcatgtctttgcctgctcttcccacagtgagtgttgtggggccctagaatactacgacaaagcctttgaccgcatcaccacgaggagtgagaagccactgcggagcatcaagcgcatcttccacactgtcaccaccacagacgaccctgtcatccgcaaggtgtgcgcctccttctgcccctctcccccttgttaggaatgctgtcggcttctacagctgaagctgcagaaagaacagaagacatgggaataacgtatgtattataggtaaaagcactttgccaggtagaccggaaatgtggatgttaagcacagctggacttgaagcccagttctgccgcgcttcctggcttagtctctggagccttagttctctcatctgcaacaaggggtagatgtacatagcactaccactggggcaaaggtgaaagcatctgaagcacttggctggaatctagcaggtgcttagggtgctgcagtgccactgccacccgaaacttgctggctcactggctgcagtgtttttggtcaatgaggtggggcctccttattaaggatttatgtggtcagcaaaggagttctttcccatccatgtgagtgggcagtgagacctgggagtgtctttccatcttctctctttgatcctctttgcagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttggtaagaagcgtgcctggggagcaactcaaaggcattgagtatttttgttggtacagaacaagtctctggtactagagaatggatagaaagtggtctgtcttcccaagggaattgacagcagcagtgtctgaatctcccacactctttagaggttaggagaagagactgtcactgcagtacctgcttgaggcctcagcttttggagtcctcacagcaccctaatagcaagcttccaaatgttgcttttttgttgtttttttttttttttaattgagacagagagtctcactctgtcacccaggctggagtgcagtggcgcagtcttggctcactgcagcgtctgcctcccacattcaagtgattcttctgcctcagcctcccgaatagctgggattacaggcatgtgccattacgcctggctactttctatatttttagtagagacggtttcaccatgttggcgaggctggtctcgaactcctggcctcaagtgatccatcagccttggcctcccaaagtgctgcgattagaggtgtgagccaacacacctggcccaaatgttattcatttaaatacccctttttcgacttttgccatcttgcataccttgttcagtgtttgcttactgtatatacatatatattttttataccatacatatatgtatttatacaccataaaggaaaaccatgtcactcaaaaattaacaaaacaggctggacacggtggctcacaacctgtaatcctgccactttgggaggccgaggcggagaatcacttgacatcaggagatcgagaccaagcctggccaacatggtgaaacccagtctctactaaaaatacaaaaattagccaggtgtggtggtggacacatgtaatcccagctacttaggaggctgaggcaggagaatcgcttgaacccaggaggcagaggttgcagtgagccgtggacacaccactgcactccaacctgggtgacagagcaagactccatctcaaaaaaaaaagtgtttatattctgagcctgaagcctgaggtctttattaaaaagcttgcaaaatcattctcttgaggaatccaaaacgactgaaaagggacagcttcgttactgtgtgattgaattgaatgttggacagtatcttgagttatcctggagcagctgccccactcccccgcttatgtgttccacaccagggagacccactttaggagagggcagttctttgaaggaaggacttgtgttgtttgcctctccacatctccccacagcgctgcgcacattgtcagtgactctttgttgcatggtgagtgaccatgccacgcttttgcagacctcctgacagtgagtgagactgccaatgagccccctcaagatgaaggtaattccttcaattcaccccgcaacctggccatggaggcaacctacatcaaccacaatttctcccagcagtgcttgagaatggtgaggaaacgagtctctgggcattgattcattcttatttaatcagctgctgtttgtggagcatctgctttgtgctaggctcttggttgtgggactgagcaggtcagacgcagtccccacctttagcaggggagttacatgcctgggcttggatgttaggctctctgactttgaacaaagttcctgcccttacagaatttaatgatagtggaggaggaaacacagtgaacaataaataataaattgatttacatcaaatggtgaatatatgccatggcaaaaaaatgaagtagagatgagcatggttactaagtcattgttctaattcatcaggtgctaacagttgggaggggtcaagtaggcacaaaacaggcagcgagctcagagccccatcaagggccccaggaacctggccagggctgcaactaagcagaggtgctgggtctgactgattggccttggccttgtcaacaaagttagctctgtcttgtgacacctttgtttttgcaggggaaggaaagatacaacttccccaacccaaacccgtttgtggaggacgacatggataagaatgaaatcgcctctgttgcgtaccggtaggtcacctctctggtgggtattgtggccagactggagcacgggccccactctatagaatccccagtgaccacatgagtttcttttttgctgcagttaccgcaggtggaagcttggagatgatattgaccttattgtccgttgtgagcacgatggcgtcatgactggagccaacggggaagtgtccttcatcaacatcaagacactcaatgagtgggattccagggtgagccgccatctccatcaccctcctggtgacaccatgtctctattccctacagtgcctgtttacgcaggctaggttgtataaactgtttcttatcccctttcgttacttatagagctacctggatgtttttttttgtcttgtgagttttttcctctgcttagttccttgctgagaaagagcatgactgtgtgtgtagaactatgttaagtgttaagaacttttctgcttattttttacgcaggaaccagttaactcccttcttccagtactttcttcatctctgttccattgtggcctcctgttgacttctgctccctgagcatctgattttttcctctccttattatctgggttggcagttttcctgtaagtctggccgctcttctttttgacctcttctttcattgactgagccactgccttcaatcttttcacacattttttgcaattcctcatttctttaactcatggattctaagatctggctcagaattgactcttcagaggcaccttgaaagaaacatgcttccttcacttttcctcctctatttccaccccacccctcccaatccgcccccccgcccacatcacctgttgaaagagcacactggaaggtttgccgctctggggccagcggccttttcttggatttttcctggtgagctccccaaagcattcagggccgtcgtgcctgtgtcgttttgccgtctgtgttaccgcgttactctggtctcacccgtttccctgttccgtttgcatgtcgtctttgctggctcccctcctttttgatcccagtggagtcacctggacagctctcttcgccatacatacttctgtattatataactttgtattagttttctttcgcaccataacaaattaacagaaacttaatgacttaataccgatttatgtattttacttttattttttattttatttttctgaaacggagtttcgctcttgttgcccaggctggagtgcaacggtgcgatctcggctcactgcaacctctacctcccgggctcaagcgattctcctgcctcagcctcccgagtagctaggattataggcatgcaccaccacacccagctaattttgtatttttagtagagatggggtttctccatgttggtcagactggtcttgaagtcccggcctcaggtgatctgcctgcctcggcctcccaaagtgctgggattacaggcgtgagccacagcacccggcctaacaataccaatttattagctcacggttttgtaggttagaagtccagtgctgtgtgcttggtccttgtattagtccattgtcacactgctgtaaagaaatgcctgagagtgggtgatttataaagaaaagaggtttaattggctcacagttctgcaggctctagaggaagcgtggctgaggagacctcaggaaacttgcaatggtggcagaaagcaaaggagaagcaggcacatcatggccagagcaggagaaagagaggggggaggttggtatacacttttaaacaaccagatctcttgaatactcttaccacaagaatagtgccaaagggggaagtctgcccccatgatccagtcacctcccaccatgctcctcctccaacattggagtttacaatttgacatgcagtttgggtggggccacaaatccaaacaaggcagaaatcatggtgtcaatagaaatagaactgagttctcatctggaggttctgaaagaaaagccacttccaagcccattcttattgtgggtaaagttcatttccctgcagttagatgactgaggcccccatccccctgccagttgtcagctgggagcctctcttggctcctagaggccacctgcattccttgtcacatggccccctccatctccaagatagcaacagcacatcagatccttcttgtgcttcagatctctgacttcctccgtctccgacctctacacctagatttaagagactcatacggttgggtgagcccagccaggtagtgtatattaaggtaaactgatttgcggccttacatctgcaaaatcccttttgacatacaaggtaggatgatcatgggggtgatacttgatcctagccataggttctgcccgtagtcaaggggaggagactctgcaagggcaagggtcactgggggtcatcttagaattctgcccatcccaggcctcaaccatgaactctttgaaaatgatttctcaaatctactctgatttattatacttcccattgtttttctgctaaaacaccttccccttccatgtgtccccagtcccgtcattgcctctgggccagctgtccatcagcattgtctttcttccacctaagctctgagcctccaacatctccaacttcttttttacattattctgttttgctgttagcaaaatagaaggctttgctgtcttctgaatctgtcctggatttcactgataattgccctagttcagggccccatttcatcatgcctgtttgacatttgtctcctaactgatttctctacctccacccaacttctatatttgatttatctccgccagtcaattgtccaatacacgcttcatcagcagtgcagattgggagaagaattctaacatgccccagcaagctgtatgcagtagtatgcacctatagtcctagctactcaggagcctgaggtgggagaatcgcttgggttcatgagttcaaatcctgaactcaccagcttgggcaacatagtgagaccccatctccaaaaaatgtgccacagcaaactcacaggagtgctgcaggatattttaaattttttagggaaacacagagacatcttgtcagaatactaatacatggtttgaccctaactaaataaaaggaattcttggccgggcacggtggctcacgcctgtaatcccagcactttgggaggccggggcgagtggatcacctgaggtcaggagttcgagaccagcctggccaacatgatgaaaccccgtatctaccaaaaatacaaaaattggctggacatggtggcgggcacctgtaatcccaactactagggaggctgaggtaggagaatcacttgaacccgggaggcggaggttgcagtgagccaagatcgtgccactgcactccaccctgggcaacaagagcaaaactccgtctcaaaaaaaaaaagaaaaaaaatttaaaagaaattcttgagtatttcttttgccctgtgtttgccatgaaccaagaaagtttgggaacctctgtcatgtgacctttgaccagtcatttcactctgggtccaacttcccacgtctacaaatgatatgggtagaaaagaggatctctctggggtccttttctactgtgtgtgcatttatgtaaaatgtcagactcagctttgcacccactgcaggcttccacccccatctaaggccaactctgcctgtctttcctatcccaccatgcctctcagatcaagacctcctggctacacctgcacttgagccaatattctccacttggctcactgttacacgtcctctgtgaagcccttccttaccacgcaacacatagtaaacacttggctctgctgtttatatgacacttctaaagtgtgtgtgtgtgtgtgtccgtgtgtgtccatccatcattccctgtctaggcgagcttttagaagagaggaattgtaagtcgttgagtgactgctgtgcggcaggctgtgcaagggaagggactatgtctttgtctcttaaatggtaagatttagtgcgtacctacccactttctaagcaagcagactagggagttccttctctgccagaggaggtcccagcaccttgggcatttggagcttgcttctgtttctctaacggggctctcctgcagcactgtaatggcgttgactggcgtcagaagctggactctcagcgaggggctgtcattgccacggagctgaagaacaacagctacaagttggcccggtggacctgctgtgctttgctggctggatctgagtacctcaagcttgggtgagattcctgtgcaggagctggcagctgatcttgtgaaaggaagggtctgggtagggaggttgaccctcccctccccgtgtactggacaattgactggcagagataaatccaggggtggggtagagatggaggggtcagttaggagacaaatgccaaacagcaggcatgctgaatggagtcctgaactagggcaatggtgtcaatgaaatccagaactgagaactcagaagacgatgttttccctttcccttgaaaatagcagtggactgccgggcgcggtggctcatgcctgtaatcctagcactttgggaggcccaggctggcagatcacgaggtcaggagatcaagaccatcctggctaacacgatgaaaccctgtctcaactaaaaatacaaaaaattagccgggcgtagtggcgggcgcctgtagccccagctactcagggggctgaggcaggagaatggtgtgaacccgggaggcggagcttgcagtgagccaagatggcgccactgcactccagcctgggcaacagagccagactccgtctcaaaaaaaaaaaaaagaaaaaatagcagtggaccaggtatcaccatttaattgacatttgatcccaagtgttgctgtctctgtgctgccctgctctgaccactgatatcccttcccctgttagttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaaggtgtgtagcagcccactttctgaggtctagagtgatctgtgggctagcacgggagcaagctctgtagccattgtgatctttaaccttgataaaacttcgagaattccctgagacttaagtatgaagaagcattcactttggctccaagagcttcttctagagcctttagatcacatcaagtggttggggaggatagcggtgttttagagaagcggctggactgtggcagaggtagaggaagatgagggaagtcccagattgaagccggtggtctagagggaaaagctccgctccgggttaaatagcctgaaagttgtctctcctgctccaccagctggtgactgaaggaaatacctgcccagccctgtgagcatctgaaaggcttaacttcggaatggaagtgttgaaaactcacgcacagtccagcagaggttcagaaaggaaagtgaacgtcatatcacacaacctggctcatttctcttacattttttgtgtctttcagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctttccctcatcgtctgcctgcattaacgatttacagtcgtttcttcaaagattcctgacagagtggggatgagattcagcaatttctatgtggaattcagaatctgggtgtcctcatttgttataagaagtccatttccacaagcatgagtgcctgctggctgtgtgaagggccacctgttgcttttggagagttcactgtgaggagctggagtgcagagcactagtacagcgtgaagcagggtgtgggtgaggtggggctgctgcgcctgagggaggctgccacagagagcttgatggatgtcccactgggtgattgtgtaatggtttatgaattgtttttaagcttggcttgggctggtgacactcaggcctgtccctacaaagcattgtgtcataagagctctgcatgttgaggatatgtaaactttttttttttttttttttttttttgagacggaatctcactttgttgcccaggctggagtgcagtagcatgatctcggctcactgcaacctccacctcccaggttcaagcgatcctcctgcctcagccccccagtagctgggattacaggcatgcaccaccatgcctggctaatttttgtatttttagtagagacggggtttcgccatatgggtcaggatggtctcgaactcctgacctcaggtgatctacccgccttggcctcccaaagtgctgagattacaggcgtgagccaccgcacccagccgaggctatgtaaactatgtaagtggacactgttctgttctggacacttgatggagtaattaccctgccaggtattaatgctgagctttctgtagtatctaagcctcatacagaactgtgatgctggcaggagtagtaccattgtagaggtgaggaaacaggcatggtggctcaaacctctaatcccaacactttgagaggctgaggcagaaggatcactttagcctagaagtttgagaccagcctgggcaacacagggagaccagggcctgtctctgcaaaaaaataaattattagccagtcatgatgcttccacctgtggtcccagctactcaggaggctgaggtgggaggattgcttgagcccaggagttcaaggctgcagtgagctatgatcacaccactgcactccagcctaagtgacagaaggagaccctttatcaaaaaaaaaaaggccaggtgcagtggctcatgcctgtaatcccagcactttgggaggccgaggtgggtggatcacttgaggtcaggagttcaaaaccagcctgagcaacatagcaaaaccccgtctctactaaaaatacaaaacagccaggcatggtggcacacgcctgtaattccagctacttgggaggctgaggctggagattcactcgaacccaggaggcggaggttgcagtgaactgagatcacaccactgcactccaatttggattacagagactctcaaaaaaagctcagcatttctaaagttacaggttttttttttaaagtagcttgaaaaaacacaaaattaattttaatgaatcgaacctcagcaagcaaaaggtttcttgaactgtgttagaagcagtggagagaaaaagtgtacttggggagttttcaatgtgaatacagagtgttaaaaaacagattaaagtggtgtgactagtgccgggggtttccaggttggaccagtattcaccaaattgcctcttgcaaaccatggccctgtccaacaggattaacagaagcaagtggaagtgactcaagctcattccctgaaaatactttgcatcagtttccactgcctttttttttttttttttttttttttgagacggagtcttgctctgttgcccaggctggagtgcagtggcgcaatctcaggcactgtaagctccgcctcctgggttcacgccattctcctgcctcagcctcccgagtagctgtccactgcttttatctgtcctgcatggggctaccaagttgactgctgcagtaatcctacattcagaa

SEQ ID NO: 14779 - DNA, 5920 bp, Human
tagctgggtgtggtggtgcatgcctgtagtcccagctacttgggaggctgaggcatgagaattgcttgaacccaggaactccggaggcagaggttgcagtgagccgagattgcaccactgcactcaagcctgggcaacagagagagactcagtcaaaaaaaaaaaaaaaaaaaaaaaaaagctgggggtggtggctcacgcctgtaatcccaacactttgggaggctgaggcagggagataatgaggtcaggagttcaagaccagcctgaccaatatggtgaaatcccgtctctactaaaaatacaaaaattagccggatgtggtggtgcacgcctgtagtcccagctacttggaggctgaggcaggagaatcgcttgaacccgggaggcggaggttgcagtgagcccacatggtgccactgcactccagcttgggtgactgagcgagactccatctcaaaaaaaagaaaaaaaatttttttgaaaataaaaaataaaggctgagcatggtggctttatgcctgtaatcccagcactttgggagcccgaggcaggtggatcacgaggtcaggagttccagaccatcgtggccaacatggtgaaaccccatctctactaaaaatacaaaattagctgggtgtggtggtgcatgcctgtaatcccatctacgctggaggctgagacaggagaatcatctagaacctgggaggcagaggttgcagtgagctgagatcatgccagcctgggtgacagagcaagactctgtctcaaaggaaaaaaaaaaaaggaatgtctagatgcagtagctaagtacgcagaagccatttcagtgtgggaggcgaggtgactgaatccagggactccaggtttctggctgaggggttgagactgcccatggtcattgtgatgagatgaagacagaaaatgagctgggctgggggaaggtggtcatctcctctggacgtgattagtttgagactcctgttgggtagcccactgggcatggtcagcaggaaattgaggagctgagagggtttggagctgagatagactccagcctcaccatgtgggcaatagtgggggtcacagagtgtgaagatggccaagaaagaggtctgggtgggggctggggagtcagcagccaggcatgggccatggagaaacagatgccagggtaagaggaaaggggagtctcagaccccaggggaaaagagtcactggaaagaggggccagtcccatgtcatatccagcagagacaccaggtacagcagaaggaccttggacatgaccatgaggagggccttgttggccatgacctgggagagatgggggtgagagcctgggggaccacaccatgtccccagcacacgaaacagtgcctggtagacagaatgtatttatggatggacggacaggtagatggatggatgaatggacagatgatagatggatgcaaagacagatgaatagatggacagatgcacagatggacagatggatggacggacagacggaatgaatgatcagaaaaggcttcatgaacaaagtgagactgagctgcatctccatgggtagatacaaaagcagaggactctcctcttgagtcaggaatgacccagtgtcctggtccagggaggaagtcagcctccttgactggggacacttgtggcagatttcagaggcccttaaaatgaggccaagtgaggtggacaggtccgagccagctgaggactcctcagccacacggcacagctgcctgaggggatgtgtcactcagggagttgctgggacctactgggcccagcgttgccatcagcaccaacagcttcagagagggggacacatgccggggtgactccaaggctgtgggcggcacctgcctcagatagagaacaggcacagagacactactgggggacactactgggacactggccacccccctaccctgtgcctagatcacagcctacacactgcagccctgtgcccctcacacccagcaggttcctgctccagcgcggctcctggactggccccgggtgctggccccgggggtttcaatccaagcataattcagtgaagcatgtgtttggcagcgggacccagctcaccgttttaggtacgtggctctaacttcccagcctgtcccaccctctcctgtctctggaaaaatctgttttctttctctgggtcttcttcccctctggcctccaggccttaggcatgaaaccctccctttctccttggggtctgggggaagtgggctagtctcaggtcaactggcttgaagggcctctacagtgggagcagccgccttcaggttccaacagtgggacacagcctggtcccgggacctgggctgggattgggcggggtcagtgctcctcccctctcccagggcaagtgtctgagtgagggacagaggccggttctgataaggggccctgcagtggccttagagacagtccccgggaccccagggtctaggctgagggctggatgcccatccagcctgggagggccacacagggccctggggacacaggcgtcaccccaaggggagaccaatggagggcacagagagggctctgggtctaggctgcagctctgtggcctgtgctgggtcgtaaggacatggggacatagagggatgggtgagactgggtgaggtcccagagcccagccctcccaggacggtcacgagaaaggagagggtctcttagtgcagagatgtgtctgtccctggagccctatcacctctggggcctggtgtctccattcacaggtcggcctcctgccttcatttgaggaagggcaccttagactcagaaggtgactagcggggagtaaacgggagtgcagagaactccacggctgacaggtgaagtccaggggcatcagaggctgctggggtgggcatgggggctgtggtaccccaacatctgtgttagcagccccaagaacccagccgatgtgaagggtcctgtggttgggctggtggggacaggggcgacggcagagccccagggtgtgtctgggtggagcccacgcttcaccaggagagctgagtgggccaggctgggtcacagcctggtgccccaggggatgggaagctccaggccatgccaggcttgggcctccccacaccctgccaggtcagttttgtgtgctgtgagggagacccctagattccaaactcagactccagaaaccaggaaggagggagcacagcctgccctgggtgcacacggggaaactgaggctgcagaggaaagggctgggccaggacacctgggaaaggtgacttgggaagggctcctaggaaggcacagggctgtctgctctccagagggctccagtggaaaggagggaatgaggagggaaggagaggccctgggtggaccagacggccacaccatgaaccctcccagagactttagacagagagaggcgctccacaacaccccacactccctctgccatctctcaccccctcctctgtccacacaggtcagcccaaggccaccccctcggtcactctgttcctgccgtcctctgaggagctccaagccaacaaggccacactggtgtgtctcatgaatgacttctatctgggaatcttgacggtgacctggaaggcagatggtacccccatcacccagggcgtggagatgaccacgccctccaaacagagcaacagcaagtacatggccagcagctacctgagcctgacgcccgagcagtggaggtcccgcagaagctacagctgccaggtcatgcatgaagggagcactgcagagaagacggtggcccctgcagaatgttcataggttcccagcccccagcccacccacaggggcctggagctgcaggatcccaggggaggcgtctctctctgcatcccaagccatccagcccttctccctgtacccagtaaaccctcagtaaatatcctctttgtcaaccagaaatcctgctccctctcttcatttcttatctctcatataatgtgatgcttctcctgggttctcagtgtggcgctgggagaatgctgacaccagtgggaaagtagcctggaggagaggatcaaagccacccacgggtgtcccctggggaaataggccaggataggaggagttcgctcactggacaccagtccctccagtctctccctcctccccttcttccttgcagctcaacccccaactcgctgcctgctttctggagggagctacttctggctgagcctccagatacaccctgtgtccctgtcctggtctggaccctctacccacccacagcctctctttcctcagcctggaaatcctactctgagcctggagcccctcttctggccctgaccctggcccctggaatgccttccttcctctctgcccaactccccacccctgagagctggactgtccaggatttttcatctgacagcaggttcagaggcctgagaaaaataggaggaagccaagaaggaaacacacatgaaaggcctgcaagaggatcaggacacttgcaaaagataggctctgagctctccaggaaccagtgcaagaagggtaatacctccatcatttctttctttttgtttttttagttggagtctcgctgtgttgcccaggctggagtgcaatggtacaatctctgctcaccataacctccacctcccaggttcaacagattctcctgcctcagcctcctgagtagctgggattacaggtatgtgccaccacacccggctaatttttgtatttttattagagatggagtttcgccatgttgttcaggctggtgtgctccatcatttctaagagattaaacaagtctttgctcgagggaagttggttttctcaatgctgaggccaggcatctcttcataattaaaagtggggatgtgttttacccaaggcctcactattgatgggatttgggctctgacatgtgcacaggtgacttcctggcagccctaggacatggagagtttctcagatgcttggcacagacagtcactggccatctttgcaggaagcatcatttttgggaaactcttcgccattggatcctgggcctcaggtggaaaaccaggtcctgtgttgggcatttctctgtgaggctccctaggtctggggctccagctcctctctgagaagaaggtgtggggggagagaacagggcccagccacacccagcctctcctgcatggttcctgctcatcagggtgttagaggggtggtggcaccagcagtggtcaggcctgtgtttctgtgggtggggccaaggaggtacccttggggcatcctagggagtctctcccatggctcctgtttcactttcctgtggctgctgtcagaaatgacccgtaatttagaggcttaaaacatcacacattgattctgtccctggtctggaggtcagacgtccaaaatgaatcgtagagtgctaaaatcagggtgccagccaggccaggctcctttgagggctacggagagaatccgtgtccaggatttttccagcttctagaggatgccctgggctcctggccctttcctccaacttcaaagccagagccagcatcttcaaatctctcccactcttctctctctctctctctctctctccccaccgccttctctcaccctccctccttctctccctttcttgtcctccagccccacacctgctgtcactctgaccctcctgcctcctcctttcccttataaagaccccaccttggacccacccacataacccaggatcatcttccacctcaggccccttgacatcatcacatctgtaaagtccctgaggccacacaacacagcacatggacaggtcccgggactgggacacagccgtccctgggccctaattcagcccaaccacagctcctttccttccttcctctct

SEQ ID NO: 14780 - DNA, 7261 bp, Human
attcagaatctactagttttgacagtccacatgtctcacccacccactatcccattttgggtgatcccagaaaagggtcagccactgccctaacacagggtaatctcagacaaggacagaggatttctcctccaatcaccacttcccttcctttatcagcctaactcccagttatccctaattctcagctcaaaccacacttcctctattttttttttttttttttttgagacagagtcttgctctgtcggccaagctggagtgcagtggcgcgatcttggctcactgcaagctccacctccgggttcacaccattctcctgcctcagcctcccgagtagctgggaccacaggtgcctgccaccacgcccggctaattttttgtatttttagtagagacagggtttcaccgtgttagccaggatggtctcgatctcctgaccttgtgatccacccgcctcggcctcccaaagtgctgggattacaggcgtgaaccactgtgcccggccttcaaaccacattttctaggaaaggccttcctaggccccttgtcctattccagcaactccccacaatttgatggccagcactttgtacatctctaaaaacattcctcttccactagattgtgccctccacaagggcagaggtctgttttgcccacgattgtggcacatgtcacacacccttgagcactctggttcctctccaaatccatttctcctgaatgtgggcccagattggtggctcaagtctggaaccctagcagtgttgaaggatcgcctgagcccaggagtgcaagaccagcacgggtaacagaaagagatcctgactctacacaaatttttgaaaattagcttcacataatggaagatacacgggaggctgatgtgggaggatcgcttgagcctaggaggtgtggcgtgaatgcaccactgcactccaacttgggtgacagagccagcccctgtctcaaaaaaataaataaataataataataaaacagaaagaaaaaaatgatggcaaggtatctgaactgcagaaatactttttaactcagcctgaggctatcaaaacatctgatccccatgtgaaaggctacagttctgggcatgctcagggcccaccgaaaacagagtccgcccaggcaccctctgcctgtgcaagggaacaggtgtcacaatcaagtgcacaagctgctctggaagacccagcccaggcctgtctggccgagggcactggactctcccccactgcgtcgtccaaacattagtgcgagtgcacccacacaaacacatacacaatcaaacacaacatgtaagcaatgggcaggactggcccggccccactcagtgttgtcaccattggccccacagatgcccacagccctggagctctgggcctagattcctgccagccccacctgtccaggccaaggccagatgttggagcaagggggtgccagagcggcaaagccccccatgtgcccctttcccaccgggcccaggctcctggcatcagaaagctgaacccagtatctggcccgggctgtgtgcttccagcctcccctcctctcgacaccagaacagagcctggcccccagctcccaggaaatacagaaaaaaaaaatggtggatgaacgagtgacagggtgtcttgttccacacaagacacagtgagcaggggttgggggaggggcccctggcggcaggatgcacactgcactatacccaaaatcccacccttccctgggggacacctggtcccaccctaagctgcctttctcaggaccccagccccagcccagcccagccacaccctgccactcccttcagccagtgtggcttcaggtcaagaggctgggcggggtcaaggtggtaacaaggggaggggccaggacacagttttccctgatttaaacccaggcagcctggagtgcagctcatactccatacctgggatttccgcctcgccgctctccgactgcttccagacatgcaggggccctgggtgctgctcctgctgggcctgaggctacagctctccctgggcatcatcccaggtaatgaggctcccccagctgcccctacacacacacacacacacacagggcaccccccagcccaggctgacctgatctttgctctccccctggccagttgaggaggagaacccggacttctggaaccgccaggcagccgaggccctgggtgccgccaagaagctgcagcctgcacagacagccgccaagaacctcatcatcttcctgggtgacggtgagtgagccaggccttccagccccgcagccctcacagccccggcgcccggaccctcagtggttccaggacagccctggggagcaagcctcacacacttctgctccttcagggatgggggtgtctacggtgacagctgccaggatcctaaaagggcagaagaaggacaaactggggcctgagaccttcctggccatggaccgcttcccgtacgtggctctgtccaaggtaagtgctgggctaccttagagtcctccaagcagagaaggggaatcctggctatggagtgtggtaggagggagggaccctaaacagctggggctccaataaggagctggaggcagttggaatcccagaggacagagatcagggtcttgtttgtctgccccagagaagagctcagagtgtctctgtccccagacatacagtgtagacaagcatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcaggtgagctggggcccgctgtggggtcagggccaggtgacagacctctatcgcatatcctgacctctatcaccctcaggaaagtcagtgggagtggtaaccaccacacgggtgcagcatgcctcgccagccggcgcctacgcccacacggtgaaccgcaactggtactcggatgccgacgtgcctgcctcggcccgccaggaggggtgccaggacatcgccacgcagctcatctccaacatggacattgatgtgcgacccccgggccaagggctggggctgggcagagagtagcagggagggggcaccagctcagacccaggcaaccaaaagccttatctgggccagcagggtctggaggtggggttgggggcgtagaaggcgcagcccaggctgggccattcccacagccttggggaggggagtcaggggctgtgcatgaggagggggcacggggccagccaggcccccaaatccacctgccccatcctctgttcccaggtgatcctaggtggaggccgaaagtacatgtttcccatggggaccccagaccctgagtacccagatgactacagccaaggtgggaccaggctggacgggaagaatctggtgcaggaatggctggcgaagcgccaggtgatgggggctggcgggtgcagggggcacagcagggggagggcagaggtgtggggctcggggctgtgggctgaggcctggctctctccctccccacagggtgcccggtacgtgtggaaccgcactgagctcatgcaggcttccctggacccgtctgtgacccatctcatgggtaatgacccccttcctgccctggcatccctcagatggcctcagatggcaccttctgagcctgtgtgcacatccgccagcacccgcccacccccagcctgccagtcaccacaggaccccttgtcccacaggtctctttgagcctggagacatgaaatacgagatccaccgagactccacactggacccctccctgatggagatgacagaggctgccctgcgcctgctgagcaggaacccccgcggcttcttcctcttcgtggagggtgcgtggtggcccctggggagtgggggttgggggttggagcagggcaggctcagcatctcccccctctggccttcctgcaggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcggtaggcctggggagagtggcaggtgctgctgcagcaattaagtgggtgaaatctgagcctcagtctcctcctctgtcaaatgggagtaatgctggcaccagccctgtagggtctcctgcggactaagcccctgaccaggcaaaacgtggcggtgcctagcacgtgggagacactccacagctgtgttcagctcaaccacagggacccctctctctgcagggctggcccctggcaaggcccgggacaggaaggcctacacggtcctcctatacggaaacggtccaggctatgtgctcaaggacggcgcccggccggatgttaccgagagcgagagcggtgagtgccgcggggtggccccctgagggggaccagggtgccaaggatggggggctggcgggaaggggtcacctcttgtctgcctggaactgaaacttcctactgaaactgaaccctccaaccagggagccccgagtatcggcagcagtcagcagtgcccctggacggagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccgcgccggcaccaccgacgccgcgcacccggggccgtccgtggtccccgcgttgcttcctctgctggcagggaccttgctgctgctggggacggccactgctccctgagtgtcccgtccctggggctcctgcttccccatcccggagttcccctgctccccacctccagtcgtcctgccggacctccacctggagctgtcacccccggagtcgccacacagacgtcctgccatggaaccttcccctcccggtgcaccctggggaccgagcccttgacaccacgccctttgctttatcttgctcttgaaattttggccccaactccagggactggggatttgtgcctggcagctgcctgcatttcaggaaaagaggaggctcagaccatccagcccccgcccatatcctgaggtggatcaggcaggctctctccccggggacatgaggcacccatacctaggaccccctgcgccttttttagcttcagtcatggcagcacctgagggacacaaggacttgggtgcatcaggacgccttggagaagcgtggcttcctgccaccctgcaacccaccctcccagccaaggaggctgctgtggtggggatccccaggggggctttgacacagtcctctgctgtccctccactgggctaattctacacccctgtgcccctcctaggggcccatgagtcagagaggcttgccccaagtcacagccactcagatgttcgacgccccctaaggtccattccagcacccacctgagttccgaggagcacctgggaagctctgggtgcaggatagcagtccagagtccatggccccgcctaggccatctgggtgctgggcatggatttctcagcaaggaagactcattaccttccctccctgggcctccattcttctgggaaacacaaagcaataataaaaggaagtgttagacaatgtaatgccagtactacttcctagcataaaaatcatgactgaatgtggacacagtggctggaggggtggataacacaggccaggaggggctgctgaggagcagatgactgagcaggagacctgaacagagtcggggcttgagcaaggtggcacagcagcacaaaggccctggggcagtgtcagcaggctgtctgggaggccaggggctggatcagagggtgggtagatggggtaaagcttgaggggtcaggagggtgggggacatgggggaccgtgaagtctaggtagaggggtgtggtcggaggtctttgaggagggctgtgacctgccctggctgggaaatgagcactctggctgctgccaggagaagggtctggtcttttggatagagggtgggggtggtggagggtagaggtgagagctggggaaggagctgactccaggtgtttctgacctccctccgaaagcattctggagcacccatcccaatacagccatacttagtatcacacttgccccaagagaacattgaaaagaattaaatgaaggtgaaatcaaccacattttccaggaaagtttacattattacagatttatttgtacatttacaatggtacaaggagcactttgtcaacatggtgaaattctgtctctacaaaaaatacaaaaattagccaagcttggttgcccatgtctgtggtcccagctactcaggaggctgaggtgggaggattgtctggggcctgggagggtggaggctgcagtgaggtgcgatcacgtcactacacttcagcctgggtgacagagcaaggccctgtctcaagaagaaaacaaaacaaaaagactttgtactcactagaaatactagaatgattgaatacttctttatgaaaattgaattaacattgtaagacgtctatttgccaggcatggtggttcaatgcctgcaatcccagcactttgggaggaaaagaggttaggattgcttgagttcaggagttgcagaccagcctgggcaaatggtgagacctcacctctacacgttttcgtttagtgttgaggcagagtctcactctgtctcccaggctgaagtgcagtggcaggatctaggctcactgcaaactccacctcctggattcaagtgaatctcccgccccagcctcccatgtagctgggattacaggcgcctgccaccatgccaggcaaatttttgaatttttagtagagatggggtttcactatgttggccaggctggtctcaatcctgaccttaaacgatccgctcgccttggcctcagaaagtgctgagattacaggcatgagccaccatgcctagccccagatttttaaaaaatttagccaggccaggtggcacgtgcctgtcatcccaactacttgggaggctgaggcgggaggatcacctgagcccagggtagttgaggctgcagtg

SEQ ID NO: 14781 - DNA, 54463 bp, Human
tagtaattatcttaataattaggtatcacccctctcccccaacaatgacacttcccatcctcattgtgaggttattaaatgaggtctctagctgggtcatagcatcaggacaggacacacagctttcccaactaagggcaccctgcctttcagatctaattgttctgcacaaatgtcctaagcttgttgcacatgggattgattgactcttatactccctgaattggtgttatgtttttctgaggaattctacaagttttagatgtcatcatatacaatgacaaagtgggtggtagtgtttttcccatgcctctgatttatgtatttgtgcccggggtgatgatttagataggagcttaataaaattgatcgaatatattaccccaaacccacacaccatcatttcagggagctgtcatcataccaaggagatgctatatcacccagcatagtgttccaaaagaaccactgtgttttcttaagtgcggatgggcttccatttggtcagaaaggtctttatttctcaaattggccaacagtacaagagtgtaaattcaaaaggtattggttagctgtagaagagagtcattgttaggtgtgtgacttttccaagttatttaaactctctaaacctcaatttccctttcttttttttttttttttttttttgttttgttttttgagacggagtcttgctctctcacccagactggagtgcagtggtgcgatctcggctcactgcaagctccgccttccggattcatgccattctcctgcctcagcctcccaagtagctgggactacaggtgcccgccaccacgcctggctaattttttgtatttttagtagagatggggtttcactgtgttagccaggatggtctccatctcctgacctcatgatccgcccatcccggcctcccaaagtgctgggattacaggtgtgagccaccgcacccagccctcaatttccctttctacaaaacgtggattgataattcctgcctaaaatatttgtttttgtaaggataagcaatagtgcatcaagacagtgggaggaatctttgtttcaaacaaatgtagatgtctatcctagctccatctttagctgtccaagtcactggtcctttgtgagcctgtttcctaggctgtgaaatggtattggtaataattgcaagagaaggccttctgcatgatggagttgtctaaaggagccaggtggatcagatgtgaaggcccagagacatgtacgccctaagagattgactacaaggctaacttgcctaagttgctaagatgcagcagagactgaggccaacttcaacgccagctctggggacagaggagcagttgttatctagacaacactcttgtattgatatgatattgacatgatgcttgttgacacaagataaatatatttgaaaggaagcagtgagggtgagaacaaaaaccctgtaagaaggtggacaaagagtggctcttctctttgggctctcgtctcagcaaacaagggtaatccctcctccctgtcgtgagaaaccaatcccagtccattcccagaaaacgagtaaattaatgtacagtgggaaataccagaatgggaatgcttgagaaatagtatgcctgtcaataaatatgtgctccatgagttaggaaagaaatgcatgcatgcatgcatgcaatgaatgaatgaatgaatgaatgaatgaatgatttgggattctagctttatcagattcactaggtgacctgcagcaaatcagttaactgttctgggcctctatttcttctctataaaatggaaataataaaaatgactgcctaatggtgagaattaaatatgttaatgcaagttaagctgttaggtcagaggctggcacttcataaaacctctcagtaagtgaatactgttgttgtgatgatttgccattaccctgtgtcttcaatagtcactgatccagatggcttggcttctccttttaagatgtttgtattctctgtacctcacaggtcagcaagtcctgggcttggtggagaaccagagtgactggtaccttggaaacctgtggaaaaatcaccgcccatggccagcccttggaagaggctacaacacaggtaaatcctcagggtggtatgggaagagttgcagaaggtgatatgaggacccagtgctccttccgcaggagaggagattgcaaaagctcaggaggaggccacctgattgcttgaattcagtggtggatggtttgtgggcagtttgcattccagttccttcttggtgctatacccacaggtagagtaaccgttgggctgtggcagtctgtggcatctcaccagaaagcccctctcctgacctctaatccagatcctattggatatctttatcagtatgacccataggttccctggctctgttaatacagaccagatatcattcttcagtaacaaccccatttcagtttcttaacacaacggatatgtacttttgccaatcacattccacgtccacttgaggtcttcagggatctgtgttcactgtgggtactcaggattcatctccatgcatacttccatgtatgtggtgggaaagtagcagaagttgtattatctcttaaagtttttgtttagaagtgacgtaatttcatatttcattgactaagcatgttgtgtggccatgcctccctttaaagcgtgtgggcaagtgcagtctaccatgtgcctggcaggagaaaaagcagaaatatttgctaatcagcacttttgaggaccacatgtgcctggcaggagaaaatgcagaaatatttggtaatcagcacttttgaggaccacagacctataaccatgtgtctaaaataaaatccattattctacctcgttactagcccaaacttgcatctcctcttcagtttctttctctgttattggtgtccttcattcatccatcaacccttcttgttcaccagctgtcccttgaatgcttactgtgtacgaggccctatgctagctgcagcagacacagtccatgacctcatggggtgtataagcaatgaaactagggcagcctcttcctcctgaggctcaattcccatcagtgtctatctttgacatgcttctggatccttctgcctccctcctccatcttcattgccactgctatggtatcccattctcaaaggatgcagactcctgatctttgtcagactagaatgtggaactcagggaacagtaggatgggtgagaccaagaagggctggaacttggcatctgagaccagcaaatgaagtgggttgggacaggtgtctggctctggggacagtaccacctaaaagtgataagtgaagcctgccctggaggctgaggccagtctgtagtgggatcagccaaaaagagtcccaaattctgagagctgatggtcagactccagaaaagtcaaatgcaaacacagggtcccagagaacaaaggagaagggacatgagtcaagcttccagaggtaagagttcacagatggggtcagagtgggggtcaaagctagaggaggacaaggaaagaaagtccagcatcaatgtccagaggtggcaggcagccagggagccctgtattgacggccatcctaagagacggggacattccttagctaacatttgcctgagtattagatatgccttgctctatgtaattttttttttcctgtaatgcctaccaggcaaacagaggttgtgattgaagaatgtcaaccaccagcccttcacagactccagattcccaccctggagtctcccatgctgtgttgggcattaatactttagttgctggatgatggggaagtctgaggagttcctgagaggggccaggttggggaaaggcagctgagggcatcagagcagtggttctcttagcaggtcaggaggtatttcactcttttcaataatgggtaaggcagggcctctacgtatcagctgagtattagccaggcaccatgttaggtgctttatggttgtcagtctcctttgatcctcacactcatcctatgaggcaggtgccatgcctataccagaagaaactagtctataccagaggaaactgaagattggagcatcgaaggctgcaaccctgaaaagtcaaggagcctgtggtgttaactaccaacctgccttgcttgaactttaatggcttcaggattaaacacttttcaacaatggagaattctgggctctgcccttcaagagtctgattgactaggtctgtgcaggagactgggattctgtcctataggaagcctctaggatgtttctggggcagaatgtccaagggcctgctctgattaaacatggcactctgtttcctgtcccagcaagctctcccagacgctgttttctcagtgcattggagactggaccctccatgaacccacagcgggccagggacgggggttccacgtgctttcctctggcaaacgactagtcaccccgtgttgatcttttgtgcctggattttcagacacgttccctccaagctttcatggaggtggagacacctatgtttctgggtggagaaaggaagtctcaggaaaaccctggtgtatacatttcgtttctgtcttccaaaatatataatagaaaatgtcacatagaaatatactgcagtgcctcagggatgctgcatcaagatcacggtttcctgcgtaaaacaaaagccgctggtcatcaatccgggtttgcagagagaagaagaatgtagcacactagggaatttattacaaccaaaatggcatgtctcttcctgcccttccctatttgctatagaatgtagcatcaggagacacaggagcacgtaaaccacctccagttcccgcttgatttgtcaaagcagtgagttacttccctcctcgctggtactgaaagggcagagcagaagagggaaagccctgttgaagtgatgtgtccatttaaataagccagtgacactgagtgattattatgaaaggacttaggcaacatcaaaatgcaaaaaaatggctttcacgaaggggatgtgtcgctttaaaaccaaggattgtgccacccagtgaatgagtcatccagacatgtagattctcatggaaactgaggacgaccctggagagaacctgccaccctaaatcccagcacatctgaagcctccaaaaagaatatctccagcagaacctcctgtcttatgccttcagcttgatgttaggaactcaggcagatctgggttagagctgcagtacagtcatttagtcttcttatgcaacttggccaagtcacttcactccttgaacctcagttctctcttttttttttttttttttgtttctttttttttgagacagagtctcgctctttcgcccaggctggagtgcagtggcgcaatctcggctcactgcaagctctgcctcccgggttcacgccattctcctgcctcagcctcccgaatagctgggactacaggcgcccaccaccacgcccggctaattttttttttttttttttttttagtagtgacggggtttcaccacgttagccagaatggtctcgatctcctgacctcatgatccacccgcctcagcctcccaaagtgctgggattacaggcatgagccaccgtgcccagcagttctctctcttttttaagataggacaaggccaggcacggtggctcacgcctgtaatctcagcactttgggaggccgaggtgggtggatcacgaggtcaggagttgaagaccagcctggccaagatggtgaaaccccatctctactaaaaatacaaaaaattagctgggcatggtggtgtgtgcctgtaatcccagctactcgggaggctgaggcagagaattgcttaacccaggaggtggaggttgcagtgagccgagatcatgccactgcactccagctgggcgacagactgagactctgtctcaaaaaaaaaaaaaaaagacataacaaacctagtatgtgaggattagcaattaatgttgtaacttgtttaatgagcctagcctgatccagggcacaaagtaagtacttagtaaatcttggtctttctcctcttgcatttttctgccacttgctctatcagggaatgagatttaccgactggaaaaaggaggttatgtgattgactggggtttgctaaggtctcccaagccctttggtcagaaagaacgagtaagtattttactttccccaggtgtaatccagctacctagcagtttttcctgtatctctttactatctgaaaaggttagctttttatatcacattaggaaaaaaaatgactatttagttcgcatatcagcttcctcgctgtgttttactttgaaaatccccagaaaagcatatgagatgtttgtgttggaagctctgccttcaagacctggcgttgttgcttttgagttctgtgccttttggaaagcttacccaagctcagggagccttgggcttctcatttatgaactggggacctcagaacccactcggaggctctgttgtggtggcgcagccacgtgtgcctggggtaaaccaaagtactttagcaagttggttgtgatttttatttatccccctaaccatagcccaactgaataactcttttcagctaattcagattcaaccgcagacatcaaacacagcctcttcactacacattcattcattgactcatcccaccaggcatcataccaggcaccatagcgtgcatgggctttgttaattccttgaattatcttataaactagacttttccccctacaagagtcagtcagtttcccccgttctctttgtttgcttttctttcccagtctgcttttccaaagcctacatggccacaaaacattagagaagatctttccaccatctcccattcatctccttccctttttactagagctgttcccaacttaattccagaagctactgagccaccgcagcttcggatggataaccaggcagatcctagcatgaagctcttgcccataactgttcgggtgaaattacaggcgtctttcacagtcttgcacagaaacgggtcagtttccaaccgctctgcccaggcatcatctcctagatgcaagaagctgtcattcacccagcattcagctgtgagcaggacttagaaaacaacaacaaaaatacacctaggattttgacaggctcattaagattcagctctcttcagttcctaagctgacggatgaatatcttaaaaacaaacaacagcaaagaaaaggggaaggagggctaaacatagcaggggattggagaatgaggtgagggaaggcaggtcggtagaaagaagatggcatgtttgcagataggtttatttgcatgggaccccaaaggcgactcaagcacaaggtgcgtcctccccaagttgaagggtgtaacactagccagagaatgtgctttttaaaacaatttaaaaataaaatgtatcgtgtttcattcagcccccaaattagggcagagacaggcagatggagacctggctgtttagggagggaggaagaatttctctcggaatccttctctgcaggacaacaaaattggaatgctcaaggactggctcacctctgaggttagagcaaaccgtggaaggcaatgggcagtacagtcagataccatggaaaattctgtggcagagattcaaaaggagaaaacatttgatagtttgccaaagaactgttaaatagctttagtgggataaatagaaatatgcaatctaggctcaacttacctctgcctctgacatccagcattctgggaccctggctaagtcccttcatttctctgcatcttaattgtctctgatgtcaggaactaagatctcttcgtgttctgaaagaatactgtgattgggtgatttctgtctgtaataattgcatccagagaagctatatttaaatataatttattcattcattacatgctactgaatacctataatactggcaagggtagggtagaaaactgttttgttttgttttttaaatgggtgataccaagaaccttccttcaaaaagtttatcgtctaatagagaagcgtttgcatatctgcaaataaagttaatatgacttgagcctcttccatgattgagatccagaattgatcatcagccctgcagtaataacccctagactagcgttttctagactaattccagaggtcactgcaagggatgtgaatatgtgtttagaaattgtgaacagaggccaggtgcggtggctcacacctgtaatcccagcactttaggaggccgaagcgggtggatcacaaggtcaggaaatcgagaccatcctggctaacatggtgaaaccctgtctctactaaaaatacaaaataaataaataaattagccggtcatggtggcacgtgcctgtagtcccagctactcaggaggctgaggcaagagaatcgcttgaacctagaaggcggaggttgcagtgagccgagatcgtgcctgcatactgtgtctgccctttggagattcatatgtgcatgttagagatcttataaagtctggaagtaaagaaagctattacacccagaagcatttcccagttttacttgatcctagagctacggaaataaattagggacaaactgcctgtagatggagtctgtagaataatcccactgaaagatgtgtgctattctaagaacagttcttctgacatcgtgctcaatagaaatgtctactccctactttcttttgtactgtaggttctcattcatctttctgctgcaaggatgtagacactgtcttaggtgctataacagatgtcccatagactgggtggcttaactacaaacatttctcacagttctggagcctgggaagtctaagatcaaggtacccagccattctagtgtgtggtgaggacttactttcttgtttgcacatggacaccttctcattgtatcctgacatggcagagagcagggaaagaaaatattctgtctgtatatcctctttttttgtttttgtttttttgagacagagtcttgctctgtcacccaggctgaagtgcaatggcaatatctcggctcactgcaacctccacctcccgggttcaagcgattctcctgcctcagcctcctgagtagctgggattacaggcacacgccaccacacctggctaatttttgtatttttagtggaggtgaggtttcaccacgttgatcaggctggtcttgaactcctaacctcatgatccacccgtttccgcctcccaaagtgctgggattacaggcgtgagctgccgcgcccagccttgtgtctcttcttacaagggcattaatcacattaatgaagtccctaccttcatgaccctaattacttcccaaaggccccaccttctaatactgtctcattaggaattaggattttaaagtattttattttattttttgagatagggtcttgctctgtcagtcaggctggagtacagtggcgcagacacagctcgctgcagcctcgacctcctaggctcaagcagaccttgcaggctcaagcgatcctctcacctcagcctccagagtagcttggactacagctgtgcacccccaccctaggctcattttcttattttttatatagacagggtctcactttgttgctcaggctggtctcgaatcctgagctcaagcaatcctcccacctctgcttcccaaagtgctaggattacaggtgtgagccactatgcctggacgggtttaggactttaatgtgtgaatttgggggagatatgacattcagtccattgcaggtaccatatcattgcacctgcttaatcactctgctgtgtgtcattgcataactgaagcgagcatccttccaaaaccttctgtccataggtaggaattctgtgagagatggcttctacaccttttccaatcctgattggttgaccacctttagatagctccactttttctctttggaagtgacactctgacctgaatgatatgcagtggccattatcaaacaattgaaggttcacacctccacctgtaaacttccgctcactgttctgaatcacttaaaattcctgtttaaaatgtcaacctcagggccctgcccccagagaaagtgaatctcaatgtctagagatgaggctgggtgactgttcttttaaacatgctccctacttgattccgatggttacttaagtttgagaaccagtacctaggcctctgatgatgtacttttactgccacattgcacttctagctcaaattgaacttgagttcaactgagaagctccatgaatgacttttcagccaaatgctcccctttctgtacttctgtagtagccttattgagtctaaagtacagattttatattggtctagtgagttttatcttctttggaccattcttttcatcattttattagatttcatattagggtatccacaaaaatactaaaaatgccttctgttccttcacccagtgtccttgccccatatttgtaacaaatgttttgaatgcctcttttataatcctggaatgaaattcaaggattacatctatattatattgcctacaagtgtaattttttttttttttttttgagacagaatctcacagcagagcccaggctggagggcagtggtgcaatctctgctcactgcaaccttcgtctccggggttcaagccattcccgcgcctcagcctcctgagtagctgggattacaggcgcacaccaccatgcccagctaatttatgtattttttttaatagagacggggtttcactgtgttggccaggctggtctcatactcctgacctcaagtgatccgcccacctcagcctcccaaagtgctgggattacaggcgtgagccaccgtgcccagccataattataatttttttaaagaaaattaatatagtgccctggctttaatataaagagtaaataaaataaaattattataaaataatatttacttcaacgtgtaatggtcaggtttggctatagtaaatgacctaataaagtggtcagatgcttctgtgcctgtatttgggatagaactgtcttcactgtgacgcctacgagtgctgaatggtactgatacattaccagcactcggcatttcatgagtggggtttgccaaatttgtggtacatttttccaaagtagtgaacaactcttggtaaagtatcagataacaggaagtaccatcttcgcttgacttgttctccaagttcagtgactattcaaaccatgcaaaaaaaaaaaaatggttttaaaaaatatcccgtaagtagtgttagttccaggctcaaatattgatagggtttggatctgtttccctgcccaaatctcatgttgaattgtaatccccagtgtttaggtggggcctggtgggaagtgattggatcatgggggtggatttctcatgaatggtttagcaccatcaccttggtgccgttctcatgatagtgagtgagttctcatgagatctggttgtttaaaagtgtgtatggccgggcgcagaggatcatgaggtcaggagttcgagaccagcctggccaacatggtgaaaccccatctctactaaagatacaaaaaattagccaggcgtggtggcatgcacctgtgatcccaaccactcggaaggtggaggcagtacaatctcttaaaccaaggagttggaggttgcagtgagcggagatcatgccattgtactccagcctgggtaacagagcaagattccatctcaaaaaaaaaaaaaaaaagtgtgtagcacttccaagctcgttctctgtctcctgctcctgctctggccatgtgaggtacctgctccccctttgccttctgccatgattggaagcttcctgaggcctccccagaagctgagcagatgccagcaccatacttcttgtaaagcctgcagaaccgtgagccaatgaaatgacttttctttataaattacccagtcttgggtatttccctgtagcaacacgagaacagactaacacagatacttaacaattatgtgtaattataaacatgaacggcctgtggtacccacatgttatgtgggtgcatttttcattgtgctggacactcctgggaaggagcactgcctgctttgaaagtcgaaggttggaggtgttgccagtgttcaacaggctggctggatgcaaagctgtgctgtgtttaaaatccttcctggggttggcagcaatgagtaagataatgctccttgctcacagagagtagtcggccagctgaaagcctgcttggcagtactgccatgggctacttctctccacttaacctttatccaaattcagtgacccaaccaaagcttattcactttgtatcctgatccagaatcttctttggcctcaggtctgcctcctggattcacagagaataaacctactccctcttccacctgcttacccccagaaatctaactgaaagaaagcagacaatgccttctcatcttgccttctgtagtcctggcaccctggtttcctcaggaattcctatatgtcacttagtctctgagcaccagttcactcatatgtgagttgaggatggttatagtaagtaccatagaaaggattgttctgaaaagtaaatgagataatagagtacatttaatgtgatgagacaaggtttagcacatagtaaatgctcagtaaatgtaggcatagttaccttgttttttaagaggcagacggagggcctgcactatgtctggcctcttgccttattggtcaacctgggatcctatagctcatattttatttttgctattaagagactgtattgcttgtattctggagttgaacagtctttggtccaagtcccacctccacctgttactagctcccttattctggggaatgaacaactttttcatttcaggataaaaagaattcatatttcacacagatgccttcaggagaaaaggagttaatgttttcaaagtgcatgggacagtgtctgggtcaataaatgttagatattagtattttcccactcctttattgattgattgattgattgattgattgattttattttattttttattttttgaaacagaggctcactctgtcgcccaaggctggagtgcagtggcgtgatctctgctcactgcaacctccacctcctgggttcaagcaactttcctacctcagcctcccaagtacctgggactacaggcatgcatcaccacacctggctaattttttgtatttttggtagagatggggtttcaccatgttggccgggctggtctcgaactcctgacctcaggtgattcacccccctcggcctcccaaactgctgagattacaggcatgagccaccgcgcccagccttccttttcctttaatactcgaagtacgtaaatggggaaagaggattacgtctgtgtcttttgacagtaactccgtcttttgcccaggtaaggtatttggagctgagcattctcccagggctgaccatccacgtgttcattcatttgttggacagaaattaaacatgcatctagcacatgcaatgtgccaagcttctctgtaggccctggggtgccacagtgaacaagacaaatgggaaccctgtttacagggaggttactggttattgtgggggagaaactgtcttccttcttgtgcttttttgatgtcgtttcctggaagtgttccccacactcgctccactccagccactctggcttccttgctgctctttgaacacacctatttaaatgtgagcctctctgcctccaaactacagcctccatgctattccgttttccaccttattctcctccagcacttttaagtaccatctgaccaactacagtttggttcattttcttttaatttccctgtgtctttccatgaggatataagttcctcaaaggtagtaatttttttctgtcaatttcactgctgtctatggccataccaccctgaatgcacccaatctcatctgaatttcactgctttatcccccatacctggaatcatgcctggcctgtattaggcactaagtatttgttgttgaataaaataaataattttggaagataagtgtttcgaagacagtgatatagagcagcatttctcatggttgctcgtgggaaattttacaacccatgggacaccggcaatgtctggagacatttttcttgtcacagccaggaggttctacgggcacttagtgggtagaggccagggatgccactagtacaccagacagtccccccataacaaagattcatctgggtcaggtgcagtggctcatgcctataatctcagcactttgggaggccaaagtgagtggatcacttgaggtcaggagttcgagaccagcctggccaacatggtgaaaccccacctctactataaacacaaaaattagctgggtgtgatggtggtaggcgcctgtaatcccagctatttgggaggctgaggcacgagaatcgctcggacccaggaggcagaggctgcagtgagctgagatcgtgccactacacttcagcctgggcaatagagcgagactccatctcaaaacaaacaaacaaaaaacaacaacaacaacaacaaaaaacaaagattcatctggccacaaataccactagtggaaccctcacagaaaagcaagttttgagggaattggattcttctagaaaggaccgtttctttgggtagagtctctgagaagacgacatttgagctaagacctgaaggatggaaaggcggcagccatgctgagagctggaatgagcatcccagatagagaggacggcacgtgcaaaggccaccaagcaggcgtgtacttgggtgatcgtgtttccctctcatgatcatggccctcatcattcctggcactgcaccctctgctcttgtcacctttatctagtaatgcatgagtggttgatatggtcaggccctgtgtctccacccagatctcatcttgaattgtaatccccatgtgtcaaaggaggaacctgatgggaggcaattgcattatgggggtggttcccctatgctgtacttgtgatagtgagttctcctgagatctgaggttttttaaggtggcgatttttcctgtgcttgcaactggacttctctcttgcctgccaccatgtaagacgtgcctgcttccctttccaccatgattgtaagtttcctgaggcctccccagccatgcggaactgcgagtcaattaaacctcttttcttcataaattacccagtctcgggaatgtctttatagcagggtgaggatggactaatacaatgggattcttcaggtgttcagaccccaagtgccctcgctttcttccctccatgccctctggactctctgactcgtactaacacactttggaaccatgatgtggtcctgttgacctgcctgtgccccaaggttcctgaagatcaccactagcacagagtgaataatggcaaaattcagcctcataggatgggagccggcctgggctggctttgtccagttgtccgtatccacagcccctcctcttccctgctcactccagccgcctccctccagccactctggccccctggctgttgcccaggcacattctcacccctgcaatctgagctctttgcctggaccgctcttctgctagcagctctctggcttatcccattacttcctcagtccttggatcaggtgtcatctcctcagagtgggcttccctagccatcctattcaaagcggcagtctccatccctttactctgatttatatttcttctttgcactttccatccatgttataaaatatgtttttgattatttgactgctgtccatcacagtaggcagaatcccccacccccatcctagtatccaggctctaagccctggaacctgtggatatgttatgtcccatggcaaaagagactttgcagctataattatgggcttcaacatagggagtttatcttggattatctggtgggcccattctaatcacatgagcctgtaaaagcagagaatttctggccggctgcagtggctcacgactgtaatcccagcactttgggaggccgaggcgggtggatcacaaggtcaggagattgagaccatcctggctaacacggtgaaacctcgtctctactaaaaatacaaacaattagccaggcatggtggcacatgcctgtagtcccagctacttgagaggctgaggcaggagaattgcttgaacccgggaggtggaggttgcagtgagctgagattgtgccagtgcactccagcctgggcgacagagcgagactctgtctcaaaaaaaagagcagagaatttcctccacctagatgtagaagagatagagtcaaaggggaagtcacagaaacttgaagtaggagaaggactcaacctgccattgctggtttgaaatggaggaaacaataggacaaggagttgcagatggtcgttagatgctgagagtggctcccatttgattgagaaagggcgtggggacctccgtcctacatagaactgaattctgccaacaacctggatgagcttagaagtggtttctccccgagagccccgggcaagagccctggatggctgcaccttgactttggtcttgcaagactctaatcagaagacccacctgagcccccaagatttctcacctacttaactgtgaaataataagggtgtggattttaagtggccaaagtattttgttatggctgcaatagaaagctaatatccctgtccttcccacaagaatgaaagttccatgagagtaagatcttgttttctttgttcctatgtccctatctggtgtgtgaaaagctctcaataaatatttgttgactgagtaaatgaattctacactcccacctgcatttctccccagagggcagggaacacactggtgattagaaatggagaaggggcttgaaaagccactggtgggaaacattccatattcctaggtcctgccggctgcccatttagtaggcagttgtccagcagatactaggtgcctggaatcatgattggcattaggagtagaaattaaaaagaaaggctgggcacggtggctcacgcctgtaatcccagcattttgggaggccgaggcaggcggatcacgaggtcaagagatagagagcatcctggccaacatggtgaaaccccatctctagtaaaaatacaaaaattagctgggcgtggtgacacacgcctgtagtcccagctactcgggaggctgaagcaggagaatcgcttgaacccgggaggcggaggttgcagtgagctgagatcacaccactgcactccagcctggtgacacagcgagactctgtctcaaaaaaaaaaaaaaaaaaaagtccgggcgtggtgcctcacacctgtaatcccagcactttgggaggccaaggccttggtagcagatcacaaggtcaggagttcaagaccagcctgaccaacatagtgaaaccccatctctactaaaaatacaaaaaattagccgggctggtggcgggtgcctgtaatcccagctactctagaagctgaggtaagaaaatcgcctgaacccaggagttggaggttgcagtgagccgagatcgcacctttgtactccaggctgggcgacaatgcgagactccgtctcaaaaaaaaagaaagtaaaaaagaaaatgggtgtctacttgcaccaccattgcctcccccgccccccaaaaaaaacacacaaaacactagatgacccacatagagccaaaaatcagaagattaaggacagtgaaatgcaatgtggcctgcactatgatggaggagtctgtacacaattccgagagctagagtggaggcctgcacgggtgggtggagaaaagcttcaaagtgggtagaactggaagtgggggatggtggcatggactttgcagagcttgctgttcaacagagcagcaagcccccagcccaggttggaaggtgtgaaaatacttgggatggccagagcagcacacacggtggtttttagtttcactgaaggtgcagcttgtagggtatgtgcccaatgtaggaggagcagggaggagctcaagctctgtctcacccttgactagctgaatggtcttgggcaaatccctttgtcacattttgggtttttatggtctgactttcctcacctagaagatgggagcatcagtgtagactcacgagattggcagaaaaaatggcatgaatgggaaatagctggcacaaagtaaatgctcagcaagtgatagctaagattcgtggtgcagccacagggagtatgggacaagaggctcctgtcatgtcgaggctgggaatcagggaggtctaaggtctgaacggtaaccaggcagttcagccttatccagcaagctggaaggttcttaaacaatacagtttcccgcctggccctcaggagaaaccgccctcacccaccatcctcttccctcttgattgtctccatttatgtcttgaccctgagccaagtgttcatctctcagggctgtggctgcagcctgttgaaacatatgcagaagctcccatccacaggcccagggcactaaagtcaccgcagtgccttcagccttgctacattctctgcagtaccctagcaaggcagccaagcgagagccccctcctatgagacttggtgggggctctaattaaactgagcagctagagagttttcccagctgcatcctgaaaagatggcaagatttcccatcgcttgccttcctgagcaaaagccactgttctagaagagttgctctaccattgcttcctcccttcctggagcaccagccctcacaggagagaatatgtatgcaatgtaaggcttccaggatctggcctgaagtgcaagaaatctgtttccccagcttctctcactctgagactttttctcctgagctatttttcttataaatgattctatttccaggttagctctggcaacaccactccatggttttcctctctctttgctaattacatcacagagctactgcatgctgattagaaggaaaataaagcaaaaacaaaacaacgcctccacctgagctgggcctcccctgcagttgtctgtgaactggagcatctgcctttgtgcagctgggctgcagggtgctgggtgctcctcctgacttgccctttattgctcatgcatcctgacctgaagatactcaagccacctctccacaccccaggatcctcttgtttgaatcgaaaaaaataacactgtcttagtccattctggctgctataacaaaataacattaaccaggtggcttataaacaacataaatgtatttctcacagttctggaggctgggaagtccaagatcaaggtagatttggtgtctgctgaggagtcactttctgattcatagatgacaccttctaactgtgccttcacatggtgaaagggatgagctagctctctggggtctcttttataagggcacaaatcccattcttgaggactgcacactcatgacctagtcacctcacaaagactccaactccccaataccatcctcttggagattaggatttcaacatatggattttgaggggacacagacacttagaccagagcacatgcctggaaacggaagcaatatccctcatgatcttgttgataagataaaaggctacagatgccatagagctatgacattatcagcagctgcattttcttagcatctgaacatgagttgccaatcctagtcaacccctttgttagctacgtcctacccacttgctctcagcttatctttagccatttctcattgtatctgcagccctcaaccttttctccccaaggcctatggcacacacccttttattgttgttgttattgttaactatagcagatttccagttatattttctgttatatttcatataacagaaacttttacctattaagaaataattcatttctcccttcccctagtccctggcaatcatgattctattctttgcctctattagtttgaccattttaaatatctcatatgagcagaatcatgcagtattttgtacttctgtgaatggcttatttcacttggcgtaatggaaccctttaaacactgtttttgggaatgtattatagaatgatgcggccactatggaaaacagtatggcggttcctccaaaaattaaaaatagaattaccatatgatccagcaatcccactcctgggtatatatccaaaagaattgagatcagagtctcaaagcagtatctgtacccccatgtttattccaacattattcacaataggcaagatattgtaacaccccacatgtccattaatagaagaatgggtaaagaaaatgtggtgtattcatgcaatggaatattattcagccttaaaaagaaggaaatcttgccctctgtgacaacatggatggcatgcacccttcatgaatgggggctcactatgccttgtgttcaagagggcagtgggcagttttaaaaagcccccagtaggccgggtgcggtgggtcacacctgtaatcccagcactttgggaggccgaggcgggcagatcacaaggtcaggagttcaagaccagcctggccagcatggtgaaaccccatctctactaaaaatacaaaaaaattagccgggcatggtggcacacacctgtagtcccgggtactcaggaggctgaggcaggagaattgcttgaattgggcaggcagaggttgcagtgagccaagatctcgccactgcactccagtctgggcgacagagcaagactccttctaaaaataataataataataaaataaaataaaaagcccccagtaatgatgcctatgtcagagtgtttcgggggagaggtagggatatcatatggcatatatataaaatatatgtaggaaaaatttgtattctggcatatagcaggcatttaataaactgtggctctttttgcagaatgtgccacacaataggtaggagtagaagttaaaaattattataccactctttcagaaagagtggttcagttgctttaaaactccactatagacattgccagttactagtgaatctgtgagattctggttctagattactgccaaaggataggattttttttttattttagactattttttaaaagaattttgacaactcatattcacatttgttataaaggacaaaaatagtctagaaatgcagtgatgtgctagggtcctagctcacatctgctagtgaaagcctattgttaaatttttaggaaatatgggatccagttgttaaacatagccactattaaaaatcaaggccgggcacggtggctcacgcctgtaatcccagcactttgggaggccaaggcgggtagatcacctgaggccaagatatcgagaccagcctggccaacatggtgaaacgctgtctctactaaaaatgcaaaaattaccccagcatggggtcacatgcctgtagtcgcagctactcgggaggctgaggcaggagaattgcttgaaccagcaaggtagaggttgcagtgagctgagattgcatcactgcactccagcctgggcgacacagcaagactccatctcaaaaataaataaatacataaaataaaataaaaatcagattatgtaaacttacaatgaaatatgtcatttgaaaaacaaaggtaacaaatactcaaaactcttaaaacttgttaattcctaatcactttactctctgtgcttctaaggttgtttgcgtctgccatgtctgtatggcgggaatgccatgcagtggggtcgtgctgcacatcccttcataaccgttcagtagcattgcattggtagcttgaaatctgccatggtgggactattgcaacctggaaatgggaaaacactaccatcaggggatttctttctttctgaagagtcagttgttgaacatttaccagcattgctgaaatataataataataaatatatatatatatatgactttgagatggagtctcactcttgtcacccaggatagagtgcaatggtgcgatcttggctcactgcaacctccgcctcccgggttcaagcaattctcttgcctcagcctctcgagtagctgggactacaagcgcgtgccaccacgcctggctaatttttgtacttttagtagagacgggattttgccatgttggccaggctggtctcgaactcctgacctcaagtgatctgcccgcctcagcctcccaaagtgctgggattacaggcgtgagccaccgtgcccggccaataatatatatttttcacattccctgaaagtaagtactgttgacagtttgcagtcttgacttctgctttccacatatgtaattatctatttctctgtatatatgcatattctttttgaatagacttgtttacttaaaaataaaatattgggtgtcttctacattaatacaatggtgtattttctttcttgttaagaactgcatagttttgccatttgatggaggtgctataattcgtttattccattttttatgagttggtattttagctgtacctaggttttcccctcaattataaacaataccatacatagatattctcattacccatgtttgtttgtttgtttgcttatgcaagtattggtacacaatagctcctaagctattctggtactgctatattaaatgttatggatattttaaattctgatagatcaaaatttaaatttgccaaatgtgtcagtttacaatcgagataaaattttaaattaaacagatgtgtgcatgtttatgtatgcatgtgatttgcttgtttgttttctgtgttaggcacacagtctgtgtatttgcaaagaatcagtattttgccaaggagctacttcataggaacccaacttgagctttttcaatttaggcagatgatctctgactaaaaggtccaggtgtttgaagccatggatcgttgaccagtggccaagtgaaacagagacatttccttgctgtggctaactctgcctggctgcagcattccaacacctggataagtgagttgacctggcttagtatttacacgggggtggccgttcctgaaaatgtgtctgccctactctgctgacccatacaaggtcaggggttttctctgtcactcactcaggtctttagcattgcaagagctaacaggagttacgacccaagcatccagacacctgtatggttcagtgtgcagtagaagggaaagaaggaaggatatgatcctaaatcttcctgacttaaggaaaataatctggccatcattcagaacgtggtttccttgaagacacatttgtgatgggaagaggcacttgatttctctggggcctctcaggttcacagtactaattgcttagatttgattcatgctttcacgtgcaccagctcatataattcccattctacagaggaagctgatggaggctcagcaaggttcgttgattttgcaagttagcagagccagtaaatgtcagagcccagtgcttaagcctaccttgcaatctctttctgggccttcagtgcttgagagtggttggtagagcagtatatgagtccattctcacactgctataaaaaaaaaatacctgagactgggtaatttataaaggaaagaggattaactgactcacagttccacatggctggggaggcgtcaggaaacttataatcatggtgggagatgaaggggaagcaaggaccttcttcacatggcagcaggagagagaagactgagcatcaaagggggaagagccccttataaaaccatcagatctcgtgagaactcactcactgtcacgagaacagcatggaggaaaccgccccccgcccccatgattcagtcacctcccatcatatctctccctaggcatgtggggattatggggattacaattcaagatgcgatttggctggggacacagccaaaccatatcaagcagttacttagctctggggatttttctagctccctccccagtctataggttagagagctatggaccgtcataacaacgtcgtgctgtctactaaatttacagtagtacttgccatcatggctgcatgttggaatcacctgggagatttgaaataatcctggcatcccagggcttatctcagaccacttaaattagaacctctagggtgagactcttccttcagtagttcgtaaaaccaagcaggtgatccctatatactggacaggcatgtcctcctttccttccaaagcctgcattataaagacaccatttgtaatgtagccactctgtacctgctttccctcttcattacctataccctatttttctagccatcactgaactcctagactccatagctgcttgaatttgtggacattcaaccaagatttcttatctttttttttttttttttttgagatggagtctcactctgtcgcccaggctggagtgcagtggcatgatcttggctcactgcaacctctgcctcccaggttcaagtgattctcctgcctcagcctcccaagtagctgggactaaaggcgtgtgccaccacacctagctaattttttgtatttttagtagagatggggtttcattgtgttagccaggatagtctcaatctcctgaccttgtgatccacccacctcagcctccccaagtggatttcgttttattattattattaactgtgcataatgtcacaccccatgctggactctggggatgcttcagtgggtaaaagaatcctagcctcagactgctgactgtcaagtaacagctacagacacaagccatttggatgcagaagtgccctgatggagaaagcccttagacaactgggaaaaggggacaggcagtgatgtaccatcagtggcttatttacatccctattgttgcctggatcctgacctgctatactatgctttcccctggggctgccagtgacatcacatagagaaagagaccagcctcctcctcctccttccgtctcagggtaagctgttccctgtcatccaccattatgcttcaatagcccctccttgtccccctgagcccttgcctgccgcatctcctttattgcatatttgacatttcaccacagcagatcagatgtatttgaatcagaatggcacacagggcccctgaattggttggcagagccctatgggactgctccaagtgaagggaatctccatgaagacaattatccaagagaaatagcctatctcagcaggcatcgttctgctttgcttattgagccaacatttatgaagcatagacttcataccgagctcaatgcaaacagactcacctctagcaaggctcaagggaggcaacaaaagaaatagaaaacacggcccttgtcaacaaacctaggattaagttggagtggccgggcgaatatactgaggaaacattggttttcttttttaacccttttcgaagtctatttaatgtctgcctactgaatatttaattattaacaacaggagttgaccccccctggccatttttgtatgtcccacgctgggtttttccattttcagatagttaaggcaaaaagaaaaaaaaaaaaaaagacaagtctattttgtggcacatgaaaatcatatgaaattctaattgcagtgtccattaataaaagttttgtgggctcacagccacagcattcatttttattttgtctatggctgtatgaaagttgtcaggatcaagatggaatcactaatattagaaaaccctgataaataggggaaggccacgaagacatgattctcacacttatatgcctgataatgaaacagactctacaaaaaacacagccttgcacaaacacctcacgaccttacacaaaaacatgtgtgcaaggacatctgcctctccaacctcggaccagtgtcatccttatcattgatctttgtagccaaagataattactcaaaacaattatgtactcctccttattttttcctttaaaaatgtttatctttggctgggctttgtggctcaagcctgtaatcccagcactttgggggccgaggcgggtagatcacctgaggtcaggagatcgagaccatcctggccaacatggcaaaaccccgtctttgttaaaaatacaaaaaaaaattagctgggcgtggtgttgcacgcctgtaatcccagctacttaggaggctgaggcaggagaacctcttgaacccaggaggcagaggttgcagtgagccgagatcgtgccactgcactccagcctgggcgacagaaaaagactccgtctcaaaaaaaaaaaaaaaaagtttatcttccttaccaccctgaatgcatgcagactttactatgacatgtgtattcccattacaatatttaattcccaaataaacgtattttcttttacagagtgtctctctgcttattatttagattgacagctgctttgaggctgcaaagacagaaattaagtagttgcaacagagtccttttcgcttccaaagccaaagatacatacttattggccctttcagaaaaaatttgctgaccgaggtccacagcatagcagaaagcatggtctcgggagcagacttgggttaggatcttgcctgcaccagttagctttccacatctagtgaataggaataataacatgttcttaataggctgagattgaataaagccactgtaaaggaaacataaaccccagttatttagaactagtattgatgcctagtaaatattggttaccttcacccaccttaattatatacaaatataatttcctatataggcacaaaaagaaagatagaattacctgaggctaatcctactctcaactggaaagatatgcacaagaaatagagggaaagggaatgagactaatacattcattggatactttataatagcagagtcttcttactcttgttcaatcctttattccccagcagttagagctgtcctgctgggcacagtggtgcacacctatagttcccgctacttgggaggctgagtcaagagaatctctggagcccaagagttcaaaactgtagtgtgcgatgatcgtgcttgtgaatagccactgcactccagcctgctcaacatagtaagacccagtctctaaaaaagtaataatagagtggtccctggcatatggtataggcatagagttcagtatatattatatgcattttcagccaggcgtggtggctcatgcctgtaatcccagtactttgggaggctgaggtgagtggatcacctgaggtcaagagttcaaaaccagcctggccaacatggtgaaaccccgtctctgctaaaaatataaaaatttgctgggcgtggtggcgggtgcctgtaatcccagctccttgggaggctgaagcaggagaatcgcctgaacctgggaggtggaggttgcagtgagccaagatcgtgccattgcactccagcctgggtgacaaaggcgaaactccttctcaaaaaataaataaataaatgcattttcacattcagccctcttaataattgatatagttgtcaaacattttacttatggagtcatcatcaggatgaggccccaaattccactcctccacacaccaccacacagccctgggcatgccaacttctctgtgccagtgttcacacctgaaaatgcggataatgggaaaacgtgtggcagagggtcgtctcgaagactgaatgagatctaaagtgtgctagatacctctgcaacccaaaagagggaagggcagacaaacagtgagggtgtgtgcgttcaagtcaaaacatggatgtttcatcacacaggcttctttgaactctgtctcggtgtggtagtaagcaggaaatcctgcaagctctcaagacggagaggataggagaaaaatcccaagatgcaaatcgggcagaggtcattgtttaaggagcagctttgtgggtcggatctcaagggatgggactgcgcagaatgttggacagaatggggaagggaagacctgcaggtggagggggcacgccaggctgtggaatgggtgtggccaggcaagtctgggtatacacggcgggaagagccgtggtcatagaggaagccttactactggacttcagagaagaatggagtcaccactcacttgctttaggtctggagacctaatgagaatgtatcatcagattcccatacctgtttctaccaaccacatattcagcctggtttcaaagtttatttctggtttccaagttctttggattgaatctatactactgattggataagactgaggaaatgtatgtgttaatggaaatggcaatgcattcctattgcagttgttaatctttccgaagattccagactctgatttttaatggtcttcatttattctaatgagttaacgtaaccacagattagtaaacagggactatcgatcttcacagagcgtaaggaaggaatttacacgtagtaagggcccattgttgtactaaaatcaccactgacttttcgttcagcattgactctgcaccaggccctgtgctaagtgcttcctgtgctttctctcatttaatgcccactacatcgtttgtaaggatcgttacaccatttattcaaaatctcactatttgtcggcagcaaagtcaagactggaacatggagcattccgtattgaaagcagaaggctcctgcccctgtagtgccttaagtatgtggtctgttgaaatcttcactccccacctagaaaaaaaggaaaagaaggaagaaagaaattacacatagtaatgttgattactccctaaagtaattaaccaggattgtgtaatgaatgacaacagagacagacctctctgatgaggtgacagtttagccgagatctgaagcgtgtcctgaagccagccacacacttggccagagaacaagaatgtagcagccctgatgtgggctccagcttggcctgttctggaactgacaggtgggaggctggaaggaggaacttgagttgagactggggagctaggctagagcttcctgggccatgatacaatgacacagaatttgcattttgttctgtaacacactggcaaagacggcacttggctgagaatatccatgagcttttgaacagtagcaatcatgcaatgtccttgtagggatctactgaatgcaggacgatctttctccctagaaagaaagaaagaaacaaagacaaaaataaaggacacagagcttaggacggtcccatgaccttaaaagccaacaagaggacagcaaactcctttatgctcctcttccccactacccaatgcagaagtgcagagtccttcgaactgggagcctcttttgtggccgtgatgactaagaatcaccctggataattgctcaggtatagctttcaccacactttccttcccccccactgaacagaagcaaaattccttgctagggagaaagttcaccctgtactcagtagatactgcaaagtttggctccaacccccttcccccttacttgggggttattgaatactgcaaaagtgatcaaggaaagtacatttatcactcttgcctcaaagcttgagccaggataattttgcacattctgtttaaacgattgacacgagaaagctggatttagttctcccttcttacttcccagcactaaatgcacacctcgctaatccaatttctaggaaatcctcccttgtgagcaggacagcctgtgggtttgcccagatcaggctggcagagggtagataggctcgtttgtgggagcacgttcagaccccaaggattactgtggccttatggctgccagagccactttctattaggtagggggcctttatgtgcccccagaaataatgttaatagtcctagctaacatttattgagcactggttataaatgtggcattgcaaatggattatgatcttatttaattttcaaaacagcctaggaggcaggcactccttgctgtttttccaatttatcagctggcttaagggcctttgcacttgtggctaattctgcctaagttcctcctccttatcagcatggcatgctacctcgcctcctgcagatcctgtcttaaatatcatcttcttggaaaagtcttcgctgaccactggttgaaaatttcaccacatctcccagctgagctttctttatctcccctccctgctttgttcttatcatacaatagactatatgtttaacctacttacttgtttatccctcttctgttagcacataggcttcccgaggactatgatttctattttcagatgggttctggtacataggagacttgcagaagatactggtctaaggaaaaacataatatcatcataactattttgcaaactaggaaagagaagtttatagaaatgagctagtatgggccgggcgcggtggctcacgcctgtaatcccaacgctttgggaggtgggtggatcgcctgagatcaggagttcgagacaagcctggccaacatgacaaaaccccgtctctactaaaaatacaaaaattagccaggcgtggtggcaggcacttgtaatcccagctactcgggaggctgaggcaggagaatcgcttgaacccaagaggcagaggttgcagtgagccgagatcgcgccactacactccagcctgggtgacaaggacgaaactccgtctcaaaaaaaaaagaaaagaaatgagccggtatggtccaggtaagaccgaaaacaagtagcagactagaattaacctaggcctcagaccttctaagtgtttacaacactgcagaaccagcacgtggccaaatacaaagccatccgtggaactgtggttgtgctgggaaataaggagacactactccctattactcccattaaaatgttcttttgaaatcaacttagtccttcaggatgacagttattgatgttaacacaagtggaattttttagcccctcttctgcactaggactctgcttgttgagatccagaggaaataagttatggtctcatctctctgcaagctcactccagttcattgccaatgcaggagcttatacttgtattgagtagacctactgtatggcacataccgtgcaggaagctgtgggtatggagtcagtaacacacaccactgccctctgggagctcagagtttggtgccacaaagcacctacaataactgcagctctgaaaggcacagatgtagattgtactatgtagtattttgttgttgttgttgtttgttttgttttttacagccatagccctgtaagtcatattccacatcaccccataggcatcagtattagaaaacgcatggattttggaacaagtgaaactggatttgaatctgggttgtcacttgctaattgcttactcgatctttctgtgatgttataaggaatagagttaataggcatgcctagtgcctgggtcctagtaagctgctgccatcaccgttagctctcagtatcatcattattattgttctgcctctgggtcacagtgagtggtgaattcagtgcctacaggtcaataggaagaaactagtttggttaaaaatataccccaggtaataacaatagtcccttatttaattaagactaacgtgtattagtcactgtgctatgctgagtatttcgttatcttatttgattctcccaacagtcctataagttatgatgaatatccattttgcagaagagtaccataaagcacagagcagttattaagtaacctgcccaaggtcatgcgtgctgtgtgggtagatgctaggaccctgacccttgatttttttgctcagctgccccaggtcatcaaagtgtgcactggggaggtgactgtattcttgctgtcattcccaaattagtcagagaagcagcaaaaagtaccaaatctagcatcaagaggcttttattcaagcctgtattctgccactgcataagcttcctgacctcaggctgctgacctcactccgaagtcttggtttcctcatctataaaatgaagacgttgacttagtgatgcccagcccctgggcctctggttctgggatatggctctttcattcatcacacagcagacctaccaaagccaatgtcatcagagttagaaagacctcagctgaaaccccagctctgccactcaccagctgtatgacctctccgagcctcagtttccttgtttgtaaaaacaagcataaacataccaatttcatggggctgttacaaggactcactgaaataacataacaatcaggatcccatcaagaagacatctgcccttggaagtcagcatatttgaatgaagggactgcatatgggggtgaatgggcaggattgaaggcatcagcaagggatgctggggcacccagggactagccaaagctgagagctggtaccagttctgggctgagagatgtgtgttagtttgctagggctgccgtaacaaaataccacagactgggtggcttaaacaacatagatttatttttttctcacagttctagaagctagaagtctgggaccaaggtattgacaaggttggttttatcgcacccttctctccttggcttctatatagatgcttcctctccctacgtctataatctcacttctgcgcatgtctgcctcctaattgcttcttcacatgagggcaccagtcctattggattagcctgagacagcactgcagagcctcttcatggagggtgaagccccacaggctatataccagctactaaaaaaatggctaccactctctaaacagaaatctgatctgctgactggctggttggcatggagattttctttttctttttattttttttatgactaatgggctggcctctcctcatcaatctggctagatgcttcacagcacacgaggatgtctcatttgcctcccaagaaggacgagacagcgtggatggccaagcatttctgaccagttgattggacattggtcacccgtctgacctcattttaacttaactacctttttaaagaccctgtttccaaattcagtcccattctgaggttgctggggattagagcttcaacagatgaatttggaggaggacacaatcaactcataacaagatacaaagggaagcaataatggtgccagaagccactgaaggcttgaaccatggagatggctgccaagcagagactgaagtggaggacacagccattgctgggaacgttgcccacccacatgcgagagtgtgcgagggagaaacacactctctttcctcccaccctccaagctgttgccaaagcttccgatcaggaaccagccaccaggggatgccaggtgatcccagggcacagagaagggcagagtatggacctgggagtggaaaaactgagaatatgtgtctggcacagaaggggcactcacgaagtgttcatccttctcacctcataaatgaggaattaaagtagagaagacacctgtgacctctgcacacctccctgaatgtgttttcagcgtctgctttttttctgagcatgcgaatgagtgaataatgaaggcatactcagttgtgcccttccatgcagactcactttgtttaagctggaagttgcagaaagcttcctgccctttcggctgtttaggagctccacattccagcaggtgccagcacatgttcaactggtcagagctgctcggccatccacgccatctctcccttctggggagggaaatgagacatcatcgtgtgccgtgaagcatctagccagactgatagagagaggcagattcattatttgttaaaaatttaaaatatccataccatccaacaaactggccagcagatctgacttctgttcagagttgcagccatttttcggtagctggtatatagcccatggggtgtcagaccctcccatccctcccccagatggctctgcagtgctgttctatgctactgcatctaccccagctcttcaattattgcattgtgctccattttattcagtggcaattttaagaccaatatcctggtactactcagtatattgttcctgctatacagctgcagaaaatacttcctccttcctgaaataggctggagagtttttaataactactgtaactgcagtggcctggacacagccagaatatcttcattcagtaaatgttatctcctgcgttctgatggactgcctgtgaaagcctgtcttgtctcagagcaggacctctaagggacttgacatcttcatggatttctgagcgagagaagagacaactacagacaagtgagcgtgatttctgccttgggtttttcttatcatttactgtctaaaatgtgcaaaattacttgccttctgtgatttagtgattagctgaaaatctgtccaaatctggaaaatgacagtgatattactttactggaactgctgtaacaaagcaccacaaacagtggcttaaaaaagcagaagttggccgggcgtggtggctcacgcctctaatcccagcactttgggaggccgaggcgggcagatcacgaggtcaggagatcgagaccatcctggctaacatgatgaaaccccatctctactaaaaatacaaaaaattagccgggcatggtggcaggcgcctgtagtcccagctactcaggaggctgaggcaggagaatggtgtgaacccgggaggtggagcttgcagtgagccgagatcgcaccattgcactccagcctgggcaaaaaaaaagcagaagtttctggttctagatccttgaagaatcgccacgctgtcttccacagtggttgacccagcaatcccattactgggtatatacccaaaggattacaaatcattctactataaagacacatgcacacgtatgtttattgcagcactatttacaatagcaaagacttggaatcaacccaaatgcccatcaatgacagactggataaagaaaatgtggcacatatataccatggaatactatgcagccataaaaaagaatgagttcatgtcctttgcagggacatggatgaagctggaagccaatattatcagcaactaacacaggaagagaaaaccaagtaccacctgttctcactcgtaagtgagagttgaacaatgagaacacatggacacagggagcagaacatcacacatgggggcctcttggtcggggcggggggaagcggagggagagaattaggacaaatacctaatgcttgaagggcttaaaacctagatgatgggttgataggtgcagcaaaccaccatgccacgtgtatatctatgtaacaaacctgcatgttgtatcccagaacttaaaataaattttttttaaaaaagcagaagtttactcttccacagtcctggaggctagaagtccatgtgaaggtgttagccaaaccacgctctttccgaagcctctaggggaaaattcttctgattcttccttgcctcttccagctctggtagcaccaggcattccttagggtatatcttcaacccctgcctctgtcggccctcttccctttgtgtctgtctctatctcttcttcttataaggacactagccattggattggagtctactctaatccactatgacctcatgttgacttgattacaactgcaaagacattttccaaaaaatgggtcacatgcataggtattgggggtcaggacttggacataccttttggaaaggacataattcaacccataagaacacttttcctcaactttttatttgcaaagcactctgtggttaaaaggaactatctgtggaatctcctcagatctgcagggttgaccaggaattatcactctagttcggcaagtgagtctaaacagactaaggaaagctgagatgagcttaaacagattgactatagagaagcagagagttggaggagtcagaaatagctcaggaggaaaggttgggggagtgtcagggacttagatccttgacctttttttttaacttcgtattagttgttttgctttgaccagccacatagcctttctgagcctcagtttcctgaagccattggggatagagatggggcatggatttgataaccttctttgaggtttttttttttctagcttaatatagattccagaaaagactagcaaagtaggcagcaggcatcacccacccatgaatgcccatccagctttgagaagggggtctctgttggtgcatagctggacacacaaagccagaaattcgctcatttccagtcagcttcaggacccacattcctttactttaaaagtgggaagaaaaatatatgaagaactcgtccaaaccagtaagaaaaagggcagacaacccaatagaaaaatgagcaaaagaacaggcagttcccaaaagaggacaaaatgggcaattaacatataaaaagactatgaccctcattagtcattaaaaaatgcaaattaaaatccatattgttataccactatacaaagtgtagacctaaccgaatgcctaaaatgcaaaaattgagacaatgccagtttttagtgggactgcggagcaattggaatacttcagaaccactttgcaatatctacttaacctgagcacatgcacactcaatgacctggaaattccacttggaggtatgtactcaacagaaatgcatacacatgccgtcaaaagacatgttcaagaatgtttattacagcccaaatgtccatcagtgacataatgggtagagtaagatattcatgtcatagattattacacagcattaagatgaacaaatgacaatggcatgcatgggatggatggatttcacaaatgtaatattcatacaaagggcacatactgtatgattcaaagcatataaagctcagaaatggataaaactatgctattgtgtaagaaggcgagatgagggcaggcaccatggctcatgcctgtaatcccagcactttgggaggccaaggcggtaggatcagctgaggtcgggagttcgagaccagcctgaccaacatggagaaaccccgtctctactaaaaatacaaaattagccgggcatagtggcacatgcctgttatcccagctactcgggaggctgaggtaggagaattgcttggacccaggaggcagaggttgcggtgaaaagagatcgagccattgtactccagcctgggcaacaagagcgaaactccatctcaaaaaaaaagaaagaaaaaaggcaagatgatggcaagatattgggtaggtttttgactgtaagggggattctggtttagtgatattctgtttcttggtctgggttctagttattcaattcatgaaaattcatcaagctgtacagttatgatctatgcacttttctgaatgtacattccactctaataaaaagtttgcttataaaagcaaaaaacaaaagtactctgcaagtttttgttgaaagtatttgccagccaccaaaccgtttgtgtccttagttctatcacaaccttggccaaatgatttctgtccagtgagataaagaggaagagtgaagtgttgttgtctaaaagaaccacttcccacaacatgaaatccaaccacacccacctttgggagcccaccctgtctgcctagaacatacctctatttgcccataacacctccaagctctctcgggcagggacgactgtgttctttgtctctgtgttgctaaaatatatatttattgaatgaatgagtgagtgaatgaccacaccccattccattcacacttgagaaaaacccagccaagttagggaaggtttgagatggaaggatttccactttctctcccacccctccctccttccctatctctctctctctctctctctctctctctctctctgtcactctctctgtctctcactctgtctttctctctcaaaaagctttcaggaagaaataatttaaaaagcaaaagctggattacagaaccttttcatttatatgatcaaaagtgagtcccaggtaaaatcagcaggggattttaaattaagtggtttttaataaacttactttctgttggattatgaataagaagagaactctagtgcttcaaagcagaagggaggaaggttgcgattctgagggtgatttttatcagcatttctgagatgagagtctgcacgctccccagagcctcctgctgagcagctgcgctgtgtccataggatttcactggttcaaaccagcaaagcctcaaaaaccactgaaggactaaggagcaaatcttcattttcacgtagtggatcctgcattagaggtggagagctgaggaagtgcagaccaaagccagtgaggactcaaactgaagggacaagcaatatcctattagagtcctgggggaaaaggggcaaatcgttctgacagtgttggaagccgtaaccacctttgagattcactgtgcacactgatatatcaaaacctatttaactttatttaaccctaatcaatcatctcctacacttatttaacttatttagccctgcttccacaacatttactagcatcctacagaatgctacatcatacactgtgagaagtactgagtttaggaataaaaggtttcatctgaaacttcctctgaacctcattcaaaggagtcatccaggcactttggtccctactttctcctcctgagccaaggaggtatgtggtctgaattgaccaacccaattctagctacattcttgtagctagcctaaagaatgaaaatagggcagggagggaatagtggcagaaccttctcttaaacagttttcataatgcaagcttaaggcattcccctttgctaaaaaagttttaaagagttcttgcctgcaagtagtcctctacatgctatgaagttacttggatggtttcagatgcagaaagaagggaatgttcctaccatgcaggagggaaagttgacataagttagcgctgacacagtgtcctgagttgaatatttattggctccatccggttacccactatcactaatcttggatcaggccctaccctaggcctacagcttccttttcatacaggactgtcctcagggaagccctagttttcctggctttttttttttttttttttttgaggcagagtcgctgcgtcacccaggctggagtgcagcggcgcgatctcggctcactgcaagctccgcctccggggttcacaccattctcctgcctcagcctcccaaatagctgggactacaggggcccgccaccacgcccggctaatttttttgtatttttagtagagacggggtttcaccgtgtgttagccaggatggtctcaatctcctgacctcgtgatctgccagccttggcctcccaaagtgctgggattacaggtgtgagccaccatgcccagccctttcccggccttttataatgattgggatcttcccaggttttcacagaggcagtctgcttatggcctgtggtcttctcaaagtccttcaaacatttacttactgctcctccaggagctactcttttgttttggctttagacccctgattcagcaaagcctcaccgtatttagttatgagcatgtagatacacacacacatacacacacacacacacacacacacacacacacacacacacacgctcccaggaggttgagaccacatggtatggttgagaccacaaatcaaagagtgaaattaattttaccacacgttagttatatggaagctttagtttcttcatctgtaaaatggaggtaattctgtctaccttagtttcttcatctgtaaaatagagataattccatctactttgcaagtttgtcataagaatcagaggtcatctggctgggtgcagtgggtcacacctgtaatcccaggacttcgggaggccgaggcatgcggattacgaggtcaggagttcgagaccagcctggccaacatggtgaaaccccgtctctactaaaaatacaaaaaattagctgggtgtggtggcacacgcctgtagtgccagctactcaggaggctgaggcagaagaatcacttgaacctgggaggcagaggttgcagtgagccgagattgtgccactgcactacagcctgggtgacagagcgagactctgtctcaaaaaaaaaaaaaaaaaagaatcagaggtcatctaagttaagttccttctctctagtatactgcagttgcttgataaatagtaggtattatcatcattgtcaccctgtttagcttctctttttttttttttttttggcagttgcactggcaaaaaataatgtctagctcataaaatagcattattctcactttcctctctgcacagatacctacttttctttccctgccatcttgattactgagctgttgctaaaaagaaaacatggccctctgatccacagatgaaaagccctgctacttgaccagatgttcatgagagaatcctttgatttttaatttatttattcatttatttatttagcgttggtctctgtgctcccagcacaacagctgtaggtaaagtgctgcgggtcacatgcatcccagccagctcccttgacagtccttgtcaaatttaaggcatgttgcctctgtgcagagcactcaggggcaaggggcttgctccaagctcccagaccccgacgacaaggatgggaatgggtggatcaggcagcagcgaatgccaggcaaaggccaaagtcaagctttttggcaccaccttccacctgacagcagaaaagcagggtcaaaagtctgatttggggcacgcattccaaagccaaatccgtgttgtttcagcttaaaaggctccagtttcaaatggaaccattttcataacttgaagcagtagtcacttaaaaatcctctttctactttgcacacatgcacataatttatattaaatccagtgggaattaggcaagttcagtgagggataattagacaccttaatgaggaaatgtatagtttctgtaactgtcatttattaagcttttatgtactacttcatattttgaaagcactgcacagccattaattaggatatttccgcagccccataggagcaaggtcaataaacagagttctgtttctcttggaaatgttgtttctcaagtcttttatgacctgagtgcaaactcctaacctttgaagaaactggcagattgtcttataagctcatatcaatatgatgattatatttaacatcctaaacagactcattagctgcttaagaatataatttaagctcataattttccatacagtggattttctttcctttattattatttgttttcttcctgtggatgtatctcttagctgccacttggaataacctcaagagatctcctaagcatgcaggctgtgacactataagccacctattttcagaacactgagaaggctatgggcctggaaatgtttgcaaatattgcaaatatttcaagttgtccagtacatttcacactcacgggaattttgaagattatttgaataatcagtggattacaaagaaaaatgatttactaggtttggacattaattatccattaataattcccactacagcactggtggatactcttccactgtaccagatgccatttaaatctttaaagtggcatccactttaaagatgccatttttcttgcttttgttgttgttgttgttgtttttaagacagagtctcgctgtgttgcccaggcgggagtacagtggggccatcttggctcaccacaacatccgcctcccaggttcaagcaattcttctgcctcagcctcctaagtaactgtgattacaggcacccaccaccacatctggctaatttttgtatttttagtagagacagggttttgccgtattgaccaggctggtctcgaactcctgacctcaggtgatccaccctcctctgcctctcaaagtgctgggatcacaggcgtgagccaccgcacctggcccccattttcttttttgttcctcacaatcaccttggagttaatgtgggattgtcactatattacaaataaggatctgaggcttagaaacacagtgacttttttcaagaatcatattgatattaagcagtgatatcaggactcagagccaagagtgtgttttccaagtccactgcagttttttctttttccttccccttctgggatagctacaaaaaaaaaaaaaaagaagaagcgtgtgttcccagaattcattctgctgtgtcactctgaggatgtgaggatattggttataggaataacctgtggtaggctgggcacggtggctcacacctgtaattgcaacacttggggaggccgaggcaggtggatcatgaggtcaggagttcgagagcagcctggccaacatagtgtaaccctgtctctactaaaaatacaaaaaattagctgggtgtggtggtgggcacctataatcccagctactcgggaggctgaggcaggagaatcgctagaacccgggaggcagaggttgcagtgagccgagatcacgccattgcactcctgcctgagcgacagtgcaagactccgtctcaaaaaaaaaaaaaaaaaaaaaaggaaaaaggaaataacctgtggataattatagatttatgagcaaagacaaatgttttcacccatgctagacaactttatgcagcctttctaaaattttcttttttgggagaagagggggacatgggtcattaccttttgaggtctgcagttcagatgtggtggacagtatttgctacctgctagatattcagcaacccattcctttgaaatcactgtcctagagagagaagcctgtctggtttgacctttgttcttcctgtctctcacttatataaccttttttatccttaagtttcagtgtagacatcattcatttcaagatgcccttcccctaatgcttcccctgagacacagtcagtttacctgtaccccagctcccatagttcttccccacctcccatttatcacagtgctttgcatttttgtgattacctgtttcccttccctatcaggccttgctccctgagaacaaggactgtgttttaaaaacttccaagtccccagttaactaatgaatagaaccaaagcaggtgctcaaataaaaaaattttgaaatgaatcatagacgaaatgacttctgaatgcaggacctatgaggatgtgaggatattggttataggaataacctgtggtaggctgggcacggtggctcacacctgtaattgcaacacttggggaggccgaggcgggtggatcatgaggtcaggagttcgagagcagcctggccaacatagtgtaaccctgtctctactaaaaatacaaaaaattagctgggtgtggtggtttacacctgtgttcccagcactttgggaggccaaggtgggcggatcacttgagttcaggaattcgagaccagcctggctaacatggtgaaaccccttctctcttaaaaatacaaaaaacattagccaggcctggtggcgcacacctgtggtcctacttactcaggaggctgaggcacaagaatggcttaaacctgggaggcggagggtgcagtgagctgagatcgtgccactcactgcactccagcctgggcagcagagtaagactctgtctcaaaaaaaaaaaaaaaaaacacacaacaaaagcagacagagtcccctctggtttggcatgccaagagcagcttgcctatggcccagctgtggtgtctgggagccctgattcccagaagcccacatgagcctgtgtcagccgagcacacgtgtgacattcatgtttaagaggaagcatggtctttaaaaatgtctaggtacaaagaagagccacccatgggttctgctggcacaggaagcacagggtctttattagttctaatgttctaagataaacagggcagtaagaagcagttgccagcactgtgacatcggaaacatcacctccatcctcagcacctcggttcccacatcgatgcaaacttagcagtaaggtctaaccagcccccctttctaagaatgttgtgagattagaggaggctcaggaagctgagagtgaaattcataagctttgtgacatgtttgctcatgaatgtttttgtctgctttggattctgattcttggttgaatcggggtacagagagtggtatatttagtaaacgttctggaattccaaagagaaaagcagcctgagaatcagctcatcaaattcacagaggcagaggttgcggttgttttatggcagagtgccagttttcctggatgaagtggtctgatgaaagaaaagaaaattaaattatggcgagaaccagatggtctggccacaaccaaggggttatagcttgttctgaagaccaccctgaaatactggaggcctttgatcttgtgaaatggcaggataaatgacagcaacattttagcttggttttttttgtttggttggttggttggttggttggttggttggttggttggttggtttttgagactgagtctcattctgtcaccctggctggagtacagtgatgcagtcgcggctcactgcaacctgtgcttcccaggttcaagtgattctcctgcctcagcctcccaagtaactgggactataggcacacaccaccatgcccggctcattttggtatttttagtagagacagggtttctccatgttggccaggctggtctcaaactcctgacctcaggtgatccgccagcctcagcctcccaaagtgctgggattacaggcatgagccaccgcacccagctagtttggcttttctaaaacagattctgttgtagtcactctcttgctctacatccttgtctggctttcagttgtcctcagtaggacttcccaaccactgtgtcacacatgggtgacaagtgccaacaaaatcatctcctgggccttggggatactttggtagggcctggggcctctgaaacccttggatcagcctttccagccataagcagcttaactcccagtgggttttaagaatagcattttctctgtaggaaacggcataaacatggttggaacgcacctgtgttgcatagatacgaggctcttcctgatttattgcctgtgcgtgtgttcaggcgtctgtcctggcatttgcctaagcctgctattgaaactgtctggccatgatacactctagttcttgcgtagcccagtcttgtcatgcatctcctgcctctgtgcctttgtccatggtgtttcctcagacagcttccccaactgcctgaccaagtcctagcccaggccacccaggcctccctcctgtgagctctcttcataagcactgcatgatctcagtgtttgcagtcatcacattgaatcctaatgatgtacgtgtcttatgtgtgtttccacaaaagggcctggcaaagaatgaatgttacacctccagtaaatatatgctgagttaatatgttgaataaagcccatgagattggccaggcgtggtggctcacacctgtaaaatcccagcattttgggaggctgaggtgggtggatcacctgaggtcaggagtttgagaccagcctggccaacatggcgaaaccccatctctattaaaaatacaaaaaatcagccaggcgtggtggtgtgtgcctgtagttccagttacttgggatgctgaggcaggagaattgcttgaacctgggaggcagaggttacagtgagccgagatcgtgccattgcactccagcctgggcagcagagcaagactctgtctaaaaaaataaaaaaatttaaaaagcccatgagattggtgaaagtagtgaagcaaaataagtacaagtctatttctgtgaattcacacatagtagctactcagtaaataactgttgaatgaatgaataaaagaaatgtaaaaggtgttttaaatttagaatctgtggactcagtaatggctgactgtaagagaaatggaagatggagtagttgaagatgtttcaagacaaggagcgccttcaacacggcaatcccggtccaactttggaagctgcaccctagctaagctctcgagacatgaatcaagattaggatatttattgcagcattgttcataatggcaaaaacatagtaaacaaccaaaatgtccttcaggagaggaatggataaataaattatggtataggtataaaatggatgatgtgattacagtgactaaactagataggaaatactaacatagttaaatcttaaagacataacagtgggtgaaaaggcaagttagaataggaaatacgcaatccaaaacacactaaaaataccatgtgttattatgtgcatagaggataaaaatataaaaacaagcctaggaataaaacacagacccctgggaatactggctgcctttgaggaagagaggaggtagaatgagatgaactttagatttatctgtaatgctttaattttttaacagtaaatgtggcaaggtattataacaaccattatatctaggtggtgggtattcattatattagtttgtgtgcttttctattgttttgaaatagttcataattttaaaaattaaagtcacgcaaaagaaaagactggctaacagggaggatgatcctgcatctctgcatttagtcatctgttttagacattccgacttttcaggcaacctggcaaatcacatctgccaagtctcacaccatttaaaagcatcagttctcagcttggtcaccagagactcataggtttatcctggacctctctagaggcttcaaaaatgtgcattaatatatttcatcattgtttctagtttcccaccatccccccccccattttttaatacattggagcatctatccaacctaattataattcatttttgtaataagattaatgaaattctttctttcttttttttttttttttttttgagacagagtctcactctgttacccccactggaggacagtggtgcaatctcagctcaccgcatcctccgtctcctgggttcaagctattcttgtgcctcagcctcaggagtagctgggactacaggcgtgcaccaccacacccggctagtttttttgtatttttagtagaggtggggtttcgccatgttggcggggctggtcttggactcctgacttcagatgatctgtgcaccttggcctcccaaagtgctgagattacaggcatgagccaccacacctgcccgccctttttttgttttttgttttttgttttttgttttttgagatggagtcttgctcagttacctaggctggagtacagtggcacaatctcggctcactgcaacctccgcctcctggattcaagcacttctcctgcctcagcctcctgagtagctgggattacaagcacacaccacaatgcctagctaatttttttgtatttttagtagagacggggtttcaccatgttggccaggctggtcttgaactcctgacctcaagtgatccacccaccttggcctcccaaagtgctggggtcacaggtgtgagccaccatgcccggcttcattcatatttttgactggaatatattttcttaaatcagtcaccagtgacttacatcactatattctcttggtttgtaactttgtaaatgtttcttttctttctaccccccccaacattgtttatctgagtaaaacaatcagataatacatttatggcgaacaatttccactgtgtaccttcctccccaactccatattcagtgatatgacattgctagcttgaaattagccatgatgggagtgtttacaccttggcaattggcaaatgctacaaatccggccgtttttttcccccagagagctgatggttaaacattaccagcctaccacaagagtgcgcaacagttttctgagctgtgcagggcaagtagcatttttctcatttaacgctcatagaaactgagagtcaacaaaagacagatcttgacctgagtcccatggctccaaagtgacattgctggggctctagtctatgtggttgagtggaagaagcactggccttggaatcacgcagatctgagtttgaatctgacatagctacttttgaacagtgaattgacaagtgtccgatttagcccctcagtttcctcacctataaaataaggataacaaaatctatcttgtagagatctcagggagcattaggggaaatgatacgtgatgtgcaaaaaccctaacaaagcacaaaggacctatgcagcagatctaatttgtccttcagacttacaagttcagatctctgtgtattaacccaatcttcccatagccatatagatactattttttttccaactccacctggccaaacacctttcactaaatggtgaatatatcttttctccaaatatgtgccactggaataagtaaagaggcttagagttgacatttgtatgtgatttggggaaatcagtttctttcctagagtcttggaaatgcaggtgctaggtttcaactaagatcatttttcaactgccttgagtcttccccactgaccattctgctgagctaagcatcctgaagaggattgatttgggggcctctgggtgctacagttccacccaccaaattgactgcagtggcctgcagggaaattctctcggctttttgtgttccgtgctcagggctttttctgcttgctctaactgacctgatggtagatagttgcttctcagccattcagctaagcctaagtgtatttttcttttttagattttaactgatgtatttattttttgcctgaataatatgtttagttgttttagctttttttttttttttttttttttttttgagacggtgtcctgcgctgtcgtccaggctggagtgccgtggcacgatctcagctcactgcaacctccacctcccaggttcgagtgattctcctgcctcagcctcccaagtaactgggatcacaggcatgcaccaccacacccagctaattttgcatttttagtagagatggggtttcaccatgttggccaggctaatctgacctcaggtgatccacccacctcccctcccaaagtgctgggtttacaggcatgaaccaccaccacacccggctgttgttttagcgttttaaaaaacacaaaaggatatagacaaggggagtttccctccctaaacaaccctccattcacccaggtcccttccgcagaaagtaaccaagaaaagataccaaggaagaggaaccacctcttattattagtttcttatgagctcacaggcttctggagctcaccttaaagacccagcgtggatgggccaaaaagaccctcttgaaatcaggaagactgagacaggcccatatggcttgtcagtaatcatcaagcaaattggcaaagccatacccagaataaagtcacagaggagctgcttttgtgtgtacggataaatggtatacatcgtacaaattccacctatcagctcaacctaggtaggtggtcatatctctggggaaaaacacaggagagaacctaatgtctataaggaatgtgctctgtatccagtgcagagctagaatcttttttttcattattgtggtgagatatacataacataaatttaccgtgttaaccatgtttaaacgtacagttgagcggcatgaagtccattcacattgttgtgcggccaccaccactgtccatctccatacaatgctaggctctccctgccctcatcacttactccttccaacagtcctttgaggcctgtatgaccagtctccatacaacaaggaggtctcagagagatggtttcatgtctcctatcgagtaactggcaggtcctaggcttgaacccaggtgtattcgtctccaaaacaggtgccccatactgtggagcctcattggaagaatttttagagggaagactcatctgcagcagtgcataggcctcttgtctgcataagacaatcatccccgagagactgtggctgtgatgtgagtaggtgtgcctagctctccatcttttttattttttaattttctcttttatcctgtgctgttgcccaggggtgatcctgttacttctggataagctgcggaagatgaaatgggagcagatgtggaggctgaccgcagagagggagctcatgggcatgctctctacatccttagctgaccaggtgagtggccaggttcgaaggtgcagctattcctgagtgtgcttggtgctgtttctcaaagaaacttaaaattaaatcgatctgaatggttttctacgtattgtgtgactctgtgtgctctgatacagctgccttattcttgccagtctaagacaacagctcaactccttagtgccttccctttgttcattcatttgttcattcggcagactttcactgagtactgtgtataccaggagccaagttcagaaaaaggatgacagagatagacgaaggatgcagcacttgccctcatagagcttagcgtctactgacgcagactcataagtagatgtcggtgccctcttcatcaccaggtggagtgcacagggcctgctctctgggaccccagaatgccacagcatatttcccaggcaaggtttcactggcctccctggcaaatagagtctaacctttaatctgagccttttgcttagatgctgtcctagtgtccctttactcaagggaaatgcacttaaatagaaagaataaactgcaagaaaaccaccttgctatgcaggcagcctcagaaactccttgaactctaccaaactgttagcaaatattcatttttattattttattttatttttgaggtggagtctcgctctgtcacccaggctggaatgcagtggtacagtctcggctcacggcaacctccgcctcctgggttcaagcaattctcctgcctcagcctcccaagtcgctaggattacaggcgtgcagcaccacaccaggctaatttttgtatttttagtagagatggggtttctccacgttggccaggctggttttgaactcctgacctcagatgatccgcctgcctcagcctcccaaagtgctgggattacaggcatgagtctctgcacccagccaacaaatagtcattttttaaaaacctattcctcattttgacgtcctaggaaaggcagagggctccagtctgactttgagtctaccaggatcactcatttaaattttcatcttcctgtggcactggtagctgtcttcaggcacgaagatgatttctctgagttttctgcatttcaccctttccttttcatccaaagagccagctcactctgcatgtttttgttcaaagtgcaatttcctggttcgtcgaatgcctgcaaagtttcataatacggaggaaacaagaaaccctgcatgattactttactattttttaaagtattattattcagtatttcccaagcagccagaaactgatttcctttttcaaacatgagatagagtataatgaatgagtttaagaaaaaaaataatacccaggtagctgttttaaacctgaggggaaaatcgtccaccagcctcatatttcaagtcgggtcacagtgacttgagcatgtcccccaaagctagcaattgtatgcccatgtccagtaaggatagtttattcagccatcttctgccacgaaggcccataattcacctcccggcgccacctgtcagcagctagttaataagtatggcctggtgcaacagcttggagaagagcccaaaaaaggtaaaacctccctagacaagtcagggttggattttgaaacggggagtgcgtatcctgggcaccatgggctgcagaaatccaaggagcatccatcactgagtccaccgcaggccccaggaagcactgctgaaagggaggatctgtaatttgtctcagtccctgaatgagtggggctacttgtcatcatgcagtttcctctccaggaggctcaggatgggtaacacagggctcctgcctaggaggccagaggggaaggagacttcgtttttcatatgccagtgagggtagggaagacaccccatgtctgcacatgtgagctcactggatagggccttatgagaccagcaggactctggagcttccagtcagcctgggacattcccccgtctctatccaaacattattgcttggttcctagagataacaggcaagagagatgcctcacagtgcgagccagcctgtgttcagagcaggaggttcaagagaagccctatcacaggggatgcagtgccttgagagccaaaatgggcagctggaccatccgactgtcttgactgtgtctttggctttcatcccccaggatattttcaatgccgtcatcaaacaaaaccccttccttgtgtaccagctcccctgcttctggaatgtgcagctgtcagaccacacccgctccgagcagtgctacagagacgtgtctgatctaaaggtagggtcaacacagggacatccctggaggtagggtgaggtgggccgagaggacctcccaggggcatggatggctgggagatttatgtgcaatgtggtgagagagataagggcacaggagagcagaatgagtatgcttttcatctttgtggggtgttggtttttttccacccttatttgggctttctggaaagcctaaagcctcctggcgtaagaaccagcttgtgtggttattattcttgccatctgctgctggctcttttggttcatgccagctccccaaatctattcattcaactcaagcaaaaacatttattgagggcctactctgtgccaggtgctatagatgtggatgtgaataattaacctgcttccaagtcatgtatgacttggaggaggagagaaatgtgcaaagaagtaagtatttaaaaaaggacaaagtgctatgacaggtgtgggtgggtcagtcggggagatgcaagcataaatgtctcattcttcctcacagagggcggacaatgacagaaaaagctttcatcaccactctgtaggtaccaaacactgtgaatgaacctggctatagaaagaggaagaagacagggtatattagtcatctactgctatagataatgctgcataacaagctattctgatagtggcctaaatcagcaaccatttatatagttgatgagtttgtaggctggttggatggttcatttttttactggtttaacagagtatttgtggtcagcttcagatgggacagctggtgactggggcaacttagatgtcctctgtcccctcagcaagccagtatggtgttttctcatggtgaggcagaggtggcagaggaagccctaatacacaagaggaaaccttgagtcattgttgctaatatccctcattggccaaagtaactgtatgactaagcccgtatgattactttgagtaaggagtgtgagttaaggagtgtgttagaattccctccctacagtggaaggagtaaagaattgaccacaactattcaacagaacgaagatttcaacacaggcctgtctgacagcaagggcttttgcctctcaggttgtatcacagaggattagatacatgcatccttaaagaatttgttccatataaagtttatatccattgcaagttttaaaaaggaaaaaggattgcaaagctagcttttctaataaattagtcttttgtacttggcttctgatccatgtccccatgtgggtattatgtcttatttgtagtcataacgcatgttaaatgtggttttctgcttttcatttgttgcatatcataagcattttctgggtgagccacatggtgttaatgaacatcatatccaatagttagtctgttacctagccactcccttgaccttagttgttttcaaattttcataaatataaattatatcttaattaacagctttgtccatgaagcccttccatccaatattgttgtagcttgcctttccaggaatgaaattatagcattagaaagaaagaacttttttttaactgcacttgaaatttatttcaaaatattagaaaggatttaaaacagaggtgcctgcaacattcattccttccatcggcatttattcagttccttctgtatatcatgtgcttgttagaaataaggaaaagagaagaaacagacaggaatattgtcaagaatatcatggattaaaaagtttggagagggggcgaaataaaaccaactgtgtaaagaatatgtaaaaatgctggattaaaaaatattttacatgctttgaaagcataattgatcggttcataaagcaagtaaagaaagcaaaggccagaaacaatgacagagtgaatccaaaaagataagcaaagagcaactggatgtcacctttgcccttggaagggatgatccctagtggcagggagcctggtttaaaggtgagcctggtattataagaaatctatttagtctttgtccctggttcctggaacagagctcctaaaacccttgaaatttcctgagtgataagaacagcttttattgtgtatatgagcccctttgggttatacctgagtttatgctaatgaggtgtcttagagtag

SEQ ID NO: 14782 - DNA, 12317 bp, Human
  misc_feature (1)...(12317): n = A,T,C or G
acctgaattgcagtttcgaccccattccacatccagtctggaacctactggaaccttctcttcatctcacaatcccagccccctctgaccctaacttggcctgggcattgaatgaccttccttcgatggtgatggaagcgtgccatcagggaggaaagcagggctatgcttcctggttgacagaagctgctcctcggaggtgaaaggaaagaggacaggtccagaaaaagggaataggaacgtgcctgcctcctcactctccctgggtcccaaatcctatctttggagagtctatctctgactctctcataatgctcttcaccttactcctaacaccttctccctatcctgcggctctgacttctgtgattctatcagcaactagttcccaatcccaacctcccacgcttattttcttcagagcacttagtatccaaaattatagtgaacaaattcttgtttactgtttctttcacttctttcccagctattccgtaagctccatgtatgtttcatttcttctctgcctctgcagtgcctagaacgccgtgcaccgtgctcactacatatctgagggaggaacgacctggttcccaacaaacacagttccactggagctcagccctgcctccagccctcttcctagcttcattcttttttgggagggaagtgagggtatgtactttatgaaattaaaggataacacataatgaaatgaatgaagtaccctagacgcccctcagatcaagataagaacacctccagcagcctatatggcctccctctgccagggatactcaccagtagaggttgtctgagaattgctcagttttgctggttctggaagttcctatcaatggataacagaacgtatcccctttaatgtctggctctttttgctcaatatcatctttgtgagactcatccgcattgcagttcattctttttattcctgggtagaattctattttatgattataccacaaaatattgatcatattaatccattatttaacttaattcttttgtcttttttttttggagacggagtcttgctctgttgcccaggctggagtgcggtggcacgatctcaactcactgcaacttccgcctcctgagttcaagcgattctcctgcctcagcctcccaagtagctgggactacaggcgcatgccaccacgcctggctaatttttgtatttttagtagagacaaggtttcaccatgttggccaggctggtctcgaactcttgagctcaggtgacccacctgccttggctttctaaagtgctgggattacaggcgtgagccaccacgcccagctatttaacttaattcttatgccccagatttcactctgtcttctaatttagtttttttttttttttttttggtcttctgattttatatccaactccaatccctcaccagtggatcctggccccacaggaagcaacagatccccttctcctaccctgatcgttcctccccgcagcatcttcaggcctttgggcacccatgtggtccccgagccctagcttcaacacctcccacccttccagtcacagactctgggccctggggcagaaggacaggccagctttctcactgtggccactacctgtcccatttcccagagaggaatggcctggaggctggccagctgcgctgccacttagtgcccctccccctcccctcccccgcccaccagtggcctcagaaccaatgcaagtcactcactgcccatggccctgcttagtaggggtgcctggcactgtagccaatggggactggcaggaggaaggagcttattagtctgataaagatctggggaccacaccctgccccctcccgcaacttccctagggccctggctcaggctggactggctcccccaccctgaaggcgccttcatccacggcatcttctatccgccctttcagaggcaggcccagtgccctgcctgctcttcctccccaccagctcccagaaggcttggagcccagacacctgctcactcaccaccagctgggctccgcctgggcctgcccggcacccaccccggccaccaagggcagcagcttttccagaatttggctggcaggcccagtcaccccacctcgccacctcaccactgcacctcggaggccagccctgtccactccactctgtgcctggcttctcttgcctgccttgggccttcgtgtggcccctccacggtgtctgggactgagtgcccctcttgcctcctgaagagcagccatggccacctacaaagtcagggtggccacaggcaccgacctcttgtcgggaacacgggactccatctcactgaccattgtggggacacaaggagagagccataagcagctgctgaaccactttgggagagactttgcaactggggcggtaagagtgtgtgtgtgtgtgtgtgtgtgtgtgtgtgtgtgtgtgtctgtgtgtgtgtgtgtgtgtctgtgtgtgtctgtgtgtgtctgtgtgtctttgtggccccgggaggggtgaaggtgcgcagggggagccaggtgagctgagcttggcgaggagaggctggagagctgaggcacagctccgaaggcagtgggctccccagtggctctacacgccttgtccagagctggcttccagcccctcgcccatgtcccagatctctgggccatccttctccatcctgctccttcatctctaaccctttcaggcattcctcatctccctccccatccttttcttctctctccctcttcctcagccctctctccctgtctctgcctatcctgcatctctcttttctcaatcctttccacctgctttccttcccctttgctctcctcccctttctgtcttaccccctctcccgcatccctctctcttccattctcagtcactcttcctaattcagctgcctcctaactgtctcacatttgcactggattctctgtgacttaaaatggcatcagaccagcctgtccagtggaaggcacgctttgcgggtcctcagacctgattttcagtcagacccagccacctgctgctaggcgaccttaataggtcactctatctatgtggccattctgaatatctgcatcttcattgatgaatgggagaaggggctggctgggcctctccccactcgaaaactgtagagtggtacccaagtccccaggggtctgaagggttcctgcaacctcaggtgcctggagaggggagtgggagaagacaggagctggggatggagagaaggaggggctggagtcctacatagccctgggtagaggaatccagtaggagacccccaagctggagaagtcagaaggaagctcaatgatcaggtcaatatcctgtccctccgtcagtccagggaggtgagcattgcgcagcatgagcagggcctaggtgaggggccagaggggtgggcggcctgggagccggggtgaagtcctgcccactcagccaggcttgcatcctgcctaggtgggccagtacaccgtgcagtgccctcaggacctgggtgagctcatcatcatccgcctgcacaaagagcggtacgccttcttccccaaggacccttggtactgcaactatgtgcagatctgtgcccccaacggccgtatctaccacttccccgcctaccagtggatggatggctacgagaccctggcactccgggaggccacaggtaagccctcatcaccctgctccatcctatggccgtgaggcctctagctccagcctgctaccctggcatggcacccaggctcccatcaagccagaggggggcccagccccaccagggactcctgggctctcctgccactgtcacacatttccctcagtcagtgctgctgccctgagctcagcttggggctgcacattggaggaagagaggtgcctgaggcccagcagctaccctcagcatccccatctggcagcagacagcattcccagagtgcgctccccgctacatctccagtcctccctgactcctataagatgcccggccatgttaaaaataccccttgtgatgctaagtacaggctcaggactctcacaggaggcctatttatgatgccaatcatatgcgctccagaaagacgccctgttactccagcaggattctgttactataacaggatgccccattattccaaccagcaccttgctatcctatttagaagccctttgagttcaacaggtctccatggtgctgtggtcttataattatgacgccctggctttctttttttgggacggagtttcactcttgttgcccaggctggagtgcaatggcacgatctcggctcactgcaacctccacctcccaggttcaagcgattctcctgcctcagcctcctgatgctagtttttgcatttttagtagagatggggtttcactttgttggccaggctggtctcactcctgaactcaggtgatctgcctgcctcagcctcccaaagtgctggcattacaggcatgagccccagttttctaattgagcattttttagactgatgggatgttctattgctccaaaggactccctattttcccaacaggacaccatatttctctaacaggatgcactgttactccaaaaggccccccttaatccagtaaggatctatctaataggggccctgttattcagatagactgtcagggtttctccaaggttaaggctggccaaggctgcccagtgggttttccacttgcttggttactcccatgggagagacataggaccggagtggctgagctccttgcacccacccctgccagagccccttgtgtggtgggctggggtcagcttcctaatttgtggtgctgcatgaggactgggggcctgtcctctcttatctcccagttccaccacctgagtgtctgttggcttcccttgaggcgaatgggagggaaaggctgagctgaggacacccagggcccgaagccccatcctccctgcagctgactacctctcttccgtttctcattgccctgtgctggaatcttcccccaggattggggaacagggcctgagctggggaaaggagaggcgaggaaagcctgggagatggtgagcatgccaaggggagggtctcactggggacacagagcatcttcctgcagtgacaggtctgggtgacatggaagcaggggacaggcagggtgatgctggtggccaggcaggaatggggttgggtggggccgctgccacgcaacaggacagggagacttgagtcacccatagggccctcaaaggagtgaggcttccgccctggggatgaaaacgagctgggtctctgggttgcacaactccagggagcactgttcatccagaatacaacatgagctgaggcaggtggaggagggagagggtggtgaggtaagggacttgaggggaaatgatgggctgcagcggtaggcacaggccagcctggggaccaccagccagggtgctggagaaagacggacctggacttaggtctcagttcttccgctgactagctggacatttgggcatattttcaaattttttttttttgagatggagtctcgctctgtcgccctggagtgcagtggcgcaatctcggctcactgcaacctccaccttccaggttcaagtgattctcctgcctcagcctcctgagtagctgggactacaggcgagtgccaccacgcccggctaattttttgtatttttagtacagatggggtttcaccgtgttagccaggatggtttcgatctcctgaccttgtgatctgcctgccttggcctcccaaagtgctgggattacaggtgtgagccaccgcacccggccacatttccaaattcttctaagccttggttccctcatctgtaaaatggagataacaacagaacctacttcatagggtggatgtgagaatccaataagatgacatctgaacggagttgttttttttttgttttgtttttgttttttcttttgagacagagtctcgcttcgtcacccaggctggagtgcagtggcatgatctcagctcattgtaacctctgcttcctgggttcaagtgattttcctgcttcagcctccagagtagctgggattacaggcatgcaacaccacacccagctaatttttgtatttttagtggagatggggtttcatcatgttggtcaggctggtcttgaattcctgacctcatgatccacctgccttggccgcccaaagtgctgggattacaggcgtgaaccaccgcacctggcctgaacagaattttaaaaggcttaacaactgttggtggtcagaagcagcccgctacggggcaaatccagccttgtccccacgtaatacataatagcgactgtttctccttgtaaaatgggcatggggatacagtcctttagctgaaactgttgattccaggggtgctttgaaattcggattttattgagaagctacatacacatgtatctgtacacatgtgtgtatgtttatataaaatatgtatatgtatacatatatatcttcatctataaatctatatcacacacataccccatatattatgtgctatatctaccacagggcaccccaatcaaatatactaacacttcccagtaaaaactatgaatagttagacccagtgagttaaataaagattgtatatagcctcagggagattcacagcaggctttgtcaaccaatgaatttgttgtggaacaaacagacaaacttgatttccacagctttctgtactttgcagttgtgacgaaggggtcaccagcctatagtaatagtcacctgcctcatagggtgcttcttaggcttagattaataaaagtaaagtgtctacaaagtgcctggtgttggggaccagcctcaacaccacctgtagggtacccaaagtccggtggtgacgaaggaatgagaagagacaggttaagagtgcaaaaagagtgggggccagggaagcagttgcaaaatggaggctgcaaaaggcccagagttctggtctccacactatttattgagtacagtcacttagatctaagaagcagatgttcagggtgaaacactgaaagggaggcagtgcgtcacaggcgtaatctatagcaatagcggtttaaacgaatctcctttgtgctcaaacagcacatctttaacttatcggagagcagctagtgggaacaggcttaactaggagcctgcgcgtctgtccacattccaggtttcaaaggagtgtctttctccttgaacacagtgtttatagataagacagcaggttaacgctcagagcatgggaccataatggcgataagaacgctttcctcctcagaggccttttgtgacttaccacagcttactgtcacatatttttatggccagtttatacaggcaccccacaagcccttttcccaatacctgggacctagtaagtgctaaacaactgtcagttattaatatttcagtggtatatacccaaaggaaaagaaatcaacatatcaaaaagatgccttatttattgtggcgctattcacactagcaaagatatggaatcaccctaagtgccctaatggatgactggataaagaaaatgtggtatatatacacagtggaatactattcagtcatgaaaaaaatgaaatcatgtcatttgcagcaacatggatggaactagaagtcattatcttaagtgaaacaagccagaccagaaagtcaaataccgaatgttctcacccataaatgggtgttaaaaaatgtgtacacatgggccaggtgtggtggctcacacctataatcccagcactttgggaggcagaggcgtgcagatgacctgaggtcaggagttcgagaccaccctggacaacatggcgaaaccacgtgtctactaaaaatacaaaaagtagccgggcatggtggcaggcacctgtaatcccacctactccggacactgaggcagcagaatcgcttgaacccaggaggcagaggttgcagtgagccgagatcatgccattgcattccaggctgggtgacaagaacgagactccattaaaaaaaaaatgtgtacacatggacatagcaaaacaatagacaatggagactctcaagggtgagaggatgggagggggtggatgatgagaaattacttaatgggtacaatatactttatttgggtgatgggtaacctaaagccctaacttggccactatgcatgtaacaacattgctcttgtactccatgaatttatagaaataaaaaatatttcagtgggtctagaggagggactttttgcagcagcagagcttagcttgacagtagagcaagaggaaagagggtgggtccgtgattcttttatctgatatttccggacaggacgcaccttcactctcccaaggtgagccttcccactccttggtcatgggcccccccagagacgacctggggcacagaagctgaactcctgcttcctgaagtgggcaggggcaagggtcagcccttgagtcctctccttggtctccctacaggaaagacaacagcagatgactcgctccccgtcctcctggagcacagaaaagaggagatcagagccaagcaggacttctaccagtgagggggcgggtggcagagtctgggcgcccggcaggggtccagggaggtggggggcagtgatggctctggccctttgccctggggtggtgcacgggcatgagggtgacatctcggtttcccttgcagctggcgagtctttcttcctggcctgcccagctatgtgcacattcccagttaccgccctccggtgcggaggcatcgcaaccccaaccggcctgagtaaggacccgaagctgtgctgggccccgcccatggttttcccctgggcgcctgcctcctccccgccccctggatcccagttgccctgcgcttctccccacaggtggaatggctatattccgggattcccaattctcatcaactttaaggccaccaagttcctgaacttaaatctccgctactccttcctcaagacggcctccttcttcgtccgcctggggcccatgtgagtgcgtgtgagtgacgggagaacgagggctcctgcaagaactttccctctcccccaaccttggcggcctccaagacagccccagaggttggaatggccaggaaggcagagggagctgaaacgcagacccagaaaacctgagacatgatcccagagacctagagatgcaaagaccttgagacatgggacccagagactttgcgacgcacagaccctgagacccagagacctaagtggatggggcggccccgccacctgccccagccggcgcttggcagcccctctgaaggcctcttcctggaatcccatctcctagggcactggctttcaaagtccgcggcctgttggactgcaaacattcgtggaagaggctgaaggacattaggaaaattttccctggcaagaaatctgtcgtctccggtatggaatggggcgtcccggatcgagcagggggagccaggcggtctccggcgtgctaggcaggcccccgacttcggggcagtgggacgggagaggcagcgaggcgcgcgcgcgccctctggcggcttcttggaaaatgtcgcaccgggctcctccggccgctcagcgccaggctgggggcctcgttttcctccccgactcctctcggtgcccatagtcttcttctgtcccatgcctctccgtccccgaggggggccgggcctccttgtgacgccctcgcgccgtcctcgcagagtacgtggccgagcactgggcagaggacaccttctttgggtaccagtacctcaacggcgtcaaccccggcctgatccgccgctgcacgcggatcccagacaagttccccgtcacagacgacatggtggctccgttcctgggcgagggaacgtgcttgcaagcggagctggaggtgaggcccgctccggcggagaccccggccctcctcccggcctccctcgcgggcatccccgtctctccccacctccggcgcccgcgccagtcccaggcaagcccgcaccccgcgtccctgtccccgtcccacccctgcccctagtcgccagcgccctgtgcacctgcggcgcgggtcacgggcttcccgtgtgggtgcctacttgccacccatcgcggctcccctccagaaggggaacatttacctggccgactaccgcatcatggagggcatccccaccgtggagctcagcggccggaagcagcaccactgcgcccccctctgcctgctgcactttggacccgagggcaagatgatgcccatcgccatccaggtgcctgggctgcaggcggcgctgccgctgagcctctgtgtgcgcgaatgctcctccgagtgtgcgcgcgcttatgtgagcgtgtggacctgcatgtattcagccgtctctcgttatccttgagagattggttccaggacctccccgggatgccaaaatctgcagatgctcaagtttcttatataaaatgtcccagtattgcccggacgcggtggctcacgcctgtaatcccagcactttgggaggccgaggcgggcggatcacgaggtcaggagatcgagaccatcctggctaacacggtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14783 - DNA, 14087 bp, Human
gcctcctgagtagctggaattgcaacctctgcctcccgggttcaaatgattctcctgcctcagcctcctgagtagccggaattacaggcagtcaccaccacacccagctaatttttgtatttttagtagagatggggtttcaccatgttggtcaggctggtctcgaactcctgacctcgtgatctgcctgcctcagcctcccaaagttctgagattacaggtgtgagacaccatgcctgaccatgatctcattctttttcatggctgtatagtattccatggtatatatggaatatacatgataagtcactctcacttcagttggctttcatgaaacactgtgacaggcacaagaggacaaagtgtctgccggcatcgttctcctcctacctcattgactgaactttgctgcttccactcctttgcatgacttccaaatatcagaggaccttagggcacagcttgtgcctcttctcttctctacttataggatattctctgcctagtgatctccaccagcctgtggtatagatgtacctgtgtgcttgtgactcaaagatgcacacctgcagtcctgagctctatgcccagacgtgggttctccacttggatgtctaatggccatctcaaacttagcatctccagaccgaaaaccccaaatctgttatgttattcccccaaagcccaaatccataacttccccttggcatctctcccccaaatccctccctcactgcactcttgcctttccctcctccaacaagccaagcttttcctaaccacagggcctcttcaggaacagtttcctctgcacaaaactctgttccccagacagatcctttcacctcctctgaggctctgaacgcctcccttcccacctctgcttctcactccttcacattagtctgtttcatttccttcattgcacttattatcatctgaaattatgtgttggtttacttattttctctcacacttgattttttttttttagaccgagatttgctctgtcgcccatgctggagtgcaatggcacaacttcacctcactgaaacctccgccttccgggttcaagctattctcctgcctcagcctcctgagtagctgggactacaggcgcccgccaccacgcttggctaatttttttgtatttttagtagagatggggtttcaccatgttggccagcaactgtgcctggcctcacacttgatttttaatctccatgagagcaagcactaggtcttgcctgggcctttatcaatagcagtgagcatagcacctggcacagaggtagttctgaacattaattattgaatgaaataaaataatgaatgtaggctgggcgcggtggctcacgcctgtaatcccagcactttgggaggccgaggcaggcggatcatgaggtcaagagatcaagatcatcctggcctacatggtggaaccccgtctctactaaaatacaaaaattagctgggcatggtggcactcgcctgttgtctcagctactggggaggctgaggtaggagaatcacttgaacccaggaggaggaggttccagtgagccgagatcatgctgctgcactccagcctggcgacagagcaagcctctgtctcaaaaataaataaataaataaataaattttaaaaataatgaacgcaggcccaagaagagttgtgggaaatggggtgatatttttgcatagacttctaaggctaagaaggaaaacaaacagacgtggtgggcacaaatctacccccaccccaactgggtcccaactctaggctctctggcctggcaccaccactgaaaggccccgttccccaaacctcagggtattcttagtccctcctgttcccagcgctgccaatcccccgcccacccccactttagttgcgtgttccagcctctccgccccgcccctccccgccctgaaacggacgtgctttttagaggagtccactgggcttggagtcagtggcaataaccaggggcaataaccaggcgtgtcccaggggggagccccgctctgcagccctgtgcgccgtagagagctggacttaggctggcagcatggccgagttcagggtcagggtgtccaccggagaagccttcggggctggcacatgggacaaagtgtctgtcagcatcgtggggacccggggagagagccccccactgcccctggacaatctcggcaaggagttcactgcgggcgctgtgagtgcgtgggagtggatggggtggaggtgaagggggcgagcaggagggtccggcctgacgcatacttaacctcccctcaggaggaggacttccaggtgacgctcccggaggacgtaggccgagtgctgctgctgcgcgtgcacaaggcgcccccagtgctgcccctgctggggcccctggccccggatgcctggttctgccgctggttccagctgacaccgccgcggggcggccacctcctcttcccctgctaccagtggctggagggggcggggaccctggtgctgcaggagggtacaggtgaggggcgggccgggctggggctgcagggggagcacaggaaggggtaggggactgggggttggggagaagggcaggtgaaatggagaggtgagctggtgtggccacagagtagcgggcagaggagagggaatggcggagccttggggagcgggaggtagcagcctggtgtaggagaaactgtacttatgggaggaggggacctggtagagggtggcaatcgtggagactgtgtggctggtggtagtgatggtgagtttctctccccaccccaacctactccccttctcccacagccaaggtgtcctgggcagaccaccaccctgtgctccagcaacagcgccaggaggagcttcaggcccggcaggagatgtaccagtgaggagggggttactgatgggggagggtgtgcccaaacgatgaggggcagcttgagtgtcctggtcatgacagagattaaaagcccctgcctccacctctcctatcaaagctgctcctgggatcagcagcgtctacaggaacgtattagaaatgcaaattctcaggccacctccaacctactacgacactgagggtgtagagtgggaatttttgttttgacaagccttccagatgactctggtggccactgatgtttgaaaaacactgctctagggccaggtgccgtggtggctcacacctgtaatctcagcactttgggaggctgagggaggcggatcactggaggtcgggagttcgagaccagcctggccaacagggcgaaaccccatctctactaaaaatacaaaaatcagctgggtagggtggcgggcacctgtattctcagctacatgggaggctgaggcagaagaatagcttgaacccgggtggtggaggttgcagtgagccgatcacgccattgcactccagcatgggggacagagcaaaactccatctcaaaaaaagaaaaaaaaaaaggaaggaaggaaaaggaaggaaagagagaaagaaagagagagaaagaaagaaagaaagaaagaaagaaagaaagaaagaaagaaagaaagaaagaaagaaagaaagagaaagaaactgctttaaatgccttacctttgctggtgtcttccttgccctgggactttttcatgcatcggcttgttgtgtcctcccagaaatctgagtagagccagaaacacgcccttcaagccccaggaaactcaccctccagggctagcaaggggtgagatgggggctctctctgtgctctgggctcagcattggagatcacaggggaaaactgggacttggagataacagaggagttggagataacagaggacttggagataacagctagtgaggattcccttggcacaaagccaggaactgcattcagaaacagattttcaaaagatcttgatccggccaactcatctgctatctaaagcctgggctgcaggcttttgctcctggtctgtgggatcagagcagccacaggctcatttggttcctggtgattctccatgtgtcatgaattccacccctaaggaaaccattgcaccaaatctggcagcaacagccccaagagagggaatagacattgagatctactgtgtccatggagacccagagtcagcctaggccctgccaaaacgagctgtgagatcttagaccaattttttcatctcttcaattcttattttcttctgtaaaagaaactaagaataccaatctcgtttgggttaggaggaacaaatgagaaaatggttaagaatgtaggtggtcagctgctaagtcttgcacaactgtgtgctcttgctgttgttcctgtctttcagttcactctgttccaacactctaggctcttataaaacgtacagtgaggtctcagatccattgcaacagcattgcctgggagcttgttagaaatcagaatctgcatttaaccaagatctctatgtgagagggattcaagtctgagaggaagggtttggccaccacctggtggcagtgtactttaattgcaaatttttctttgaagttgaaagctcaaacccaaaagcaagttttgaatgaatcaaagaatgaatgagtgagagcatgactggctaggggtcatcaagtttgcagatacatgaatttaccatttccctggaaggtctttggctgtgttgcttgtttgagaatagaatttagagatgcctcgggcggctccccctaaactatgaaggctgaagtgcctctctatgggacacctaccaaaggcaactgaaaccttctgcgcagcccctgtcccaggatagtctcgcctctacaagatgcgtctgtgttagtcgggacttctatagttgcaagaacaaaagctaactccaactagcaggcagaaaaaaagtttgtcggccagacacagaggcacttacagaaacacaggcaggaattgtccacccagtggaaaatggccataactaacagtctgtgtttactgctataatctacatatccagagagagaccacctctctggctcagccccaatggcaaattccctggaaaggactctgattggcccagctctagtcaggtgctcaactctggaccaatcacccttgaccaggggagccatctcactgtgggaaaatggcagctcccttgcagcctccttgggtagaatggaagggcagctcccaggagggccctcttggctgaaggggtctggctgtgaccaggccccccaaggggactgccactccatctgccctagcaaagagtctccctgaggcctcttgctgaccaccttccctctctaccctccaggtggaaggcttacaacccaggttggcctcactgcctggatgaaaagacagtggaagacttggagctcaatatcaaatactccacagccaagaatgccaacttttatctacaggctggctctgcgtgaggatgcccacccttccctgcccctgggcctcagatgccctatgacctctgccttctgccctcccctagtcagttcccccaccctcagtgatatgagtcacatagtcctgcccaggaaacagcctccttcccactaccaatcccacagagcaacagctaccttaggggtagtgactaccttgggcccggaggctggttcaggatcccaagaggcataaggctggctgacagggaagggtctcccagggcctcctccccactccccacccctcacatcccctggcagttttgcagagatgaaaatcaaggggttgctggaccgcaaggggctctggaggagtctgaatgagatgaaaaggatcttcaacttccggaggaccccagcagctggtgaggagcttgggccagggatcctgacctctttcctggggcatcagctcctgtggctgcccagagtctcagaaaaccaagcaccaatttgctatgtaaccctgatcaggtccttgctagaccttacttttccccacagagacaaaagagaatatggacggaggggatccctgaccttctaacgccttctaatacaacagacatttgttgagctgctacatatcagacaccgggttaggggctacatggttcttcacggggctcacagttgagcaggccagttggtgttaattagactcaaaatcaaataattcatttcactgtgaaacatgctcattggatccagtgagggtgtaaagggggcacctgccataccctggagagggccccaggaaagctctcccaagggggtgaactatgctgagacctcaaagttcagtaggccttagcagtgccaaggatgggccgtgggggcagagagcagttcggggaacagtgagtgtgaaggccctgaagacagaaggatcagccacctttggaggaaagaaaacaccactgtggtcaaagtgtaatgaacaagagaaggagagcgagagaaggagcaggaaggtgcacgggggtcgcacaggactttgtcggccatggcaggacttgcgtctttcctcagcccagtgcttgactggttgccagcaggggaataatgtggtcactgtgcactgctggggggcaagagactatgagaatctgctatgaggctctggctgtggtcaccagaggatggtggcctcagcaaggcagtggcaatgcaatggagaggatgggtggaccgagaggtactcaggatggagaatcaatgggatttgatatgtgaggggtactgccaagagaggtccccaggctccggctgggcgcagtggctcacacctgtaatcccagcactttggaaggccaaggtaggtagattgcatgaggtcaggagtttgagaccaggctggccaacatggcaaaatcccgtctctactaaaaatacaaaacttagccaggtgtggtggcatgggcctgtagtcccagctactcaggaggctgaggcctgagaattgcttaagcctgggagatggaggttgccctgagccaagatagccccactgcattccagcccgggcaagagagtcagaccctgtaaagagagaaagaggtggggagtgggggagagagagagagaggaaggaaggaaggaaggaaggaaggaaggaaggaaggaaggaaggaaggaaggaaagaaagaaaaggaaaaaggaaaaggcggaagctgaggcagacagatcacttgagcccaggagttcgacaccagtctgagcaacatggagaaaccctgtctctaccaaaaagacaaaaattagccaggcatgctggtgtgtgcctgtaatcccagctacttgggaggctgaggcaggaggatcggttgaacccaggaggcagaggttgcagtgagccgaggtcacgccactggactccagcctgggcaacacagcgacacagcctgtctcaaaaaaaaaaaaaaaaaaggaaagaaaaagaaagggtcccgagtctcctctgtaggcaactgggtgggggatggagctgccacttcccaaatatcaggcaatgggactgacctgagctgtaggaataatctgtatttggcctgcaacgtgttgcatttgaggctagtgagttattcagggggagtgtcaggcagacactgggatgcatgggctggggactatgatttgctgctgggtgaagaggcagtgactgaagacaaggggcaggggaggtaactctgaggacacactgtgaagattagccagaggcctgtgggagctggggtaaccccgtccccgtgtcccccaccccctgcaaagcacgcatttgagtgaccccgttcccctgtcccccaccccctgcagagcacgcatttgagcactggcaggaggatgccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagaggtgaggggtgcagggatcttggctctgcacagtcccatctcagtgccttcacacccgtcccctactggagacagaggggcacactcacatttgttagggacctaccgcgtgctgcgtgccaagcacactctcccgaaacacactcctctcccagccctgaatcctctcccttctacaactgcacccccttcatttagaaaaccaggtggcagccccagatctcctttcttctgcagaagggctccctgttcttggtggatcacggcatcctctctggcatccagaccaatgtcattaatgggaagcctcagttctctgcggccccaatgaccctgctataccagagcccaggctgcgggccgctgctgcctctcgccatccaggtatgcagtcaggcaggggcagggcagcgtgaagaagagtcaggagaatggttggaagacactcatggctgcctctctccccacctgcctccccccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaaggtcagtggcttgacaaggtggcccagcctgtgcccatgcctctgtgcctcttctaagcagcctttcctcacatggccctatccatgcaagctgggatgcagagcccccgtccgcttcagcagcatctcctggcacaactcccctggaagcctgctatccagcaggccctaagtaacataaatgcagcaccccagaaaggctctcgaagggagatcaggcagcatcaacagccgtcatagaagcccaaatcttaggaaggggaaggacctggggctggcaggtgccaaagtttgaacatggctttgagagaccaagttctctgcagatacttctggggtaggggagggctgggtgggaggcccccgtgctctagggtgggttctgtaggtttcctagaccctgctagctttcagacggcatggattcgaggcatctcctctgtgaagggcaggatggccccctcccagggtccacccacagtcgctgctcagattctctgatccttctagacttctcctgggtcccagatgcgggccctactctgtgctcttctgtactagctggttctttctgactatctgcagcttctgaggcctggcgctcagaggtgggctctggtggacggctccacattgccaggcccacaggccctggttttcctagtgccttccctgcctaggggctaggaaatcacaggatgccagagccggaagacacagggctcagccacatcagcacccacgtttgacaaaacaacctgaggctcagggagaggaaggagcacgcctgagctcccagaacaagctgctggtggagcccagcaggaactccagggctcagacccctgtcccaggctgcctcctctcattcttgttgcctctttccaagtgacttgcagggctggtgcctgtgtgggggaaggtctggggccagaacaacccaggcctcccctagctctgccattttcctgccatgcagctgctgatcccgcacacccgatacaccctgcacatcaacacactcgcccgggagctgcttatcgtgccagggcaggtggtggacagggtgagagctgtgttggggagggagtaggcaggccactccttcaatgtgacgaatttgaggtcctggggtaggagtggcccatctccccgacaccagtgctacctcctgcttctggagcaaggtctgtaggacccaagagtcctgtctctcagtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatttggggtgcagtggaacggtgaggggccgtccctggagagccgagggctggtcggggacgtgggaagacaggaaaggagactgaggccccagggaggctcacgttgaggaggagggccagacattcatgatgctaagcagaggcattcctcagagcgggtcggggttggaggctggacctgaacctggatgcattgcagctttgtctctgaaatcatcggtatctactacccaagtgatgagtctgtccaagatgacagagagctccaggcctgggtcagagagatcttctccaagggcttcctaaaccaggagagctcaggtacagggacctcagccctcaggcgcatttgagtgagcccatccccgtgtcccccaccccctgcagagcacgcatttgagtggccccgtccccgtgtcccccaccctcaaggctcaccctcaagcctccgcagcagggtcctcaggtccctggaagccccatcccagcccagctctccttgcaggtataccctcctcactggagacccgggaagccctggtgcagtatgtcaccatggtgatattcacctgctcagccaagcatgcggctgtcagtgcagggcaggtgaggaaaggccagcgcccgaggtggcaggctggaggtgacccagctcctcagcctcattctgccctctcggccttcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaagtgagtgtggggctgggggccaggctgggccaaattggggtaagagagggtgtgatgtttaccctgctggcccagacccaaccctgccatcaggtagcgggtccctttgccccactgaccctccagtgggacacatgagccttggacatttcacagtgaaggtcaaatggccaaatgcgatgatgcggagccactctcagtagcaaggggaacgtgtaattatgcttcttggaaattccgaattgagctttcattccccgaaagcttcctgcagataagctttacatggatatctgtttaagaggagggacatggatcaggccccatcgagggctacttcaggtcccacacttgggggctagggccagagctggctaaggcaagttgcagctgctcagatagtggggaccaggagtctgggatgcaggacctcagcagccgcctcacccaaccttgtggtggatcctcagaggcccctgggcacctatccggatgagcacttcacagaggaggcccctcggcggagcatcgccaccttccagagccgcctggcccagatctcgaggggcatccaggagcggaaccggggcctggtgctgccctacacctacctagaccctcccctcatcgagaacagcgtctccatctaaatcccaggggaacacaggcccagatgacatccctttgaccacatcgctctaggataactggcacccagagaaaaggactcctcagaaaaaacaggcccccatgtgcctctcctgggacaaccagactctgtaactcacccccaccaccatacacacacacaaaaacagaaacaaaatcaaaacagagaaagcagaaaatctaccaagaacagagtctcaggacagaaccactgagtcttttggaggctccaagcctcaaagtgcccgcagagcccaccttgagggttttgctagttggttttgttttgcgttttacagccgtggggggaagcacataatcccgccccagggcccactagcatccactgattggaccttatggtcacccaactcaaggacagccaccaagaagtggctgccaaagagactgggcgcagtggctcatgcccataatcccagcactttgggagatggaggcgggaaaatcatttgaggtcagaagttcaaggccagcctggacgacatagcgagactccacctctaccaaaaaataaaaattaaaaaacaaattgggcctggtggtgtgtggctgtggtcctaactactcgagaggctgaggtgggaggactgcttgagcccaggagtttgaggctgcagtgagctatgattgtgccacggcactccagcccaggtaaccgagcaagaccccgtttctattaaaaaaaaaaaaaaaaaaaaaacaaggccgggcgtggtggctcacacctataatcccagcaccttggaaggtcaaggtagagggatcacctgaggtcaggagttcaagaccagcctggccaacgtggtgaaacccggtctccacccaaaatacaaaaaatagctaggcgtggtggcacacatctataatcccagcaacttggaaggctgagataggagaatcacttgaacctgggaggcagaggttgcagtgagcccagatcatgccaccgcactccagcctgggtgacagagtgagactccgtctcagaaaaacaaaaatgaaaacaaaaaatgcccaagaggttgattgtgacctactgtctcagctttaaagtgaacaaaacactgaaaaagggtcactgggagccaggcagaatgagaacacccagtcggcacaggcagtgcctatgtatactttcttaaaaacatcccctaaagttaaagacttgtacgttataaggcaggttccgtttccagagaatcagaaaacattgtcatatctctaatcatactttgctgctagatttcatcatcactgatggatttacatttcatacacattctttcattctgtttttcttttttttctggctcatagtcggtgagcatccattaaggtaaaaaagtgtcctttaaaaaaaaaaaaacaactcccgtggcgacaactggtagacatcaccttaatcaaataatccaggtgagttcaggcgtggtggctcacacctgtaatcccagcactttgggaggccgaggcgggcgaataacttgaggccaggtgttaaagaccagcctggccaacatggcaaaaccccatctctactaaaagtacaaaaactagccgggtttggtagcaggcgcctgtaatcccagctatttaggaggctgcggcaggagaatcgcttgaacccaggaggcagaggttgcagtgagccgagatcatgctgctgtattccagcctgagtgacagggagagactctgtgtcaaaaaaaaaaaaaaaaaaaaaaaaaaaaaatccaggtgaacttgctgataccatgttgctttgctctaatgttgtaagaagagcacctcatctctgtggtttcttctagaaactcataactacagtctagtgatgagaaaaatacagacaaacccagattgagggacattctgcaaaatacttgaccagcactttccaaattttaaaattgcctttgcttttttggtgtaaaaacaaaatgcatcctttacaattcatctaatgatttccatcactactacacattgcaggcatgagtgcttttgtttttcagtttcactgatttttataaaacaatgtggacaaaaatgcaatttatatactataactgcataaacattaccattggaaaaaaacagaacagtgcctcagaaagggtagggctgactggcaagtggcatttgacatgctcattcctcgttgagagtgagtataccgaaagtgatttagagatatatgtatctgtcaaacttctttccatcaattcctgctaacttaagcaataaaggagttaatggaaaagaaatggagttccttgagaagttaaagagctgactatgcaggccaggcgcagggactcacgcctgtgatcccagcactggaagtccaaggcaggaggattgtttgagcccaggacttcaagacagcttgggcagtatagtgagaccccatctcttcaaaaaaaattaaaaagtagcagagcgtggtcgctcacgtctatagccctggctattcgggaggctgaggagggaggactgcttgatccacggaggaagaggttgcagtgatc

SEQ ID NO: 14784 - DNA, 8060 bp, Human
cccaggctcctgggtgaattattttatcctcccctatgcgctttgtcagccaagtgaatgtagaaaagcaagcaaaactccagaaccccacaacgattcacgccacgcttcggtggcacaactcttttcttccccttttagattagtactgtgcagggaaggctgcacctgctaccttcagacaccggggatctggctaggaccctcttcctctacccctactctctcctcccgtccccaccctctcccagatgcaccccaatccagcctctcaaccctgtcgctgtttgcaaactcgagggatgtttagtgcaattgcctttaaataagcaattcacgtaagaggtatttattgcagagggtttcaggtctgggagggggtaaggagttagttaatgaaggattagaggcaaagctgggaaagaacgagtagacaggccagtttctttctttctttttaaaatctattattctggaaaacccttgttcgaaaagagtaaagaattgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcacggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacggtaactatgattatctgctagtgctgattttaaagtcccaaaagcaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaagcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatccccggcgcgtgggagagcgctctgcgccgcgcccccagccctcgccctgcagctagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagtcatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaagccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgatcagagaaataccacagaaccagtgccaatgtcagaaacatattctacaaatttactcacttaaatgtttaatgaatatttggaaggcattttcaaaccataagaaacattttaaattatcttcttttatgaattc

SEQ ID NO: 14785 - DNA, 7583 bp, Human
ccccatctctaccaaaaatataaaaattagctgggtgtggtggtgtacacctgtaatcccagctacttgggaggctgaggcagaattgcttgaatccaggaggcagaggttgcagtgagccaagatcgcaccactgcactctagcctgggcaaaaagaccaaaactgttgtctcaaaaaagaaaaggaaattaggttcttaaaggcatcttcccagacgtgagagtgtctgcttttgcctggtatagtagtgcctgcaaatgttcaaggaaataaacaggtacccctgttaagcctataggtaacttctcattgctccccatcttctctgtactcagcactttttttttttgttttgtttttgagacagcacctctctgttgcccaggctggagtgcagtggctgaatcatgggtcactgcaatctcaaacctatgggttcaggcaatcctcctgcctccgaagtagctgggactgcaggtgcgcaccaccacacctggatagttcaaaataaaacttttttttgtagagacagggtctcactatgtcttccaggctggtcgtgaattcctgacctcaagtaatcctccctctttgaccttccaaagtgctgggattacaagtgtgaaccactgcacccgccgtggcactttttttttttttttttttttttgagatggagtctcactctgtcacccaggctgggtgcagtggcgtgaactcagctcactgcaacctccacctcccggattcaagcgattctcctgcctcagcctcctgagtagctgggattacaggcacccgccaccacacctgaaaaatttttgtaattttttttttcttttttgagacggagttttgctcttgttgcccaggctgtagtgcaatggcactctctcggctaattgcaacctctgcctcccgggttcaagcgattctcctgcctcagcctcctgagtagctgggattacaggcatgcgccaccacgcccagctaattttgtatttttagtagagatgcggtttctccatgttggtcaggctcgtctcgaactcccgacctcaggtgatccgcacatctcggcctcccaaagtgcaggcgtgagtcaccggacccaggtcccgccctggcactttttaaccacccacaaatctggatcctacactgaaaagagacactgcagtggctcacgtctgtaatcccagcactttgggaggccaaggcgggcggatcacctgaggtcgcgagtttgagaccagcctgaccaacatggagaaaccccgtctctactaaaaatacaaaagtggccaggcatggtgtcgcacacttgtaatcgcagctactcgggaggctgaggcaggagaattgcttgaacccaggaggcggaggttgcggtgagccgagatcgcgccattgcactacagcctgggcaacgagagcgaaactccgtctcaaaaaaaaaaaaaaaaaaaatcctgagtcccgcttgacaccttttgtcaggcaccaccacctttctgggcgaatgcggtagtaccgtctgctctccctgctgctgtcctgaaatccattcaggcacagcggccgagagctttataataaccgattccaggtgttaggtgctttcccagccccgactcctgcgtcctggacccgcagtcctctgcttaatacctttgctttattagaaaacattctcctctactccgttcagctattcgctgagggcccgccaaccgccagcggttgtcagtggcctagaggcagcggacgcaaacacggggagaggtgcaatcgtctcaagtgactcggcgggcggggcccacaaccggaagcgggtgggcgaccttcacccacgtgcgctgcggcttcgttcgccagcatccaagatggcggcagggcggggcccaaggcgcggcgcgaattgtgacgcaggcgtccggcgtgctccgtgcgcaagcgctttcggcggcgattaggtggtttccggttccgctatcttctttttcttcagcgaggcggccgagctggttggtggcggcggtcgtgcgggttcgcgccgggccgagagcgggttgggggctgcgggaggctgcaggggcctgggcggcagaagaggcggccctgagctggctcatgcgggccagtctcggcagggtggctgggcagggctcgcgaggccacggctcggagcccagaccggggcccaggaggcgagcgccgttttggagaggagcctgcctgctctgcctgccagcgtgaccccacgaggcctcgggcgggaagaggtcctcggggcagatccgagttaatgagagaggggtattgagcgtgtagcgttaactctgccagtcactgcgtcagtcgctttggaaatactaaatttctcgagctgagtcttcatacctggctccattactacgtctgtaaggaggagctggtggtagtgtctgctttttagacttttctttagactatttgtatttttttcagatggagtcttgctctgtcgcctaagctggagttcagtggtgcggtctcggctcactgcaatctccacctcccgggctcgagcgattcttctgcctcagcctcccgagtagctgggattataggcgcctgccaccacgcccagttgatttttgtagttttagtagagacggagtttcaccatgttagccaggctcatcttgaactcttgacctcaaatgatccgtctgcctcggccttccaaagtgctgggattacaggcatgagcccctgcgcccggtcgattctttgtctttttaagtcaacttttatatgtgaacaatgcttggcaggtggttggtagatactaagtgatgttcgtggtttggggtcaaggcaagaagtggggtctggagagttttggtgtaattgagaaggaagctaagagtgttgggtgctccagcttggagttagagaggagagaggctgcgacaggaaggcatgtgtgttgtaggggatggcttcccatccaggctggcagcaggagcagcctgtgcagatcaggacctggctgccgtggaagagggtgggaccgccttcagggaagatggatctagcaagatgatgccaaagggtacttattccatcaggagatactgacgagtccttccgccgctaaacctaaggagaataaccacagtctgtgttcctgaagagcacccgtgcggtcaggagggtggaggacatgtggtctttagttccaggacatgtttagactacaggccagggtgtgtgagaagcctagcagggccaggcttggaggagtgaaaggaagacaggtactggggcaggaccagttggacttggtgcaggcaaagggatagcaactgtggtgtaggcacctgagcttgtgctactcaggcatgcattgctcaccagtctatcctgcctcccttcctcctgcagacgcaaacatgcagatctttgtgaagaccctcactggcaaaaccatcacccttgaggtcgagcccagtgacaccattgagaatgtcaaagccaaaattcaagacaaggagggtgagtagggctgggtgtgggggctctggctgtgaactgggagtccctctctgcccaggggagtctcagtcctgtgtgggttgtgctgactttagatctgttttgcccttgcttctccatgtgatctgaagaacgtttgttatcttctacctcagttggccttttgagaaactgggggtagtgctggagctcccctgcagaggacactgccagtaatatggtccgcagagcctctaactgagcctccctccccctcaggtatcccacctgaccagcagcgtctgatatttgccggcaaacagctggaggatggccgcactctctcagactacaacatccagaaaggtaccggggttggggttgctgggcagggacccaagatccccaggtcctaggaaaggagcattgatggcctcaggggttggggagcagttcaaatgacttgtgttttgtttaaaataatgggactgggcacagtggctcatgcctgtaatcccggcactttgggaggcttaggcgggtggatcacctgaggtcaggagttcaagaccagcctggacaacgtggtgaaatcccgtttctattaaaaatacaaaaatcagctgggtgcagtggctcaggcctgtaatcccagcacttcgggaggctgaggcgggcagatcacaaggtcaagagattgagatcatcatgaccaacatggtgaaatcccatctctactaaaaatacaaaaattagctaggcatggtggtgcgtgcctgtagtcccagctactcaggaggctgaggaaggagaattgcttgaactcgggagacaaaaaaaaaaagtcataatgtgaatttttttatcactgcaataaggaaattagtgtcacttgtgggagcgacaagaattcagtgtcctttttttgtgagacagagtcttactctgtcacccaggctggagtgcagtgacgcgatctcactgtgacctccgtctcccgggttcaagcgattcccctgcctcagcctcccgagtagctgggattacaggcacccgccaccacgcccagctaattttttttgtatttttagtagagacagggtttcactacgttggccaggctggtctcttaaagtgctaggattacaggcgtgagccatggtgccccgcctagacttcagtgtctgaccttgcctgaaccacttagaggtcggcttccatgttagaaacccagatggatgcctcagttggcatgtgtcagtctcagactccccccagggctcgtggtcagtgctgagatggagatttcctggggcaggctggctgggacagtgtatcttccacacgtagaacactcgggggatcccgacttggtgtccccatcacacttgagaaagcagcagactataggccctggagggtcctgcccctgtgactgaggagccagggctgggctcagtcgccgtccttctggctgtctcctgcagagtccaccctgcacctggtgttgcgcctgcgaggtggcattattgagccttctctccgccagcttgcccagaaatacaactgcgacaagatgatctgccgcaagtatgtgtgctccgatgcttggggggctgtgggggctgccggagtcggggtatgccctcacccacccctcctgtctctgtgcaggtgctatgctcgccttcaccctcgtgctgtcaactgccgcaagaagaagtgtggtcacaccaacaacctgcgtcccaagaagaaggtcaaataaggtggttctttccttgaagggcagcctcctgcccaggccccgtggccctggagcctcaataaagtgtccctttcattgactggagcagcaattggtgtcctcatggctgatctgtccagggaggtggctgaagagtgggcatctcccttagggactctactcagcactccattctgtgccacctgtggggtcttctgtcctagattctgtcacatcggcattggtccctgccctatgcccctgactctggatttgtcatctgtaaaactggagtaaaaacctcagtcgtgtaattggtgggactgaggatcagttttgtcattgctgggatcctgtcaggcactttgaggtgtccctcaggccttggccctgaagtgtctaggtgtgtggagatgggtagaaaattaggtacacccaatggtgtagaacgttgattctcaaatttttttattttatacaaatggggtctcactatgttgtccaggctggtcttgaactcctgggctcaagccatccgcccatctcagcccctcaaagtgttgggattacaagcaagaactgccatgcctgacccagttctcagttttttgtttgtttgtttgtttgtttgttttgagacggagtcttgctctgtcgcccaggctggagtgcagtggcgcagtctcggcttactacaacctctgcctccggggttcacatccttctcctgcctcagcctcccgagtagctgggactacaggtgcccgccacaactcctggctaattttttgtatttttagtagagacggggtttcactgggttagccaggttggtctcgatctcctgaccttgtgatccattcgccttggcctcccagaatgctggtattacaggcgtgagccagcacgcctggcccagttactcagttttgaatctgaggccgtgacatcactcatggtctgcagtcagtgctctgcccctgagctgtaccctctcctatgataatcactcttaagaagggcaacccttggtgttttccccttaaggtcacccaggctggaatgcagtggtgtggtcatggctccctgtaccctggaactcaggcttgggtgatcctctctcctttgcctccgaagtagccaggactacaggtgtgcacccaccaccacactcagataattgctttggtgtttttaaagcttgtaatgatcagtaggctgaggtgggcaaatcataaggtcaagagttttttagatggggtgagcacagaccaattcctgttttatttactgatttaaaattttgagacagtctcactgtcacccaggttggggtgcagtggtaggatcatagcttgctgcagccttgatctcccaggatcttgcctcagcctcccgagtagctgggactgcatgcttgtgccaccacactcggttaatattttgtagagatggggtcttgctatgttgcccaggctggcttcaaactcctgaacttaaaagcctcctgtttagttttggttttttatcactttttttttttttttttgagatggagccttgctcccatcgtgcaggctggagtgcggtggcgcagtctcggctcactgcagcttctgcctctcgggttcaagcgattctcctttctcagcctcttgagtagctggaattaccagtgtgcgccaccaccaccacgcctggctagtttttctgtttttagtagagacagggttttgctatgttggccaggctggtcttgaactactgacctcttgtgatctacctgtcttggccttccaaagtgctaggattacaagcgtaagccacagcgcctggccttgctacatttttttttttttttttttttttacagacatggtctcgctatgttgcccagaatggttttgcactgggtccaagcagttctgccgcagcctcccaaagtgctgggattacaggggtgaggcaccttgctggcccctgttttgattagggtgcagtgctggtgaagccggtgcacgaggccagtgatgcatcctaatgaggggtggagttggcgggacttcctgggccagtttggggactttcacaaaagacccccatgactcagggttttgagttcttaactgatcgaatgaaggattcaaaattaaccactccaaggggggattgaaggaagaaccactcttaatggacaaaaagaaagaaaggggagggagtaacagggatatgagctctagccgcccaagctagcaatggcaacccttctgggtccccttccagcatgtggaagctttcctttcgcttcattc

SEQ ID NO: 14786 - DNA, 36952 bp, Human
cccaagtggtaccactagctgggaacctcgccccctccaccaggccctctccccagcctgtcctttaggattgctgagtcagtggttagatgttcttacggctcttctctgaaacggagttactgctccttcttaggcacccctggctcagccaagccctgacccacctgacgggttttcatgtgtgcctagctgggtggtggacttggagaggcacagggacagcttggggctccaggggggcattgaggcagcactgatgcagcttaggattagcaaggtcaaggtgactggctttcacccatatgttcctctgtatggatttcactgagcctcgattgctgccccttttcatggcattttgttctgggattttgctttgaaagttagggctctttcagccttgtggtgagcagtgaattgtcctcgtcctctgcttcactttccagattttgcccagaaatttccctgcagtgcttaggaagctgcctggtagagcaggtttctaagtttgaggcgaagcagctctggaagctgcctctgtccttgctgttggaggcagtgatttaagtagcagttgcctagagatacatcctttctgttttaatctcaaagagagaaaaacccagtccctgtaatcccagctacttcggaggctgaggcaggaggcaggaggcaggagaatcacttgaacccaggaggcggaggttgcagtgacctgagatcgcaccactgtgcgatctctgtctaaaaaaaaaaaaaaaaaaaaaaaaaattagagaaacacccttgtcttccccccgggggtgccaggagttgggcatagagctcgaggaaaccctttgtccccctccaccccccagcatgttgggtaatcccatagcttttttcctttttctcatactccctaagcagccatgcctgattagcaccggcagcggtaggaaagacacatccgttggtgtagacataatttcctgcctcaaatgttgctgttcattttcttttcaccttgttttctcctctggacagcttctcagagaagaaggcggaagggctaagtctgggcactgcctaggtcattggcccatcctgacagggtcagaggaggccaatcatgttgactggtgacttgatagggtggcatgtgacccaaataaaggaaaactaggtttttgccatgtagtaagtgccaacacagagggtgcacccagccggcacagactgtggggcaggaatctgtaatatctcatgtgggaagcaggaatacttgcttggccccaccaggaatctggaaaatgtcaagaggtttcattgcctgaaagagctacttgcggggtgaggagaggcctaagactagagaagaagcgagtagatgagccagttttacgatagaggttgcggatttcacagagcgctgagcacctttctttgacaagaaatcaagtcttaggatctatttaaatgggtgagatccagtgatttctagcaaccaacctaggtcttctggggtcttaataccagaagcaggcttagcacaaaagctcctttggactctaatctgttttctgcgtggtggtgtcaggttaagtagactcacctgcctctttaaatcctgatggattgactgggaacggtggctcatgcttataatctcagcactttggcaggccaaggtgggaggatggcttgagaccaggagttttgagaccagcctgggcaacatagcaagaccctgtctctaccaaaaaaaataaataaataaaaataaaccctgatgggtggtgtgaaaatgagaaggatgaactaaacacgtctgatgggtcaagaggggccatggagcagcactgtcagttgctttgggtgggtttgggcaaggcctgatgtgaaactccagaaccagctcctgcatgaggagaccccagggagatccagttagacacttactggcagctggattacgtgtaaccgttgagaagggtccgtgttgagaataacatctgtctctgtcctttagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagaggtatgcggcatgagcagcggggccggatgctggcttttgtgtgtgtgtgaatgagtgttatttcctttattgttttatatagatgggattatactaattgttatatcctaacaattaatagttatatactgactgtataaatgttatactcacatttatatagatgggaatatactattccttttttgttgttacttatcatggcctcctctcccagcctgttctgtctgcctcggtctctgaagtccgtgtaggattcacagtatcatgggggacagaagtgctataggttgttgaaccctcctgtcttgacgcatatttctagtcatttccagatgcctacataatccagtaaaactccttctgtgtagatcttctgatgtacttgtatatgcagatttttagcaaatattcctaaaattgaattcctagaattgctgggctggtagggtttttaattctgatatcgtgaaatcgatcgctagagaaattttggtacctctctttggatcaaaggcatcagcatttttaaatgaagcttgaactgatttgtgtactggaatccatatcaaactacacaaatttgctaaatccctaacgaaaacagtaatgtttcagcaaactgtgagcagacccaaagggcgttgatggtattaattatacatcagcttgagtggaagtcaaaccaagctagttttagaagctatccagaactggtaaaggtaaacctgaatctttttaaaaattgtgataaagtacacgtaacataaaattcaccattttaaccatttttaagtatacagttcagtgacatttaagtccatccacactgctgtgaaactgaaagctggatcttaatttctagtctctaaactgaactgaaatcaattgactttcatttggaaaaagccccacttcactgtggtctgtcactttgatggtgtcagagggtccaggacctcagtgccagggtgcgaggagagcagtgctgtgcagtggggaggaacctcaccatcacccagtctcctcgccagagggtccaggacctcagtaccggggtgcgaggagagcagcgctgtccagcggggaggagtctcaccatcacccagtctcctcaccgtcacccagtctcctcgccagagggtccaggacctcagtgccggggtgcgaggagagcagtgctgtccagcggggaggaacctcaccatcactcagtctcctcaccagcacactttttctccatgtctcgttttgctcctcctctggtatttgtatttcttaaagaggattttgaaaagagatggtgaagttggtattttaggtagaagggaccaattgtttcctcaagactaagttggtccaaccaaactgacagagacgaggtctctacatatgaaagatggaacctggccgggtgcttcgggggctcacgcctgtaatcccagcactttgggaggccgagacggatggatcacttgaggtcaggagtttgagaccagcctgggcaacatagcgagactccatctctacaaaaaataaacaaaattaggctggtgtggtggcgagtgtctgtagtcctgtctactcaggaggctgaggtggaaggatcacccgagcccaagaggtcagggctgcagtaagccatggtcacgccactgcactccagcctgggccacagaatgagatcccgcctgtctcttacaaaaaaaaaaaaagaaaaaaaagaaaaagaaaaggccagcagtgactgccaccactacctctccccatggtgacaagagaagctttactgtgtcagccatctggctgcccaaagcagaaagcagagctcccctgcagtactctcactcgcccttcttatcgcatcaggccccgctgactccgccccgcaacactctcactcgcccttcgtgtcccatcaggtcccgctgactccgccccgcaatactctcactcgcccttcgtgtcccatcaggtcccgctgactccgccccgcaacactctcacttgcccttcgtgtcccatcaggtcctgctgactccatctcctcagcgtctccaacatgtcccttccttgccacctcttgcctggattactacagcagcttctaacgagtctccctgcctttcagttctccgcaccgcttcaagtgttcagtctggatggtctgtcactcccagcgccaaaactgctgacggcttccctttgccttcaggacgaagtccgtgctgtctgacataacttataggaccttttagccagcctgggcaacatagcaagaccctgtctctaccagaaaatacaaaaatgagccaggcatagtggtgtgcacctgtagtcccagctacttgggaggctgaggtgggaggatcacctgagcccaggaagtcaaggctgccagtgagccatgatcacaccactgcactccagcctgggccacagagtgagaccctgtctcaaaaaaaaaacaaaaaaatcttttaggatccagcttcaggtgtctccttgaattccccaccttgtacctgcaccggttactctgaacttgtccctcttttctccagcttttcccaccccactcccatctgtctcttagcttagccccactcattgtcccatgtgttggttcatcctgactttcctcgcagagcctgcccggtgcactgcatgtcccccactgtgttctcacagcactccgccacccagggccctgtgcccaccgcattatggcatgaacttacagtgttgtgcttggccttgtctagttacacgccccagtagaccggaaactccttgagggtgggagccacatctgtttggtttctctgtgtgtccccctgcctggacctagaaatactcgcctgaatggggatggcagtgagttcgtgaatcacagaggccgccccaagtgctccaggttagctctctgctctagtttgctcttctttcttaggcctgaggcactaaagctgatgaggttgccagagcttgccaaagactggacagattatctgttagaaaccaaggacggctgggcgcggtggctcacgcctgtaatccccgcactttaggaggctgaggcaggcagattgcccgaggtcaggagttcgagaccagcctggcctacatgacaaaaccccatctctaccaaaaatacaaaaattagctgggcgtggtggcgcatgcctgtagtcccagctacttaggaggctgaggaaggaggattgctggaacccaggagatggaggaagcaatgagctgaggtcgtgccactgcactccagcctggcgacagagcaaggctccatctcaaaaaacaaaaacaaacaaaaaaaaggaaaaggaatatatgtaccattttcattttaattttaaaaaatctttctaggccaggcacggtggctcacgccactgtaatctcagcactttgggaggctgaggcgggcagatcatgagctcaggagattgagaccatcctgtctaacatggcgaaaccctgtctttactaaaaatacaaaaaattagccgggcgtggtggcgggaacctgtagtcccttctactcgggaggctgaggcaggagaatctcttgaacctgggaggaggagcttgcagtgagccaagatcgagccactacactccagcttgggtgacacagcaagactgtctcaaaaaaaaaaaaaaaattctaaatgttttcctactccgtcaaaccacacacctaccaaaaaaaaaaaaaaaagcagggggcttatactgtacatgttgttctgtaacctgagataagaattgagtagaagagaccgggcgcggtggctcatgcctgtaatcccagcaccgtgggaggccaaggtgggtggatcacgaggtcaggagttcaagaccagcctggccaacatggtgaaaccctgtctctactaaaaatacaaaaattagctgggcgtggtggcgcatgcctgtaatcccagctactcaagaggctgaggcgggagaatcgcttgaactgggaccctggaggtggaggttgcagttacccgagatcgcagcactgcactccagcctgggcgacaaagggagactccgtctcaaacaaacaaacaaaaaaaaagaattgagtagaagaaaatactttgtcctgggaggcaaatggttctaggccctcctggcctctcagagctgatgaaagcagatcagataatcctggatcccaaacccaagttagtcggctagttaccctggccctaaaccgagactggttcatgcttggaggcatctcctttgtgtttttctcgcaccttgtagtataatgccctgggcccagcaagctctggaaaaatgtgtaatgctgatggaaggggtgatgagccacagcaggtagcctggggtctcttgtgtggtcctgtttctggtggctggtggggcacgtcgtgggtgtgtgttaggagccagccaaggtggggtgtcaggctctcatacgtaacttctcactcccaccagtaacctgctcattgcatggaaacttgcttgtcagctccccatgaagaagctggatctgaaaagcctcttgtctcctttctctctaccatttctctttatacccctttttttccccgctatagcaaagtacccacgtttgttcgaatgctggccccagagggagccctgaatatacacgagaaagcctggaatgcttacccctactgcagaaccggtgagtgcagccggggccacgtcggccaggcaggggcgggcagcagagctgtgggtcccacctgcgtgttccggattaggccagggaaaggctcgggctgggtcccttccggctgatggtgggtatcagtgctgtgtccagcacagcttggtggacagcagggcgagaagcaccggtcgtcacggcctgagagcacagagccagtctctcacttggggatgctgcgattttgattattgttattcattataacattttagtatatttttctagtcatttttatttatttatttattttttgggagatggagtctcgctctgttgcccagactggagcacagtggcgtgatctcggctcactgcaacctctggctcccgggttcaagcaattctgctgcctcagcctcccgagtagctgggactacaggcgcataccgccacgcctggctaattttttgtattgtagtagagacagagtttcaccatgttgcccaggctggtctcgacctcctgacctcaggttatccgcccaccttggcctcccaaagtgctgggattataggtgtgagccactgtgcccagcccagacacattttctcgaaaaattttagatcattactatttattttattattattttttttttgagatggagcctggctctgttgcctaggctggagagcaatggcacaatcttggctcactgcaaactccgcctcctgggttcaagcgattctcgtgccccagccatacaagtagctggaattacaggcatacaccaccatgcccggctaatttttgtatttttagtagagacggtgtttcaccatgttggccaggctggtctcgaactcctgacttcaagtgatccacctgcctcggcctcccagaatgctgggattactaatatgattactaattttttaattgctttttttgtctcactctgttgtccaggctggtgtccagtggcacaaccacagctcactgcagccttaacctcccaggctcaagtgatccttctgcctcagcctcccaaatacctgggactataggcatatgccatcatgtccggctaggtttttttttttttttttttggagagatggggtctcaccatgttgcccaggctggtttcaaattcctgggctcaagcgatcctcccaccttggcctcccaaagtgctggcattacaggcatgagccactgtgcctggcctaagtttctcatttttcttcagtgaatggataacattttccttgtcactaaggtgtctggtgttttgttttgttttgttttttaatttataatagctgcatagtattccatcatatgaatgaactgtggcttctgctgaaacagcatgttctgtaattgaggatacaggtataattattttcttaatcttggccagtctcctgcatagagtttcttgaaaggaaaggaaagatttgaacctccacagagaactttctattctagtccagacattcttaaatttctttcgagtgattcagattcttagccttccaagattcctaggtttccagggccatctaggaatagacctgttgggagggcctaagctggtactgattcataaccctggggagtcctgagaggtcccctggcacttgtctgtgaggtaggtgacctttcctcccaccagcctccatgtgtgggtacagacagtgttgggctgcggggtcctcccaccagcctctgctgacctgtcctcctgcacttgctttctttgttggcacctggtactccctagagtctgatgagtctgggatccttacgtgacgcatatcacccttatcctgtggactttgggaatgactgcaatccagaatacggggtcattgctctttccaaccctcagtggccccacacaggttcagggaccttgtatcaggagatttgcggtcattggtggggtctgggatgtgtaacccttagagttttcttgctgtagctgaagcacagccctccctactccttaagcactgggctggaagttagattcttggaaatgagggatgcacagatgttcttaaaagacagggtcgggcacggtggctcatgcctgtaatcctagcactttgagaggctgaggcaggcggattacttgaggtcaggagttcaagaccggcctggctaacttggtgaaaccccgtttctactaaaaatacaaaaagttatccgggcatggtggtgcatgcctgtaaccccagctacttgggaggctgaggcaggagaatcgcttgaacctgggaggcggaggttacagtgagccgagatcgtgccattccactccagcttggacaacaagagcaaaactccgtttattaaaaaaaaaaaaaaaaaaaaaaaaggcagtatgcagtgtggctgggtgtgtctggtctagggccaaaggtggattttcttgatgtctaagagagtcgcagtgagcatgtgttgcaagtgtggacatctccctgcctggggcagggttctgggtacacagcttgtgccaactgagagatgcccctgttctctgtgtcattctgggaagagtgttgcggctgacatgggcatttttctgcacgttaaatgttcatatattgatccttggccaaaagaaaagaaaaacataatttctgtatcagcaccatgcgctaaccaattgcgccactggagctccactggaaaaatgtaatttctaaatatttcatggagacagggagtaggggaaggaaggttggtttcctcagtgggtgctgacctcctattcaggatacaccttcacacagaatggatatgttgaatcttagatctgtttagttagacacttgctcttttaaaataagagataccagcaggcaaggaaggctactttccagttccctctgggggctgatgggagagaggttattagttcagacatcttagcttggcctcagtagatccaagtttgaaggaagatagatgaaggagcatgaagtaaaatgcctcatggcttttggaaggctcttcctttctctgagcggagtgaaaacagattgggacaccctggtaatgatcagctcttgctgttcttagcttgtttccctctctctttttcccttgaagctgatgggatgggctggaagtgaggagagggtaagataggagttggtctgtgaatgaatgaaagtgggaaaaggaaaagaaagtttgtttctccttccatctcttcctggaactatagtcctcggctggatacagtatcactaagccatgcttttatttatttattttaaatttttttattttttgagacagagtctcattctgtcacccaggctggagtacagtggtgcaatctcggctcactgcaacctccgcctgctaggtttaagcaattctcctgcctcagcctcccaacagacagtgttgggctgtggggtcctcctcctgtcagcctccatgtgtgggtacagtgcctgggattacaggcatgcgccaccacacccggctaatttttatatttttagtagaaacgaggtttcaccatgttggccaagctggtctcgaactcctgacctcaggtgatccgcccgccttggcctcccaaagtgctgggattccaggcgggagccaccgtgcccggccctgccatgcatttaaaatgccttattagtctcatttggaaatctctgctctcccactgcaaaagatttcctgcggcttttctgtgtactttgggttacagtttgaacaacagggaatactggaatgcagaggtgtttgagggcctgggagggctggagaaggtttggggaggattgtttgatcacccaagtttacatgaaaaggtcagcaagggctgtcaccctcatgatttcggaaaaccaggttgtcagaactgagtggatctgtctctcggggtctcacaaagatgaatgtgtaaaaaccccagcgccagtctatgaagttacactaaaacgcagaattgctaccgaaacgggacattcccattcgatgatcagggcattcttttcttgtggattcttctacatgagaaaccaaattataatcagaatgccaatgtgtggcaaagaatgtccgcttggctgagtgatcagattcttgggtccattgatgagcacgtctcggagaggccgaactaggagagactttcttagaggagatagattcaaaaaaggtgcttagttggagaagtttagtggctggtgtcatcagaccaggccatcctggcactgctgcccccactccagggatggcgctgccagagatgccacatgcgggggctgggcctccggggcccaccacggcacaggagaatttctgctgacgagatactatacccatgatttccttttcttattctaacgtggttttcttgaagctgctaacagggcagttacttcagtgtaggcctttcagttgtaatcttaatctggtgcttccttctaagtgtctttcgttgggtatgggggaattactgacagtcttttgggttatttctgtgcgtgatagctcttactctttatatttcaactttgcctcattttgtgctccggggtcaccttaacttcagttctggagtttgttaccccacacactctacaaacatggcagtggggcagccagcagaagtggacataggtcctaaattcagagggtacagaatgaaccgggcggtctcaggagcagagctagtctgttccccagtgacatgagaggtgcagtcattttctctgataaataattgaaccatgctttctaaggggttcccattacaatgagcaggagtgcagagcctgggaggtttgattacagcgagaggaagggtgcaggaggcagatacagtgcatggccaaagcaccctgctctgtgccccgggaggtagaggctggggtaggggtgggaggcgcccgagaaagctctgatgccagagtgatgagttgcggcacctctgctgatcagagctggtccctgtcagtgccctgctgaaaagaatcccaagaagcccatagcggcgtcgctttaattaaattccctgtttggttttttgggatgtttgtctgagtgaaatttgagggttggtgcgttaaggtatttctgactcactggggcttggaggtgaccgtggaataagccacagggagtaaagtacactctgccattcgtcctccttgtggggggtggggggcagatatttcttcatcttcattaatctttttctctcttctttccatgtccttgcctcggagcagttattacagtaagtattgtcaagggggttggaactgtagatgatgtataagaacaggagagagaaaaatgtaactgcactggtggtcttgggtgttctttcccttggctgatgtttggagttgctgaggctcagtcctgtcagtggactaacaaggaacctgttaactggcatgatgacctcctgctttaagctgcattggcctgcggctccattaagtgcatcctggctgtgggtctgacatggacacagtggctcgaggccctgcctccccaggtcacaccttttcaaggttgtagagagagctccattcaactgacctgaccgacatcccttccccatctgtgcatctgttgagtccactgagcactgatccttggcaaagtcgtgaagtcagcggggtttctcttccacagccgtcccctctgtcattgcccacccgcccaccattcagcacactcatctgagtgccttgtccctgccggtaaacactggctgtctctgggaaactggttcctgctgaggcgttaatgggtgaatgtgttcctcctttgagaagttccaatttttaagaagcaggaagggagggagggaggcaataattagcttgaagggttcagttactgagaagaaaacttaaggccttagccacaggctagttggagggaaaggggccatggtgagtatcttcgatgggttaggaagtcttctgtgctctttccacactgcttactacccagagtggctaaatgtatggattctgaagtcagacgaaactgttttgagacccaactctgtcgtgatctctgtgacttttttttttttttcgaaacggagtcttgctgttgtttcctagactggagtgcagtggtgcaatctcggctccctgcaacttctgcctcctgggttcaggcgattctcctgcctcagcctcccgagtagctgggattacaggcacccgccaccatgcctggataatttttgtatttttagtagagacgggtttcaccactgttggccagactggtctcgatcttgtgacctcaagtgatccgcccgcctcggcctcccaaagtgctgagatgacaggcgtgagccaccatgcctggcccgatctctgtgactttggttaagtcacctaacctctttgaacctcatctgtaaaatgagggtgattctacagagctctcaggctggggtgaggattgaatgggataatacatgcctagtgtgtcgtgggctcccagtcaagttaactgttattacaaggcagaggctggaatctcctagctgcccatgatccagtaatgcccatctccagtaatgggagatggttactctcaactgtgaacctagtgactttcatgtattttttttccttcttccagaatgagtacatgaaagaagactttctgattaaaattgaaacctggcacaaaccagatcttggcacgcaggagaatgtgagtagtagttcccaaaagccccaggggtgaggtcttgagtctctgccttgtagcctctccagggctaccatggggtcctctctgtggtcctcttttgcctggccgggaaggcagtggcctctgcctagacctatcttaccagcatgggattgctgtgtctctgatttgcaaaatgtgatctccggaactttttatggggccttctcgtactgcttggattggtgcagttcctggtacatgggagctatatctttaaaagaccaaaattacagttttctatagagcacaatttgcagtaactcccaaaaaataaaatacacctatcctttagcatttccatgcccaagaatttagacagttattttcacatgtgtgaaataacatatatacaaggagactcattgcagtcttctttgtgtagccaaagatcaaaaacaatgtaagaccatcctgggcaacataacaagactctgtctctaccaaaaataaaaaaagaattagctgggcatggtggtatgtgcctgtggtcccagccactctggaggccgaggctggaggatcatttgaggctgggaagtcaaggctgcagtgagctgtgactgcaccaccacactccagcctgggcaacagagtgacaccctgtctccaaaaacaaaaaaacaacataagagcccgttagaccgggtgcggtggctcacgcctgtaatcccagcactttgggaggccgaggcaggcggatcacgaggtcaggagatcgagaccatcctggctaacacggtgaaaccctgtccctactaaaaatacaaaacagccaggcttcatggcgggcacctgtagtcccagctactcaggaggctgaggcaggagaatggcgtgaacccgggagtcgaagcttgcagtgagccgagatcacgccactgtactccaacttgggtgacagagcgagacactgtcttaaaaaaaaaaaaagagaaaaaaaaggcccgttagtaggacaacgttaaatgcattgtggttcagccaaatagtgacatccttgcagccatggaaaaaccaatagagagcagtcttcaagttgactgttcagtgaaggatggaagttatgaaacaaggtgtgtgcatgccgcccttcatattaaaagaaaaatccacgcacatggatgtttgtatgtaggatctcttagaggtggctgttactagactggggacgagggacaagcaagaagaggagttactctagttactctatattgtatccttttgtaattttgaatttgtgtcataattttgtattatgtgcatgtacagcctgatcaaaataatcagcatgttgctaaacagacgccatctctagaagggtttacagtctttacagcgggtcagcatgttgctaaacagacaccatctctagaagggtttacagtctgtacagccgggaacacatggaaatggtgtgggcaccgtaaacatccggaaggcgttttgacctgcagaagtgacgtttagcctcaatagtcagagcattcgttctcagtcatgtcacttaaaatccagcgggggctgggcgggaggccaaggcgggtggaacacttgaagtcagtagtttgagatcagcctggccaacatggtgaaaccctgtttctactaaaaatacaaaaattagctgggcgtggtagcccacgcctgtaatcccagatactcaggaagctgaggtaggataatcgcttgaacccgggaggcagagtttgcagtgagccgagatcgcgccattgcactccagcctgggcgtcgcagcaagactccatctcagacaaacaaacaatccagctgggttcagtgttgtgcacctatagtcccagctcctcaggaggctgagacaggaggatcactcaggcccagctcctcaggaggctgagacaggaggatcactcgggcccagctcctcaggaggctgtgacaggaggattgctcgggcccagctcctcaggaggctgagacgggaggatcactcgggcccagctcttcaggaggctgtaacaggaggatcactcaggcccaggcaggagactgagagaggaggatcactcaggcccagctcctcaggaggctgtgacaggaggatcactagggcccagctcctcaggaggctgtgacaggaggatcactcgggcccagctcctcaggaggctgtgacaggaggatcactcgggcccagctcctcaggagactgagacaggaggatcactcgggcctaggcaggaggctgagacagtaggatccctcggtcccaggcaggaggctgaggcaggaggatcactaggagcctgaggcaggaggatcactccggcccaggagttcatgctagagtgtgctgtgatcactcctgtggatagccattgcctgagaaacacggtgagaccccatctcttaaaaaaaaaaatccattctcccatttctttggataattttgtatgtaattgtataattacttatcattaggaatcttacatctgtggctatgggaatggcagttcctaggtgtccattctggctaaaggatattttataactgacaaaaactgcatagtggttccccacttgttcccacaggtgcataagctggagcctgaggcgtggaaacacgtggaagccgtatatatagacattgcagatcgaagccaagtgctcagcaaggtaggatccgtttaaagacgtgggtggccttcgagacgcagaaatgacttctcaatgctaaagaaaccaggaaaccatacccaacttggcacaaaaggaaattctgatgtgtcttgcttgttttatttttaaaagtgagtattaggagatttcttgtcttgagttggggatgccaccagaaaattagtggcccaaatttgtgtgccctgtttggcctctgaaaattattactggactaagtaggtattgtagctagagtattttgccctgctaaaatgatgcttagcctgaaaaatcggagcaccacttctcaaatttatttttccaactcagtaattaaaaaaacatttacttcctgcctactgggttgtggaatattgtcaggatctctgggttccaggtgagggatgcagaatgcagggaaagacaggtcccctgccctccagaagtcggtggcgccttttcagagtaacacacactggagcagacccctggaaaaggacagtccactggtggaccatgaccttggtcaaaagagggaccaggtctggcttgctcactgttttgcacccaagaagtatttgctcagggaatgagggggttagattcctcctcattcattaccattcttactaggcagaggcctcattgggattaaaagacaggaatgtaactctctgcccactgatagggaatgtgtgtttgctctttgtatcccaggggtgtgatacctctttcctgtggtcactctgcacttaagatattttggggcctggcacggtggctcacgcctgtagttccaacactttgggaggccaaggtgaccgatcatctgaggtcctgagttcgagaccatcctgcccaacatggtgaaaccccatctctactaaaaatacaaaaattagccaggcctggtggtacgtgcctgtaatcccagctacttgggaggctgaggcaagagaatcgcttgaacccgggaggcagaggttgcagtgagcagagatcacaccatcgcactccagcctgggcgacacagcgagactccatctcacacacacacacacacaaagttattttgatttgtgcatttccgaaaagatataaaaaccatcttgtgcttccttgcctaatatcccaacccccaccttcaaaacgttggtggatttttcaaaaagctttttatggaagtttaacatatacagcaaagtgaatataagtatgcagcttgatgaattttctcaaactggatactagcaaaaagtatgattctttgagtattttgtcaactctggttgatctgtgtgagtggagggaagcagtgatggtgaatatttattttttaaagcacacataaatataatctcctcagaggctgggcacattggctcacgcctgtaatcccagcactttgggagaccgaggcaggcatatcacttgaggtcaggagtttgagaccagcttggccaacatggtgaaaccccgtctctactaaaaatacaaaattagggccaggtgcggtggctcacacctgtaatcccggcactttgggacgccaaggtgggcagatcacgaggtcaagagatcgagaccatcctggccaacatggtgaaaccctgtctctactaaaaatacaacagattagccaggcgtggtggcaggtgcctgtaatcccagctacttaggagactgaggcaggagaatcgcttgaacccaggaggcggaggttgcagtgagccgagatcatgcctttgcaccagcctgggcaaaaagagtgaaactgtgtcaaaaaaaaaaaatacaaaattagctgggcgtggtggcgcatgcctataattccagctacttgggaggctgaggcaggaggatcactggaactcaggaggcggaggttccattgagctgagattgtgccactgcacttcatcctgggcgacagagcgaaactctatctgaaaaaaaaaaaaaaaaaaaaaatcggccggacatagtgactcatgcctgtaatcccagcactttgggaggctgaggcatgtggatcacctgaggtcaggagcttgagaccagcctggccaacatggtgaaaccccgtctctacaaaaatacaaaaattaccctggcgtggtcgcaggcgcctgtaatgccagctactcaggaggctgaggcaggagaatcgcttgaacccaggaggtggaagttgcagtgagctgagatcgtgccactgcactccagcctggccaacagagtgagatgctgtctcaaaaaaataaaataaaaaaataaggcagggcgcggtggctcacgcctgtaatcccagcactgtgggaggccaaggtgggcggatcacgaggtcaggagatcgagaccatcctggctaacacggtgaaaccctgtctctactaaaaatacaaaaaaaattagccgggcatggtggcgggcacctgtcgtcccagttgctggggaggctgaggcaggagaatggcgtgaacttgggagatggagcttgcagtgagccgagatcgcgctactgcactccagcctggccaacagagcgagactccctctcaaaaaaaaaagaaaaaaaaaaaaaacttctcagctttgggaaatactttatgagagagagaaatttattatctttgttatttttgttaagtagatgctataagtttgtatctcctgagcccacattagtcaatgtagagggacagctgaaaattaaacttttgttgtggttaattaacacaggaaattgactgcattataaatctgtgaagtgagactcaccagtagtggataggttccatacactgaacatttccagtaatgattttgttaaaacaagccagagggagattgcactggaagatttaaggaatgacagccgggtattctgagcgctggctgtattttagagtcacttgcagagatttaaaaaaacaaaaaacaaatctgtgctgccgtcacctgcagatattctcagtcactgggttttagttggagtgactcaaaaatctgtgttttaaaaaggtcttccctggtgatctggatgctcaccccaggttgaaagtctctgtcttcaacacggtaaatatgtgcctgctcagacagtctggtgatactttcacactggcaaaatggaaaacaaaccctatcggagaaaatcacatagaactctcctctgaggctaatgtaaacagttctacatcttgtttataacattttcccatatttgctttgtgccatcagcatcaagatctggtatggagtgaatgctaatgaaagatctgttctccccatctctcactccctctcccactcccctccaaccccaattccacaatttctctcaggattacaaggcagaggaagacccagcaaaatttaaatctatcaaaacaggccgaggacccttgggccccaattggaaggtaccattcacaccttcactgccagggggctgggcagcatgtgggtgggccgctccctgtggaggaggggcatggctggggtgagctggggacggcctgaggtctgcccgttgttacttgcgtacccatgggtatgtttctaatgcagcaagagcttgtaaaccagaaggactgcccatatatgtgtgcatacaaactggtgaccgtcaagttcaagtggtggggcctgcagaacaaagtggagaacttcatccataaggtaagtagctcggctgaggccttcccagtgactgcgtgtgtgtgttgtgggggggtggtggagaacttcatccataaggtgagtagctcggctgaggccttcccagtgactgcgtgtgtgtgcggtggggggtggtggagaacttcatccataaggtaagtagctcggctgaggccttcccagtgactgcgtgtgtgtgcggtggggggtgtttggcccagtgaagaagatggcccagcccatgtggcctgcatgacagggttgccaacatgagcatacctcacagtttggcggcttcccagctgcccaccttcccttgcactgaaatgtcttacggtttaatgctgtccttccagggacaccacatgtgacagggaaggaaactgaggcaaaagaaggccacaggaagggacttgctatgactgacctacagataaaactcagtctttcttttcttgcagctgaaaggcaagaggtgctgggagccaggttggccggtgccctgaattactctgctgggcaggtctaaggagttttagagccttttaatcctccgacatgtttgagcctcacttgggccatatttcatagctgctggccagttttaatctggcattagacaccagagacaggaagaaatgtggcagtggtttggggcccttggcttgcctaggagttcatgggctgctgtcttgctggtgctttgggcagagggcctagtgtgaggtaggcatccttctttcttgggggctccctcctatgtgaagccatacctgttagacacgtgaaggcaaaggtcattgacccatggctggtccagataaccagccgggcattactcctcctcctgtccgcccgtccccagtctagtgtgggtattcgtgtggagtgcatggagagaagggctgtggcagcagcctttgccttctgcgttctaacgtggttccctcctttctatagcaagagaggcgtctgtttacaaacttccacaggcagctgttctgttggctcgataagtgggttgacctgaccatggacgacattcgaaggatggaagaagagacgaagagacagctggatgaagtaagtgggggctctgggggctctcaattagataaacaaacgaagattaaggagactgttttgctggggcgcttcaccgagagcaccatcctgtagttctgggaacacgtcagtgtctgctacagggacggtatcctgggcagtacgtgggcactatacggaagaaaacagcctgtgctcttgaattgacagttgagttgaagtcttggcatacccacagagacaaaaatggcagtatgtgccgaatgccaagtgggtaatacagctgctacagcgatgcttcagagcctggtgggaaagagcgtgcggggctgcagagctggaggtgaccctgggaggaggcaggctgggctgacctgtgaataccatgcacattacccacagaggacagccacagcgcacgcaggagctgacagctggcggctgtctacggtcattttgagctatcagagttgagagcttttgcttttctttttttggtcttggcgtggatcgcagaaggagggttccctgttccttaggagcctaaagacccagcacttctcatgcctcatttggagatgctgatgcttccttgagaggcccactcagaggagattgtcagttagtaacattcaagcactcactgtgtgccgtctaccattctgagggcctttacctactgcagtcttcacgataccccatgaggaggcgctgctgctctccctaccctcagatgaggaagtggaggctctgagagctcaatgctgcggtgctctgggtcacaccgtcttgcaggtgatatggtcagagtaagagcccaggactctctggccctggaaccacagctcttaatcactcccctgtactcctccctctaaatgcaattttgggccctcctgccatcttggagctaaaaatatgataaggcaggaagctctgtttcataagaactgccatcacttctccctccttgccccaggtggggttggcatggagtttgggtatccagtagaggcattgctttgcaacagcccactcagctctcctgcagggcctcaggtgagagccaggcttgggcgcccatgctgcccatgctgcacggacggtgtctgcttcaccatgctggtctagggcgaaaattgggtccagaagttcttcctctggaaccccgcagggaactgtttttaccatccagaatgacacttttcctgggctgactcactggtaagtggtgcactgagttggttcctcttgaagacagatgttttggttattcatttagctacatttagcagggaagtggcaggatttcattggggcacagtccctgattctttcgctaaggatctttaggaaggggtagacctcagtgtccaggggtctggtgattgtgactgtgtaagagaagcctgaggcttttggtcaccctagtcctgacaaaaagaaagggaaaatgttaacaaatgaggaaacatggagactttcattggagttttagcctggagcttcagccatccactgcctgacaaaggccagcatgacgtatgttggggttcgtggaagtatttgctgtccacctttcattccttcgggtagaactcaaattcttggagctagaagaactctccagaggatctactggatctgctttgttcagatccaaactttgagagccctcagtgttagagagttattttttaatctctcagacccttttgaaaatctttctcggccaggcacggtggctcacacctgtaatcccagcactttgggaggctaaggtgggcagatcacgaggtcaggagtctgagaccaacttggccaacatggtgaaaccctgtctctactaaaaataaaaaaaattagccaggcgtggtggcggacacctgtaatcccagctgctcaggaggctgaggcaggagaatcgcttgaacccaggaggcagaggttgcagtgagcagagatcatgccattgcactccagcctgggcgacagagcaagactccgtctcaaggaaaaaaagaaaaagaaaagaaaatctttctccattccatggagaatcatgccaaaagcttaggtgatcactgtcctccaggataactgcaaatagaagaaactctctttggaattagaattttaaaactcatctgcagtgggagagaaagcaagtccacctcattgtggtacatgttgtggtctcttcagcaactgtgcaggacctttgtgtgctgactacgcttgatgtggcttgcctttttatttttttgtctatctaaaaatatatgtttcatcaaagttatattttgtagttttaaaactcagcatcccaggattatgagtcccacccctcagaagcagccccttgtaattccgatggttgttgcttttgttaattacttccatactttcaaataatctatgctgatgctcttagtagttcttttttttttttaagaggtgaggttgtgttctgtcacccaagctggagtgcttggcgtcgtgcagtggcatgatcatagctcactgcagcctcaaactcccaggctcaaaatccttttaatttttcttatttatttattttttttctgagacaggctctcactctgttgcccaagctggagtgcagtggcacgatctcggctcactgcaagctccacctccctggttcacgccattctcctgcctcagcctccccagtagctgggactacaggcgcccgcttgtactcggtagttacagtggggggaacctctacctcagggtactcggtagttacattcgggggcgggaacctctacctcaggacttcgagtctttttttcacggaggcttgtcactttccctatagaggactcccctgtctcttgctgtgggagacaggcaggcagccagcattctggaggccacactgaggaagggtcccagtgggctcattgtgccattgattcgctttaactttaattccgtcgtattctgcctcttgcccaccttccccctagcagcacctggggtcctgaggtcagggttccctcagcgcttcagagagtgaacctcctggcttttgctgtgaaggaaaggagggtggttgcttgacttccagagcaggagaagggaacaccagttcctaaccgttctccatttggactttcaaaaagtcaccagttttgagccacacctggtactcccatctgcagcgggacctggtgcttccagttcctgagcctttgcagaacctgcagctccttctccgctctccatcctccaggcacttaggttcagcttttgctgctctgcaaattagctactgactcttctgtcctttttccatctcccaaaaggttgttaactggctcttacctgctgtggtgtcctctgttcctgttgtcttcatagtttttatctttttaaattcctttactgtcatgtcatagggtttgggggaggaatagagatagatgcctgtcttccatgcaccgtgatgaactgcacacttggaataggaattatgactgttagtctctaagccagtacatagtcgtctagtgcaggcagattttgtttgtgagtgatgaagggtcactgcaaggccacagtcatcactgctgtaactctagtccctgtccgggcggacccaccattcttgaatgaggcttgaagatttgggaagcaaggcatcgagagattagttcttcgccctaaaaagaaaaaatttctggaactatgtgcctgtaggaaagcagtttctgtctctctctttctccccaacttgccttttttctccctttcccaagctcttactctcttaagaggcccataatctgaaaaatggaaggaggtatcttaaaggtcatttggtccaattatatgttcagtgcttgagtactctctgaagcttccctaccagcctttgcttgattactgcctgtaatggggaactcactgtctcccaaatatggtagtaataaaaatatttgtattattaatagaagctaacatttattgaggacttcctgtgtgcctatcacgtatgctaagagtttcacatgtattacatcacccagttttcatggcaacctgtaacacaggtattagtttcattttatagataaactgtggctcacagaagttgaggacgttttataattcactgaacaagtacctcttggcctttggccattaactctttagataatgagattcagaaaagagaattcacttaaaaaatgttaagaaaacttgttttctttttttttttttcttttgaaacagagtctcgctctgtcacccaggctggagtacagtggtacaatcttggctcattgcaacctccaactccccaattcaagcaattctcatgtcacagcctcctgagtagctgggactacaggtgcccgccaccacgcctggctaatttttgtatttttagtagagacagggtttccccatgttgcccgggctggtctggaactcctgagctcaggtgacccacccgcctcagcctcccaaggtgctaggattacagttgtgagccactgtgcccagccaagaatctaaaattttattttattttttttgagacagaaccttgctgtgtcacccaggctggagtggagtggcgccaggctggagtgcactggcacaatgtcagctcacagcaacctccacctcccaggttctagcaattctcctgcctcagcctcccaagtagctgggactagaggcgcccgccactacacgccactaattttctatttttaatagagagggggtttcaccatgttggccagactagtctcgaactcctgagctcaggcaatgcacctgcctcggcctcccaaagtgctgggattacaggcatgagccaccatgcccagcctctaaaactttcataggagctgcagaggctgcaggatccctatatgtgaaggatgacactgccctcatggagtctctctctctctctctctcttttttttttttttttttgagatggagtcttgctctgtcgcccaggctggactgccgtggcgcaatctcggctcactgcaacctctgcctcccgggttcacaccattctcctgcctcagcctcccaagtagctgggattacaggtgtgcgccaccacgcccagctaatttttgtatttttagtagagatggggtttcaccatgttggccaggatggtcttgaactcctgacctcaggtgatccgcctgcctcggcctcccaaagtgttgggattacaggtgtgagccaccatgcccagccactcagggagtcttaattccctccaacctgctggcagtgattgcagaccatctggaacatcagccaacatccccaattatggaagtagctttgttttcttttcttttttttttttttaagagagacagtctcgctctgtggcctaggctagagtgcagtgctgtgatcatagctcactgcagccttcaacttctgggctcaagtgatcctcccacgttaagctcctaagtagctaggacttcaggtcccaccactacacctgactaatttttttagagacaagatctcaatatgttgctcaggctggtcttgaattactggtctcaagtgatcctcccaccttggtttcccaaagtgctgggattaccatcatgagccactatacctggccctgttttctttttaaatacagtttaaggcacggtggctcaaaagcctgtaatcctagcactttgggaggctaaagttgggctgatcacctgaggtcagaagttccagaccagcctggccaacatggagaaaccccgtctctactaaaaatacaaaaatcagccaggtgtggtggtgtgtgcctgtaatcccagctacttgggaggctgagacaggagaatcgcttgaatccaggaggcagaaatggtagtgagccgagatcatgctgctgcactgtccagccttggcgacagaacaagacagggtctcacactgttgcctaggctggagtatggcagcctgaaacgcttggattcaactgatccacccacctcagcctcccaagtagctgggactacaggtgcaggccaccacgcctacctaatttttaaaatttttttaatttttgtagagacaggatcttgctatgttgtccaggctggtctcaaactcccagccacaagtgatccttccacctcagcctcccgaagtgttgggattgtaggcgtgggccaacacacccagccagcttcatttctgcaccgaaccttttattttgaaatgattgaaagattcacttgcagttataaaaaataacgtggaaagatctatgtaccctttacccagtttttgccaatggtaacatcttgcaaaactatagtacaatgtaataactcggatattaacattgacactttactatttttttagatcaaaggtgtatttcatacttaatggtcaaaatgattttcaaaagatagaaaaaaaatttaaaaatagaagtccaaataactaataggtgaatacataaataaaagtcttcttgtttcagcccctggcctcattccctaaaggaaaccactgttaaaaacaaaaacaaaccagggctgggcacggtggctcacacctgtaatcccagcactttgggaggccgaggcgggtggatcacctgagcttgggagtttgagacagcctgagtaacatggagaaaccccatctactaaaaatacaagaaattagccaggcgtggtggtgcacgcctgcaatcccagctactcgggaggctgaggcaggagaatcacttgaacccaggaggcagagattgcggtgagctgagatcgcaccattgtactccagcctgggcaacagagcgaaactctatctcaaaacaaaccaaccaaccaggattgaagtttctattttcctattttcacatacacattttcttcagccatattatatgtgtatgtatagcctacattggctaaatctgaggaacaccacaaacatcagataaatctctcatgtcgtgtaggccccaggaaacaggaaataagcattcttagatcattgtaagactgaagtaatgggctgggtgcgatggctcacacctgtaatcccagcactttgggaggctgaggcaggtggatcatctgaggtcaggagttcgagaccagcctggccaagatggtgaaaccccatctactaaaaatacaaaaattagctggatgtggtgcacctctaatcccagctacttaggaggctgagacaggagaatcacttgaacccgggaggcagaggttgcagtgagccaacatcatgccactgtgttctagcctgggtgacagagcaagactccgtctcaaaaaacaaacaaaaaaagattgaagtaatgaattttatttcagtggtatggggaaccttgtttctgacagtaggggaagctatcatgttcctggtaggaggttgcatcttatttcaagcggtgggaaaacaggacctggctttgcattagtaactgaagccaggtggtgaactctcagcatgtgtaaggagccggctgagaaggagctttgctcccatgatattaaattatctgattattgaaaacttttgtaaatggtcattagtgagcaaattgtctttttaaaaattctattatgaaagagttttaaacttaacagaaaataggcaagaacagtgccaagaactcctgtacactcctttgcccagagactattcctttagagcaaaggctacagcccagaatcacgcgcttcaccccattcatcacagctctcctttctgtccatctggtgccactcctcagttttcctgaacttccgcgattttggcgtttgtggaggttataggctgatcattttgtagaatgtctttcaatgtggattcgttgatgtttctgcatgattagaccccacctgtgtgtacttgaagcctgaatgtcacagactctgttctttttatcctattctgtgtctttctgtccagttactggtgaggttactgctgtcgccttgaagcacaaggtgttctgggtttgtcttgttttttcatgaccctgtaactggccacatcttcaaggagcgctgcttccatatagtggaggggggtgtttggaaatgagatctggttgctggtgtgcctatttccactagggtattgcagctcccagaccttctcataggatagagctaggggacttgtacatttatagttatttctgtatctgcgtcatatatcatgttcacacaaatgcatctaattccaatctaacatcacagagttgtcttttaaaaatatgacaagctggccatgcgtgatggctcacgcctgtcatcccagcactttgggaggccaaggcaggcggatcacctgaggttgggagtttaagaccagcctggccaacatggagaaacctcgtctctactaaaaatagaaaattagccaggcatggtggcacatgcctgtaatcccagctactcgggagtttgaggcaggagaatcgcctgaacccgggaggtggagggtgcagtgagccaagatcgtgccactgcactctagcctgggcgacagagcgacagagtgagaccttgtctcaaaaaaaaaaaaaaaaaaaaaaaagtttcccagtggagaactactgccagagatagaatctccacaaaatgtggcagtattaaattttcagtgactagaatacaattctgaagtgggctatggcttaaaattccaggttcttcagagcttctatacacatctcctttgctataggacagtgtctggaacgaaagaataaaataaacaacatttgaaacagggtctcaaataattttttattggccgggtgtggtggctcatgtttgtaatcccagcactttgggaggctgaggcgggcggatcatgaggtcagaagtttgagaccagcctgaccaacatggtgaaaccccgtctgtactaaaaatacaaaaattagccaggcgtggtggtgtgcacttgtaatcccagctactcaggaggctgaggcagaagaatcgcttgaacccaggaggcagaggttgcagtgagtcgagatggtgcctctgcactccagcctgggtgacagagcgagactctgtctcaaaaacaataataattttgtattctataacataaacagcatttggaaccgcgtctccagtaattttcatctctacacaggccccgaatactcagtgcatactccacgtcaggcactctgctctgctaagtacacgaaaacctctttttttttcttttttgagatggagtctcgctctgtcgcccaggctggagtgcagcggtgccatctcagctcactgcaagctccacctcccgggttcaaacgattctcctgcctcagcctcccaagtagctgggattacaggtgcctgccacaatgcccagataatattttttgtatttttagtagagatggggtttcaccatgctggccaggctggtcttgaactcctgaccgcacatcttaaatcttcatcacaatcctatgtactgttatctctattttattattatagaaattggggcttaggccatacccagtggctcaaacctgtaatctaagcactttgggaagctgaggtgggtggattgctcgagtccaggagtgtgagaccagcctgggcagcatggcaaaactctctctctacaaaaaatacaaaaattagccttgcatggtgatcgcaccactgcactccagcctgagtgacacagtgagaccctgtctcaaaaaaaaaaaaaaaaaaggccaggtgcgatggctcacgcctgtaatcccagcactttgggaggccaaggcgggcggatcatgaggtcaggacatggagaccatcctggctaacatggtgaaaccccgtctctactaaaaacacaaaaaattagccgggcgtgttggtgggcacctatagtctcagctactcgggaggctgaggcaggagaatggcgtgaacccaggaggcagagcttgcagtgagccaagatcgtgccactgcacaccagcctgggtgactgagcgagactccgtctcaaaaaaaaaaaaaaaagaaaaaagaaaaaaactgaggcttagagagcattgcagtaacttactcaaggtcatacaattagtgatggagtcagaatacaatccaggccaggtgcagtggctcattcctgtaatcccagcactttgggaggccatggcgggaggactacttaagtccaggggttcgagactagcctgggcaatacaatgagaccctgtccccacacacaccgaaaaaataaaaaatcagccaggtggctgggtgcagtggctcacgcctgtaatcccagcactttgggaggctgaggcaggcagatcgtgaggttaggagattgagatcatcctgaccaacatggtgaaaccccgtccctattaaaatacaaaaaaaaattagccaggcatggtggcgtgtgcctatagtcccagctactggggaggctgaggcaggggaattgcttgaacccgggaggcagagattgcagtgagccgagatcacaccactgccatccagcctggcgacagagagagagactgtgtctcaaaaaaaaaaaaaaaaaaagccaggcgtggtggcacatgcctgtagtcccagcttcttgggatgctgaggcaggaggatcacttgagccagggagtcgaggctgtagtgagccatgattgcgccactgcactccatcctgggcaacagagccagaccctgtctcaaacaaaacaatacagtctagggagtttcattctagcagctatgctcttaggtgctcaaaatttgttgaacattataaagaacaaaagttgagcagaaaactaatggatagtgaagaaatacttattgacattcttcacatagaatggagttttcaaatcagaactgattttagagagatgacgtctacagtatccccagtgatgtctgcctggaaggtgccagtgacagggaccacttggtgcttccacagaagcccccatcctgttttccagcagccttgcacatctgtggatctgagacctgcacctgcactttccacctctgcatccttgtgcctagttctgacaccacattgtgcccacctttaaacaggtcaggaaagggaagttctgttactctgccgggaactcctctcccggagagccacaggattttctccctcatttctctcaggtttcatctcaaacctcacatacaagcttctgtaactacctaaaatagcacttacccacagtcattctgtatccgagcagcccacagtcctagctgacatagatgaatgtttgttctctgcccatcctgccccagaatataagctccttgaggagagaactggtctgtttagttcacagctaaatattcccagccctctggaagtccctagcactaaagagatgcctcactgaggctgggtgcggtggctcacgcctgtaatccaagcacttcaggaggccaaggcaggcagatcatctgaggtcaggagttcaagatcagcctggccaaaatggtgaaaccccgtctcccctaaaaatacaaaaattagctgggcgtgatggtgcatacctgcaatcccagctacttgggaggctgaagcaggacaatcgcttgaatccaggaggcagaggttgcagtaagccaactttgcgccactgcactccagcctgggcgacagagcaagactcctcacacacacaaaaaaagatgtttcggccaggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcggcagagcgagactccgtctcaaaaaaaaaaagatgtttcataagtatttgttgaatgaataaatgaatgaaacgggccaagtgtggtggctcacacctatgctgtaatcccagcactttgggaggttgaggcaaaggatcgtgtgaggccaggagcccaagaccagcctggtcaacataggaagaccccccccacacacacctctctaccaaaaaaaaaaaaaaaaaaaaaggtgcttcaaacaccgtgacacgagagaactagaaatcatggatggtgagaccagtgacacagatctggaaatgtatggcttcgagtccatatgcagaattcttccgtccttccagtgtcttgctttttacacaaaatatgccccaccccacctatgggcaggactgagaaggcaggagttccatcagcagcaggagccttccatttgtcctgctttttctgttccagatgagacaaaaggacccagtgaaaggaatgacagcagatgactaaagccgcctttcccctctgcactgtacgtaccaaatttctcactgtgcgtgtcacagacgctaaaatcagtttgggtttcaaggcctcagcagctcactatggagtcagaaaacctattcctccttccctctagtaatgatggttgccacgctcgatagctctccacttccactaggagattatggcccttgggacatttcagggacattttccaaagaaccacccagatagagacaatggacagggagggggtggtggatatagaaggggagttcatctgctgcgaatcactcctcctgtctgccagcttgatccatctcaagttgcagctgtcatgttgggcactccctggccttcccacgccagcgccagctcccaaaagctgccattacctgcccttcccccttggaaaacttgctggccagacagcttttgttagcacccactgttgtctggtgcttcatttccttctttatacccccgatcccatactaagctgccctcatcagaggtggcatctttcagatgctgggagggtgtttctgcccaggtcacagggccagattgggggccccttgtttcatgttgtcacttttccccaagccccctccttccgttaactctcggtgctggtttcccagtgccctgtacaccacccgagtcatgggattccagcagctcaaagcagtcttaatcactgaatgaaaaacctggctctgctcccaattagcctcagagagaaaattatttttacaaataaaagctggcctctaaccctacgggcaaggagggccagggtctcaccaggagtgacggcaggccctgcttactctccctgccccatgttcccaaagcagcctcggggaggctggagggtggaatgaggcggactgctgtgatgccagcttctcagtcactgctctgggcctcagtgctctcccccactcccttccccacccacccactggcttccctcctcctcttgaaattatccattcaggacgatttacagtgtttctgttttctcctcttgcttccttaatactttcatttttcttctagttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaatagctgccttttgtgatgtggtgatttaaatgatttaagttcatttgttctcaaccttggggtaaactgaggtattttgcttcctgggaagatcttcgcaattttgagtgctcctgtggggagcggggatgagctaaagatacaatgtttccctgccccgcaccgcttccacaaaatagcaatgtggttttgcagctctgacttctgctcccagtaacccatcgttagggcactctagcactatggaggtacccaaggctcagccagtctctatttaagaaaatttaacaaatacgagtaaccctgtcccaatcactgaatctctagttactactcttagaaacacctgtggcttcttggccctcctgttgcccgctctgaatctctctgcagtctacaaaatcgccccagtcaactctccacttggagggaattgtccagtgtggcccctagaattgagtcaccccctagataccaactgtctgaccccgaggagctctgtaagtccctgctcctcctcttccctttggggctggtgctgccactcagcaataatcctcttttctctgtgctttcttaggtccctgtcctctgtctttgaggctggttaggaagcaagagtcctgatctttcatgctgcacaatatgagcatgcaaaaagctttttccagcagaacatgttccctcgtctccagttgccggaaaggaatttggggatcaagaacttagctcgtcctacccccatgttgagttctgccctggaaaacccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgggagaatgagagagagctgtagtgtcacctgacattccccaaaccttgtgaagcacgttggcctaagtgtgccgtgatcccagcccacactagcctgggtgcatctgctaatgggagaccaaatctttgtccgggaagcaagaagtgggtgggagaatgtatcctgtttttgtcagtttgtttgccttactcatttctaagtgcaataagggagtgtctcacaggattgcacctgtgacatcctgatggatgcttccctgtggccctcctggggcaagggtggacagactcagacccccagcatggttagcgctgaccttcattgaggtccctttggaaccagatgtcttgttacagacaccttcctctgtgtaagtctcctcaccttgaggggtctttagtaatgcatctgggtagcatctcaactgctggtagcatttatctgacttggaaagttggagaagaggcattcctactggagaaaaatgtcagtgttttcctataagctctgtgttagctattcattatatttgtgcttaaagatgttccttcattcatcaactaggggaagtccagatgcgggttatcttgaaagaaacaaactgacattctaggcagacagttgtctatgtggtctgagggtcagcagctgttagtctccttcctttggctcttgagacccacacatatcactttagccctaacaagggctcctcccacctccacctgttgccccagttgaaaagcatccattatgagctgaggtcagcctggatctggaattgcagcccacataaacataaaggaggatgtccctggtctgttccatccccacggatggtgttgctgctgggcaacagtgttggcttcttttaagtaccccctttcctcctcacccacctccaaactgactagcactcagagggacttatgataaaggttcagctccaggggtagtacctgagtgtgtgccatgccccttcagaccagctgcttccatcagaattccagggtcacagccccaacagaagcagcagtgcctctgtaggaggggtgctgggctctggccttctcatgcagagaggtccggg

SEQ ID NO: 14787 - DNA, 18291 bp, Human
cccatgtgttggttcatcctgactttcctcgcagagcctgcccggtgcactgcatgtcccccactgtgttctcacagcactccgccacccagggccctgtgcccaccgcattatggcatgaacttacagtgttgtgcttggccttgtctagttacacgccccagtagaccggaaactccttgagggtgggagccacatctgtttggtttctctgtgtgtccccctgcctggacctagaaatactcgcctgaatggggatggcagtgagttcgtgaatcacagaggccgccccaagtgctccaggttagctctctgctctagtttgctcttctttcttaggcctgaggcactaaagctgatgaggttgccagagcttgccaaagactggacagattatctgttagaaaccaaggacggctgggcgcggtggctcacgcctgtaatccccgcactttaggaggctgaggcaggcagattgcccgaggtcaggagttcgagaccagcctggcctacatgacaaaaccccatctctaccaaaaatacaaaaattagctgggcgtggtggcgcatgcctgtagtcccagctacttaggaggctgaggaaggaggattgctggaacccaggagatggaggaagcaatgagctgaggtcgtgccactgcactccagcctggcgacagagcaaggctccatctcaaaaaacaaaaacaaacaaaaaaaaggaaaaggaatatatgtaccattttcattttaattttaaaaaatctttctaggccaggcacggtggctcacgccactgtaatctcagcactttgggaggctgaggcgggcagatcatgagctcaggagattgagaccatcctgtctaacatggcgaaaccctgtctttactaaaaatacaaaaaattagccgggcgtggtggcgggaacctgtagtcccttctactcgggaggctgaggcaggagaatctcttgaacctgggaggaggagcttgcagtgagccaagatcgagccactacactccagcttgggtgacacagcaagactgtctcaaaaaaaaaaaaaaaattctaaatgttttcctactccgtcaaaccacacacctaccaaaaaaaaaaaaaaaagcagggggcttatactgtacatgttgttctgtaacctgagataagaattgagtagaagagaccgggcgcggtggctcatgcctgtaatcccagcaccgtgggaggccaaggtgggtggatcacgaggtcaggagttcaagaccagcctggccaacatggtgaaaccctgtctctactaaaaatacaaaaattagctgggcgtggtggcgcatgcctgtaatcccagctactcaagaggctgaggcgggagaatcgcttgaactgggaccctggaggtggaggttgcagttacccgagatcgcagcactgcactccagcctgggcgacaaagggagactccgtctcaaacaaacaaacaaaaaaaaagaattgagtagaagaaaatactttgtcctgggaggcaaatggttctaggccctcctggcctctcagagctgatgaaagcagatcagataatcctggatcccaaacccaagttagtcggctagttaccctggccctaaaccgagactggttcatgcttggaggcatctcctttgtgtttttctcgcaccttgtagtataatgccctgggcccagcaagctctggaaaaatgtgtaatgctgatggaaggggtgatgagccacagcaggtagcctggggtctcttgtgtggtcctgtttctggtggctggtggggcacgtcgtgggtgtgtgttaggagccagccaaggtggggtgtcaggctctcatacgtaacttctcactcccaccagtaacctgctcattgcatggaaacttgcttgtcagctccccatgaagaagctggatctgaaaagcctcttgtctcctttctctctaccatttctctttatacccctttttttccccgctatagcaaagtacccacgtttgttcgaatgctggccccagagggagccctgaatatacacgagaaagcctggaatgcttacccctactgcagaaccggtgagtgcagccggggccacgtcggccaggcaggggcgggcagcagagctgtgggtcccacctgcgtgttccggattaggccagggaaaggctcgggctgggtcccttccggctgatggtgggtatcagtgctgtgtccagcacagcttggtggacagcagggcgagaagcaccggtcgtcacggcctgagagcacagagccagtctctcacttggggatgctgcgattttgattattgttattcattataacattttagtatatttttctagtcatttttatttatttatttattttttgggagatggagtctcgctctgttgcccagactggagcacagtggcgtgatctcggctcactgcaacctctggctcccgggttcaagcaattctgctgcctcagcctcccgagtagctgggactacaggcgcataccgccacgcctggctaattttttgtattgtagtagagacagagtttcaccatgttgcccaggctggtctcgacctcctgacctcaggttatccgcccaccttggcctcccaaagtgctgggattataggtgtgagccactgtgcccagcccagacacattttctcgaaaaattttagatcattactatttattttattattattttttttttgagatggagcctggctctgttgcctaggctggagagcaatggcacaatcttggctcactgcaaactccgcctcctgggttcaagcgattctcgtgccccagccatacaagtagctggaattacaggcatacaccaccatgcccggctaatttttgtatttttagtagagacggtgtttcaccatgttggccaggctggtctcgaactcctgacttcaagtgatccacctgcctcggcctcccagaatgctgggattactaatatgattactaattttttaattgctttttttgtctcactctgttgtccaggctggtgtccagtggcacaaccacagctcactgcagccttaacctcccaggctcaagtgatccttctgcctcagcctcccaaatacctgggactataggcatatgccatcatgtccggctaggtttttttttttttttttttggagagatggggtctcaccatgttgcccaggctggtttcaaattcctgggctcaagcgatcctcccaccttggcctcccaaagtgctggcattacaggcatgagccactgtgcctggcctaagtttctcatttttcttcagtgaatggataacattttccttgtcactaaggtgtctggtgttttgttttgttttgttttttaatttataatagctgcatagtattccatcatatgaatgaactgtggcttctgctgaaacagcatgttctgtaattgaggatacaggtataattattttcttaatcttggccagtctcctgcatagagtttcttgaaaggaaaggaaagatttgaacctccacagagaactttctattctagtccagacattcttaaatttctttcgagtgattcagattcttagccttccaagattcctaggtttccagggccatctaggaatagacctgttgggagggcctaagctggtactgattcataaccctggggagtcctgagaggtcccctggcacttgtctgtgaggtaggtgacctttcctcccaccagcctccatgtgtgggtacagacagtgttgggctgcggggtcctcccaccagcctctgctgacctgtcctcctgcacttgctttctttgttggcacctggtactccctagagtctgatgagtctgggatccttacgtgacgcatatcacccttatcctgtggactttgggaatgactgcaatccagaatacggggtcattgctctttccaaccctcagtggccccacacaggttcagggaccttgtatcaggagatttgcggtcattggtggggtctgggatgtgtaacccttagagttttcttgctgtagctgaagcacagccctccctactccttaagcactgggctggaagttagattcttggaaatgagggatgcacagatgttcttaaaagacagggtcgggcacggtggctcatgcctgtaatcctagcactttgagaggctgaggcaggcggattacttgaggtcaggagttcaagaccggcctggctaacttggtgaaaccccgtttctactaaaaatacaaaaagttatccgggcatggtggtgcatgcctgtaaccccagctacttgggaggctgaggcaggagaatcgcttgaacctgggaggcggaggttacagtgagccgagatcgtgccattccactccagcttggacaacaagagcaaaactccgtttattaaaaaaaaaaaaaaaaaaaaaaaaggcagtatgcagtgtggctgggtgtgtctggtctagggccaaaggtggattttcttgatgtctaagagagtcgcagtgagcatgtgttgcaagtgtggacatctccctgcctggggcagggttctgggtacacagcttgtgccaactgagagatgcccctgttctctgtgtcattctgggaagagtgttgcggctgacatgggcatttttctgcacgttaaatgttcatatattgatccttggccaaaagaaaagaaaaacataatttctgtatcagcaccatgcgctaaccaattgcgccactggagctccactggaaaaatgtaatttctaaatatttcatggagacagggagtaggggaaggaaggttggtttcctcagtgggtgctgacctcctattcaggatacaccttcacacagaatggatatgttgaatcttagatctgtttagttagacacttgctcttttaaaataagagataccagcaggcaaggaaggctactttccagttccctctgggggctgatgggagagaggttattagttcagacatcttagcttggcctcagtagatccaagtttgaaggaagatagatgaaggagcatgaagtaaaatgcctcatggcttttggaaggctcttcctttctctgagcggagtgaaaacagattgggacaccctggtaatgatcagctcttgctgttcttagcttgtttccctctctctttttcccttgaagctgatgggatgggctggaagtgaggagagggtaagataggagttggtctgtgaatgaatgaaagtgggaaaaggaaaagaaagtttgtttctccttccatctcttcctggaactatagtcctcggctggatacagtatcactaagccatgcttttatttatttattttaaatttttttattttttgagacagagtctcattctgtcacccaggctggagtacagtggtgcaatctcggctcactgcaacctccgcctgctaggtttaagcaattctcctgcctcagcctcccaacagacagtgttgggctgtggggtcctcctcctgtcagcctccatgtgtgggtacagtgcctgggattacaggcatgcgccaccacacccggctaatttttatatttttagtagaaacgaggtttcaccatgttggccaagctggtctcgaactcctgacctcaggtgatccgcccgccttggcctcccaaagtgctgggattccaggcgggagccaccgtgcccggccctgccatgcatttaaaatgccttattagtctcatttggaaatctctgctctcccactgcaaaagatttcctgcggcttttctgtgtactttgggttacagtttgaacaacagggaatactggaatgcagaggtgtttgagggcctgggagggctggagaaggtttggggaggattgtttgatcacccaagtttacatgaaaaggtcagcaagggctgtcaccctcatgatttcggaaaaccaggttgtcagaactgagtggatctgtctctcggggtctcacaaagatgaatgtgtaaaaaccccagcgccagtctatgaagttacactaaaacgcagaattgctaccgaaacgggacattcccattcgatgatcagggcattcttttcttgtggattcttctacatgagaaaccaaattataatcagaatgccaatgtgtggcaaagaatgtccgcttggctgagtgatcagattcttgggtccattgatgagcacgtctcggagaggccgaactaggagagactttcttagaggagatagattcaaaaaaggtgcttagttggagaagtttagtggctggtgtcatcagaccaggccatcctggcactgctgcccccactccagggatggcgctgccagagatgccacatgcgggggctgggcctccggggcccaccacggcacaggagaatttctgctgacgagatactatacccatgatttccttttcttattctaacgtggttttcttgaagctgctaacagggcagttacttcagtgtaggcctttcagttgtaatcttaatctggtgcttccttctaagtgtctttcgttgggtatgggggaattactgacagtcttttgggttatttctgtgcgtgatagctcttactctttatatttcaactttgcctcattttgtgctccggggtcaccttaacttcagttctggagtttgttaccccacacactctacaaacatggcagtggggcagccagcagaagtggacataggtcctaaattcagagggtacagaatgaaccgggcggtctcaggagcagagctagtctgttccccagtgacatgagaggtgcagtcattttctctgataaataattgaaccatgctttctaaggggttcccattacaatgagcaggagtgcagagcctgggaggtttgattacagcgagaggaagggtgcaggaggcagatacagtgcatggccaaagcaccctgctctgtgccccgggaggtagaggctggggtaggggtgggaggcgcccgagaaagctctgatgccagagtgatgagttgcggcacctctgctgatcagagctggtccctgtcagtgccctgctgaaaagaatcccaagaagcccatagcggcgtcgctttaattaaattccctgtttggttttttgggatgtttgtctgagtgaaatttgagggttggtgcgttaaggtatttctgactcactggggcttggaggtgaccgtggaataagccacagggagtaaagtacactctgccattcgtcctccttgtggggggtggggggcagatatttcttcatcttcattaatctttttctctcttctttccatgtccttgcctcggagcagttattacagtaagtattgtcaagggggttggaactgtagatgatgtataagaacaggagagagaaaaatgtaactgcactggtggtcttgggtgttctttcccttggctgatgtttggagttgctgaggctcagtcctgtcagtggactaacaaggaacctgttaactggcatgatgacctcctgctttaagctgcattggcctgcggctccattaagtgcatcctggctgtgggtctgacatggacacagtggctcgaggccctgcctccccaggtcacaccttttcaaggttgtagagagagctccattcaactgacctgaccgacatcccttccccatctgtgcatctgttgagtccactgagcactgatccttggcaaagtcgtgaagtcagcggggtttctcttccacagccgtcccctctgtcattgcccacccgcccaccattcagcacactcatctgagtgccttgtccctgccggtaaacactggctgtctctgggaaactggttcctgctgaggcgttaatgggtgaatgtgttcctcctttgagaagttccaatttttaagaagcaggaagggagggagggaggcaataattagcttgaagggttcagttactgagaagaaaacttaaggccttagccacaggctagttggagggaaaggggccatggtgagtatcttcgatgggttaggaagtcttctgtgctctttccacactgcttactacccagagtggctaaatgtatggattctgaagtcagacgaaactgttttgagacccaactctgtcgtgatctctgtgacttttttttttttttcgaaacggagtcttgctgttgtttcctagactggagtgcagtggtgcaatctcggctccctgcaacttctgcctcctgggttcaggcgattctcctgcctcagcctcccgagtagctgggattacaggcacccgccaccatgcctggataatttttgtatttttagtagagacgggtttcaccactgttggccagactggtctcgatcttgtgacctcaagtgatccgcccgcctcggcctcccaaagtgctgagatgacaggcgtgagccaccatgcctggcccgatctctgtgactttggttaagtcacctaacctctttgaacctcatctgtaaaatgagggtgattctacagagctctcaggctggggtgaggattgaatgggataatacatgcctagtgtgtcgtgggctcccagtcaagttaactgttattacaaggcagaggctggaatctcctagctgcccatgatccagtaatgcccatctccagtaatgggagatggttactctcaactgtgaacctagtgactttcatgtattttttttccttcttccagaatgagtacatgaaagaagactttctgattaaaattgaaacctggcacaaaccagatcttggcacgcaggagaatgtgagtagtagttcccaaaagccccaggggtgaggtcttgagtctctgccttgtagcctctccagggctaccatggggtcctctctgtggtcctcttttgcctggccgggaaggcagtggcctctgcctagacctatcttaccagcatgggattgctgtgtctctgatttgcaaaatgtgatctccggaactttttatggggccttctcgtactgcttggattggtgcagttcctggtacatgggagctatatctttaaaagaccaaaattacagttttctatagagcacaatttgcagtaactcccaaaaaataaaatacacctatcctttagcatttccatgcccaagaatttagacagttattttcacatgtgtgaaataacatatatacaaggagactcattgcagtcttctttgtgtagccaaagatcaaaaacaatgtaagaccatcctgggcaacataacaagactctgtctctaccaaaaataaaaaaagaattagctgggcatggtggtatgtgcctgtggtcccagccactctggaggccgaggctggaggatcatttgaggctgggaagtcaaggctgcagtgagctgtgactgcaccaccacactccagcctgggcaacagagtgacaccctgtctccaaaaacaaaaaaacaacataagagcccgttagaccgggtgcggtggctcacgcctgtaatcccagcactttgggaggccgaggcaggcggatcacgaggtcaggagatcgagaccatcctggctaacacggtgaaaccctgtccctactaaaaatacaaaacagccaggcttcatggcgggcacctgtagtcccagctactcaggaggctgaggcaggagaatggcgtgaacccgggagtcgaagcttgcagtgagccgagatcacgccactgtactccaacttgggtgacagagcgagacactgtcttaaaaaaaaaaaaagagaaaaaaaaggcccgttagtaggacaacgttaaatgcattgtggttcagccaaatagtgacatccttgcagccatggaaaaaccaatagagagcagtcttcaagttgactgttcagtgaaggatggaagttatgaaacaaggtgtgtgcatgccgcccttcatattaaaagaaaaatccacgcacatggatgtttgtatgtaggatctcttagaggtggctgttactagactggggacgagggacaagcaagaagaggagttactctagttactctatattgtatccttttgtaattttgaatttgtgtcataattttgtattatgtgcatgtacagcctgatcaaaataatcagcatgttgctaaacagacgccatctctagaagggtttacagtctttacagcgggtcagcatgttgctaaacagacaccatctctagaagggtttacagtctgtacagccgggaacacatggaaatggtgtgggcaccgtaaacatccggaaggcgttttgacctgcagaagtgacgtttagcctcaatagtcagagcattcgttctcagtcatgtcacttaaaatccagcgggggctgggcgggaggccaaggcgggtggaacacttgaagtcagtagtttgagatcagcctggccaacatggtgaaaccctgtttctactaaaaatacaaaaattagctgggcgtggtagcccacgcctgtaatcccagatactcaggaagctgaggtaggataatcgcttgaacccgggaggcagagtttgcagtgagccgagatcgcgccattgcactccagcctgggcgtcgcagcaagactccatctcagacaaacaaacaatccagctgggttcagtgttgtgcacctatagtcccagctcctcaggaggctgagacaggaggatcactcaggcccagctcctcaggaggctgagacaggaggatcactcgggcccagctcctcaggaggctgtgacaggaggattgctcgggcccagctcctcaggaggctgagacgggaggatcactcgggcccagctcttcaggaggctgtaacaggaggatcactcaggcccaggcaggagactgagagaggaggatcactcaggcccagctcctcaggaggctgtgacaggaggatcactagggcccagctcctcaggaggctgtgacaggaggatcactcgggcccagctcctcaggaggctgtgacaggaggatcactcgggcccagctcctcaggagactgagacaggaggatcactcgggcctaggcaggaggctgagacagtaggatccctcggtcccaggcaggaggctgaggcaggaggatcactaggagcctgaggcaggaggatcactccggcccaggagttcatgctagagtgtgctgtgatcactcctgtggatagccattgcctgagaaacacggtgagaccccatctcttaaaaaaaaaaatccattctcccatttctttggataattttgtatgtaattgtataattacttatcattaggaatcttacatctgtggctatgggaatggcagttcctaggtgtccattctggctaaaggatattttataactgacaaaaactgcatagtggttccccacttgttcccacaggtgcataagctggagcctgaggcgtggaaacacgtggaagccgtatatatagacattgcagatcgaagccaagtgctcagcaaggtaggatccgtttaaagacgtgggtggccttcgagacgcagaaatgacttctcaatgctaaagaaaccaggaaaccatacccaacttggcacaaaaggaaattctgatgtgtcttgcttgttttatttttaaaagtgagtattaggagatttcttgtcttgagttggggatgccaccagaaaattagtggcccaaatttgtgtgccctgtttggcctctgaaaattattactggactaagtaggtattgtagctagagtattttgccctgctaaaatgatgcttagcctgaaaaatcggagcaccacttctcaaatttatttttccaactcagtaattaaaaaaacatttacttcctgcctactgggttgtggaatattgtcaggatctctgggttccaggtgagggatgcagaatgcagggaaagacaggtcccctgccctccagaagtcggtggcgccttttcagagtaacacacactggagcagacccctggaaaaggacagtccactggtggaccatgaccttggtcaaaagagggaccaggtctggcttgctcactgttttgcacccaagaagtatttgctcagggaatgagggggttagattcctcctcattcattaccattcttactaggcagaggcctcattgggattaaaagacaggaatgtaactctctgcccactgatagggaatgtgtgtttgctctttgtatcccaggggtgtgatacctctttcctgtggtcactctgcacttaagatattttggggcctggcacggtggctcacgcctgtagttccaacactttgggaggccaaggtgaccgatcatctgaggtcctgagttcgagaccatcctgcccaacatggtgaaaccccatctctactaaaaatacaaaaattagccaggcctggtggtacgtgcctgtaatcccagctacttgggaggctgaggcaagagaatcgcttgaacccgggaggcagaggttgcagtgagcagagatcacaccatcgcactccagcctgggcgacacagcgagactccatctcacacacacacacacacaaagttattttgatttgtgcatttccgaaaagatataaaaaccatcttgtgcttccttgcctaatatcccaacccccaccttcaaaacgttggtggatttttcaaaaagctttttatggaagtttaacatatacagcaaagtgaatataagtatgcagcttgatgaattttctcaaactggatactagcaaaaagtatgattctttgagtattttgtcaactctggttgatctgtgtgagtggagggaagcagtgatggtgaatatttattttttaaagcacacataaatataatctcctcagaggctgggcacattggctcacgcctgtaatcccagcactttgggagaccgaggcaggcatatcacttgaggtcaggagtttgagaccagcttggccaacatggtgaaaccccgtctctactaaaaatacaaaattagggccaggtgcggtggctcacacctgtaatcccggcactttgggacgccaaggtgggcagatcacgaggtcaagagatcgagaccatcctggccaacatggtgaaaccctgtctctactaaaaatacaacagattagccaggcgtggtggcaggtgcctgtaatcccagctacttaggagactgaggcaggagaatcgcttgaacccaggaggcggaggttgcagtgagccgagatcatgcctttgcaccagcctgggcaaaaagagtgaaactgtgtcaaaaaaaaaaaatacaaaattagctgggcgtggtggcgcatgcctataattccagctacttgggaggctgaggcaggaggatcactggaactcaggaggcggaggttccattgagctgagattgtgccactgcacttcatcctgggcgacagagcgaaactctatctgaaaaaaaaaaaaaaaaaaaaaatcggccggacatagtgactcatgcctgtaatcccagcactttgggaggctgaggcatgtggatcacctgaggtcaggagcttgagaccagcctggccaacatggtgaaaccccgtctctacaaaaatacaaaaattaccctggcgtggtcgcaggcgcctgtaatgccagctactcaggaggctgaggcaggagaatcgcttgaacccaggaggtggaagttgcagtgagctgagatcgtgccactgcactccagcctggccaacagagtgagatgctgtctcaaaaaaataaaataaaaaaataaggcagggcgcggtggctcacgcctgtaatcccagcactgtgggaggccaaggtgggcggatcacgaggtcaggagatcgagaccatcctggctaacacggtgaaaccctgtctctactaaaaatacaaaaaaaattagccgggcatggtggcgggcacctgtcgtcccagttgctggggaggctgaggcaggagaatggcgtgaacttgggagatggagcttgcagtgagccgagatcgcgctactgcactccagcctggccaacagagcgagactccctctcaaaaaaaaaagaaaaaaaaaaaaaacttctcagctttgggaaatactttatgagagagagaaatttattatctttgttatttttgttaagtagatgctataagtttgtatctcctgagcccacattagtcaatgtagagggacagctgaaaattaaacttttgttgtggttaattaacacaggaaattgactgcattataaatctgtgaagtgagactcaccagtagtggataggttccatacactgaacatttccagtaatgattttgttaaaacaagccagagggagattgcactggaagatttaaggaatgacagccgggtattctgagcgctggctgtattttagagtcacttgcagagatttaaaaaaacaaaaaacaaatctgtgctgccgtcacctgcagatattctcagtcactgggttttagttggagtgactcaaaaatctgtgttttaaaaaggtcttccctggtgatctggatgctcaccccaggttgaaagtctctgtcttcaacacggtaaatatgtgcctgctcagacagtctggtgatactttcacactggcaaaatggaaaacaaaccctatcggagaaaatcacatagaactctcctctgaggctaatgtaaacagttctacatcttgtttataacattttcccatatttgctttgtgccatcagcatcaagatctggtatggagtgaatgctaatgaaagatctgttctccccatctctcactccctctcccactcccctccaaccccaattccacaatttctctcaggattacaaggcagaggaagacccagcaaaatttaaatctatcaaaacaggccgaggacccttgggccccaattggaaggtaccattcacaccttcactgccagggggctgggcagcatgtgggtgggccgctccctgtggaggaggggcatggctggggtgagctggggacggcctgaggtctgcccgttgttacttgcgtacccatgggtatgtttctaatgcagcaagagcttgtaaaccagaaggactgcccatatatgtgtgcatacaaactggtgaccgtcaagttcaagtggtggggcctgcagaacaaagtggagaacttcatccataaggtaagtagctcggctgaggccttcccagtgactgcgtgtgtgtgttgtgggggggtggtggagaacttcatccataaggtgagtagctcggctgaggccttcccagtgactgcgtgtgtgtgcggtggggggtggtggagaacttcatccataaggtaagtagctcggctgaggccttcccagtgactgcgtgtgtgtgcggtggggggtgtttggcccagtgaagaagatggcccagcccatgtggcctgcatgacagggttgccaacatgagcatacctcacagtttggcggcttcccagctgcccaccttcccttgcactgaaatgtcttacggtttaatgctgtccttccagggacaccacatgtgacagggaaggaaactgaggcaaaagaaggccacaggaagggacttgctatgactgacctacagataaaactcagtctttcttttcttgcagctgaaaggcaagaggtgctgggagccaggttggccggtgccctgaattactctgctgggcaggtctaaggagttttagagccttttaatcctccgacatgtttgagcctcacttgggccatatttcatagctgctggccagttttaatctggcattagacaccagagacaggaagaaatgtggcagtggtttggggcccttggcttgcctaggagttcatgggctgctgtcttgctggtgctttgggcagagggcctagtgtgaggtaggcatccttctttcttgggggctccctcctatgtgaagccatacctgttagacacgtgaaggcaaaggtcattgacccatggctggtccagataaccagccgggcattactcctcctcctgtccgcccgtccccagtctagtgtgggtattcgtgtggagtgcatggagagaagggctgtggcagcagcctttgccttctgcgttctaacgtggttccctcctttctatagcaagagaggcgtctgtttacaaacttccacaggcagctgttctgttggctcgataagtgggttgacctgaccatggacgacattcgaaggatggaagaagagacgaagagacagctggatgaagtaagtgggggctctgggggctctcaattagataaacaaacgaagattaaggagactgttttgctggggcgcttcaccgagagcaccatcctgtagttctgggaacacgtcagtgtctgctacagggacggtatcctgggcagtacgtgggcactatacggaagaaaacagcctgtgctcttgaattgacagttgagttgaagtcttggcatacccacagagacaaaaatggcagtatgtgccgaatgccaagtgggtaatacagctgctacagcgatgcttcagagcctggtgggaaagagcgtgcggggctgcagagctggaggtgaccctgggaggaggcaggctgggctgacctgtgaataccatgcacattacccacagaggacagccacagcgcacgcaggagctgacagctggcggctgtctacggtcattttgagctatcagagttgagagcttttgcttttctttttttggtcttggcgtggatcgcagaaggagggttccctgttccttaggagcctaaagacccagcacttctcatgcctcatttggagatgctgatgcttccttgagaggcccactcagaggagattgtcagttagtaacattcaagcactcactgtgtgccgtctaccattctgagggcctttacctactgcagtcttcacgataccccatgaggaggcgctgctgctctccctaccctcagatgaggaagtggaggctctgagagctcaatgctgcggtgctctgggtcacaccgtcttgcaggtgatatggtcagagtaagagcccaggactctctggccctggaaccacagctcttaatcactcccctgtactcctccctctaaatgcaattttgggccctcctgccatcttggagctaaaaatatgataaggcaggaagctctgtttcataagaactgccatcacttctccctccttgccccaggtggggttggcatggagtttgggtatccagtagaggcattgctttgcaacagcccactcagctctcctgcagggcctcaggtgagagccaggcttgggcgcccatgctgcccatgctgcacggacggtgtctgcttcaccatgctggtctagggcgaaaattgggtccagaagttcttcctctggaaccccgcagggaactgtttttaccatccagaatgacacttttcctgggctgactcactggtaagtggtgcactgagttggttcctcttgaagacagatgttttggttattcatttagctacatttagcagggaagtggcaggatttcattggggcacagtccctgattctttcgctaaggatctttaggaaggggtagacctcagtgtccaggggtctggtgattgtgactgtgtaagagaagcctgaggcttttggtcaccctagtcctgacaaaaagaaagggaaaatgttaacaaatgaggaaacatggagactttcattggagttttagcctggagcttcagccatccactgcctgacaaaggccagcatgacgtatgttggggttcgtggaagtatttgctgtccacctttcattccttcgggtagaactcaaattcttggagctagaagaactctccagaggatctactggatctgctttgttcagatccaaactttgagagccctcagtgttagagagttattttttaatctctcagacccttttgaaaatctttctcggccaggcacggtggctcacacctgtaatcccagcactttgggaggctaaggtgggcagatcacgaggtcaggagtctgagaccaacttggccaacatggtgaaaccctgtctctactaaaaataaaaaaaattagccaggcgtggtggcggacacctgtaatcccagctgctcaggaggctgaggcaggagaatcgcttgaacccaggaggcagaggttgcagtgagcagagatcatgccattgcactccagcctgggcgacagagcaagactccgtctcaaggaaaa

SEQ ID NO: 14788 - DNA, 16230 bp, Human
tctatgtcaggtctctagcttcaactaaacactaatagcaagtggtagtaaaggtacaaagctatgaccctgctagaaaaaattcagtgtctaggattttgagtactaagagagtgcaaaatatgtgatgagtttaagtctttactatcattgatatttatatagagccattccagaatatcaggaattaactgaatttttgagaactatcccctatttaaacacaaggtattctattttggtttagtcttctataattttggggtaacaactgggaacaagtccgagaccactttttacacatcttgacatgaaaaaagaacaccttatattagaaaatgtttgtgtgctgcacttcacattttatatacaggggcaatagcacatcagtgagttctggaggtagtgtttgaaaaatttcagaattcccaggcatgctggctaacccctgtaatctcagcactttgggagccggaggcaggcagatctcttgaggccaggaatttgagaacagcctgggcaacaaagcaagacctcgtctctacaaaaaaaaattagctgggtgcagtggcgtgcgcctgtagtctcaacaactcaggaggctgaggtggaaggattgcttgaggccaggagttcgaggttgcagtgagccatgatcacaccatgctccccagcctaggcgacagagcaagaactcatctcaaaaaaaattttttttgcaagacccctcagtcagaaatagattcaaattcttggagacagacccagtcaccttactctacaatggttcagaggctgctaatttacatgttacgggaaccctacttggtctgacagtatgctgtagggttacctgccaaaaaaatatagaggcccagccgggagcgggggctcacgcctgtaatcccagcactttgggaggccgaggccagcggatcacgaggtcaggagatcaagaccatcctggctaacacagtgaaatacggtgtctactaaaaatacaaaaaatcagcccggcgtggtggcgggcacctgttgtcccagctactcgggaggctgaggcaggagaatggcgtgaacccgggaggcagagcttgcagtgagccgagatcgcgccactgcactccagcctgggcgacagagcaagactccgtctcaaaaaaatatacatatatagagagaggcccattcctccagggatcattatcatttggtatattggtatatatgaagaaaataagcgatacgatccacagacatgcgggattggccgggtttgcccaggagctagagacgggaccgttatctcaatatctcaattttattttttaaatagagaaggggtctcgctatgttgcacaggctggtctcgaactcctgggctcaagagatccaaagttctgggatttacggcgcccggctttttttatttatttatttatttttatttattttggctgttccatagacaagagcagggataaccggctgggcgcggtagctcacgcctgtaatcctagcactttgggaggccgaggcgggcggataacgaggtcaggagatcgagaccatcctggctaacacggtgaaacccgtctctactaaaaaatacacaaaattagccgggcatggtggcgggcgcctgtagtcccagctattcgggtggctgaggcaggagaatggcgtgaggccgggaggcggagcttgcagtgagccgagatcgcgccactgcactccagcctgggcgatagagctagactccgtctcaaaaagaaaagaaaaagagcagggatacccaccggtggaatacccgttatctcaattttgtacaaggaaaacggaattcagaaaggtgcctagaggacgcacccctccgtcctggccaatcgctgaggacataaccggaagctcaacgatgaccgaggcgctgagatatcgcgaggtgaaatgtaaaaactgccaacaatccattggctaacgaggtcgatgacgccagacgcaagacgccgggcctacagcgggagcgtgaggaaagccgtgcgttgcgttccaaggcatctgtgagcccgcggagtatacaccatgagcaaagctcaccctcccgagttgaaaaagtaagtatgtgtgagagccaaaccgaagtggtcagttatttgcgtcctgcgagtcccttggttccctctccgttagccgaatgtcttgagccgcttcacttcatttcttcttccggtccgaggtcgccgggatcccggccaggctcccgcgcatgagacgtgaagcccgcgcagagctcgcgcgtcggtgtggttacagccggcagccacggcacctccttccggccgactagtctccaggtcccgcggtctggcccctggtcacccggcgctgtccctcgttccttgaagatctccagtgctaccttttgttgaacatctcgaatagtatcatgttctagatagacggctagagggggaaattctctgaaggaactaaggaggggctggaagggaaggaagtgtttttaaaactacgtgaggcatcagaatccgaaagccactttagtcttagcaaatgtgtttgtaggtgtttgagcttttacttagaaacctcattcctttttcttgccttcttttacgttaagcttgaatgtcatgtgttatcttgctctgatgttgaaactatataagaacattcatttttctttttttttaagaacattaattttttctagtcagagaaggctaattttttgaagttttttctacacacccagtaaagtcaaacaactttaagtaggagagccttactttaggtaggactcaacgtaaagctttgaattcctcaaatactttttgagtggacttaacaggttatgtgtttcctgactacgtttctgttttgcttatacttcctgatgctggaattctacatgtattagttggattgcacaaaggatgcaaaatttttacagggatcagttttttctggcgtagcatgtggttggctttgtgtatagttagttcatttattaccaggcccatggaagtcagacaaaaggtaaagttcctatttaataattttgcggccgggcacagtggctcacgcctgtaatcccagcactttgggaggctgaggcgggaggatcacctgaggtcaggagttcgagaccagcctggccaacatggtgaaacccccgtctctactaaaaatacaaaaaattagccaggcaggtggtgtgcgcctgtagtctcagctattccggaggttgaggcaggagaatcgcttgaacccgggaagcggaggttgcagtgagtcaagatcgcgccattgccctccagcctgggtaacaagaccgaaactctgtttcaaaaaataataatatttttgcatttaaaggtccatttgtatcaaagccatcttttgtatgaaaactacttctatgtatattttagttaggtctgttaaggaattaattattaaaacataagcccaacgcggtggctcacgcctgtaatcccagcactttgggaggccgaggcgggcggatcacgaggtcaggagatggagatcatcatggctaaaacggtgaaaccccgtgtctataaaaatacaaaaaattacgtgggcttggtggcgggcgcttgtagtcccagctactcgggaggctgaggcaggagaatggcgtgaacccgggaggcggagcttgcagtgagccgagatcgcgccactgcactccagcctgggcaacagagcgagactccgtctcaaaaaaaaaaaaaaaaatagaagttactcagaaattattgtgaaaattactctttttatctgaaagttatttttggtgatgtaagtatcctctggattcatcagggactggtgaaatggtgatttttttttttttaacaaaaagaccattctctacttgtaatctaagattttctttctgattcataacatagtttttgaaaatttcagagaaggaagctagttttaatacctttctcttcctcgtaggtttcatgaattgtgaaatccggtcagatctgccgccaaaatgacttaaaaattttttcttcctctgctttctcacagatagcatcttcttttacaccattatgccctccttctggtgtagcataactcaggtgttcttaaatggggagtagggaatctggtgctaccggcttctagtgagtagacaccagggtgctgctaaacatcctactgcttattcgactgcccccaacaatacaaaattaactggtcccaaatgtcagtagtatagaagttgagatacactggcttaactgaattcttccttccacttcttaaaatttgctgccacggtagtcttgccagtgactgctttaataatttatcacagtatgcaaaatcgagtctgtacttaacccagcattcaagcaccaaaccttctagctgctaatactcaggtattccgttctccagtcacactgaactatttgtgtttgctctcacttgctgtgtgactttgaaaaattgctttagcttttccaagcctagttctccatctgtaaaaacggtggaaatgatagaccataattgcaaagtcgttgtaaagattgtataagatcttgtgtgttatatttgatacgttttatgtatcttattaaaatatagtttacttcatatatgtgtgtgtgtgtgtgtgtgtgtgtgtgtgtgtgtgtgtgtgtgttttgagatggagtttcactcttattgcccaggctggagtgcagtggcgcgatcttggctcaccgcaacctgtgcctcccgggttcaagcgattctcctgcctcagcctcccgagtagctgggattacaagcatgcaccaacacacccgactaattttttttttttttttttttttttttttttttttttttagtagagacgggttttctccatgttgatcaggctggtctcgaactcccgacctcaggtgatccgcccgccttggcctcccaaagtgctgggattacaagcatgagccaccgcgcccagcccataaatatatttttacttgtaaatgtatctactccctccttcagtcatgctccttgttttatatttacattttcccatgataatcctatacattaaaattgaataagtgccccacttcgtggcccatatactaaacatctttttttcatttttttatattttaaaatttgaatgaaatttttaaaattgaatgaaattttatgttttctggcctatatggaagaaattaaaaactgatttgactgcatggcttaatctcgtattccactaaaatggaatttttttttaattcatatcgtttgaagtttcaaatgtgcatttattattctaaaatatacttaaatgttgaggactaccctgaacatttatgcttgatgctttaatattaaataaaagaacactacttatttcaaatataaaatacctattgaattggatatgatttgattactgtttgctgtctttacaacttagttttggaaataaccaaacataggcaagtctttgtttttctcttgtgactataaaatccagtcattgaaaattaggtcaatgagaccagatgtggtagctcatgcctgtgtaatcccagcggcactttgggaggctgagggggagtatatttttcgaggccaggaattcaggaccagcctgggcaacataatgagactcccatctcttaaaaaaaaaaaaaaaaagaaagaaatttaggtcaatgaaacaacgtagtattgaacaataagaatgtaattcacattagtatactctacttaatgtaaattaatatagtctaaatatgtttcatttttattgcctttcctcttcccaaattactttgcttcctagaatgtctaatttaggtaaccctttacgcccccactctttttttcccctgagacagtttcgctctattgcccaagctggagtgcagtggcgcaatcatggctcactgcagcctcaacgtggcaggctccagtgattctccgacctcagcctcccaagtagctggaaccataggcatgtgccaccacccccagctaatttttgtatttttggtagagatggggtttcaccatgttgcccaggctggtctcaactcctgagctcaagcagtccacccgcctcagccccctaaagtgctgggattacaggcgtgagctacctcgccctactccctcactctttacagcaatacattatttttactattttagatttcattattcccattgtataaattttagcaaattatcttaactatacctatttacttgtttatgcttaaatttttttaattggttatataatctttacccttttcctttttcagatttatggacaagaagttatcatgtaagtttgttgttgttttggggttttttttaattatttaattgctttttacatgtgtcttagcaatgtttggagcaactttataaaaatttaaagcagccaggcgcgatggctcacggctgtaatcccagcactttgggaggccgaggcaggcggatcgtgagatcaggagatcaagaccatcctggctaacacggtgaaaccccgtctctactaaaaatacaaaaaaaaattagccgggtgcagtggcgggcgcctgtagtcccagttactcgggaggctgagtcaggagaatggcatgaacccaggaggcggagtttgcagtgagccaagatggcggtactgcactccagcctgggctatagagctagactccgtctcaaaaaaaaaaaatttaaagcacacaggacctctaattcacatccgttagttaagcagattacttaatcctaactagacaattttatttacctaatttctgataattaatttaacagcacttcagactttatcttatgtaagcccttcctcactttggcaaaattaacaggatttatcaaccttttttctttaaacaagctacaaaggacttagacaaggaacagttatcttgtttcttgggaatatgtaggaataacatttgttcaatttatctaaaaatctgacccacacagtacttgaaatatatgtaggggaaaaaaccatgagcgttagaggtaagcagccttcagcttgaatctcacttctgtcgtacagtagctgtataaccatgaacccagttacttaaaagctcgggcacggtggtttacacctataatcccccagcactttgggaggccaaagcgggaggatcccttgagcccaggagttcgagaccagcctgggcaacatagggagcccccatctttataaaaattttaaaaaagctctgaagtttagttctgtcctataaagtaaggataatactactttttaggattcttataaattaaaatgtggaagtaaatacaaaaatgtttaacccagttcttgtcatacagtaaggatagtgggtttcagacatctcaaatacttgtgttttatcccacctgatttttagtgaatgcttggtagctaatggaatgtttttctaaaacttctttttctctttttaatagtgaaattaaatggtggcagacatgtccaaggaatattgcggggatttgatccctttatgaaccttgtgatagatgaatgtgtggagatggcgactagtggacaacagaacaatattggaatggtggtaagtaaagatacaagagttctcttggagatttcatttttcttttggaatgtgtattaactttcctggttagtaacccccagaaatggcaaataacaggcaagattagactttccatctcctttttagttgcatacggcagttactcagctgtagtaatatcctggttacctgtaggtaagatctcaactatacagaacctaaggtcctagcgcttgaaatagctgttggaaatcctttttgagctttattctgcaatagaggctcatagttggtccttcattagagcagtagttctgaaaccttaatgtgtatatgaatccccagggaatcttcttaaaatgaagattctacttcagtaggtatggggcagaacttaactaaggttttgcatttctactaatgcctaatgcagatctgccagttcacaggtaacactttctgattttacttgtatacatagttaacctggattttctggtttaccacacccaaaattttaaggtagccaaggtaaaagttacaagggataatcacaatgacagttattcacatgagagaaaaagcaggaaaaaataagcacatactgagccctcataggattaaacattcctacattcattgggccgtagttttagtgattgctgaagaagagttttgatacccagactttgagtccctctttgtctaacacaggacaacatacctaataaagcggtaagcccaaagttcttgaaaaaggtgaaccaaaaaggacaacttacttttagcaaattattaagcataaagacctccaaggagtggtaagagttgctaattattagccttgatttattaaccttgatttttaagtttgagcagtaaagttgaagatagacctattttgacatctctgcctgtttaatttttttacataccattctttccaaggtttgtgttattacttatttcagatactttttcattactgtattttgaaaagcaaatcaatagttatgactgaaaaaacagtttagagtctccagataccacactgtacccccaagtttcatgtaaattgacttgtctttcaggtatattcccttgtgagcttctgttgaataaggctgccagcatgattagtagccaagtccttttaaaaacattttctagataccccaagattttcctctcagcccttatttttacaaataaattttcattctaatagaaggtagattaggtttttagttccttgcaaaaaatttgctgaaaaggattcaggaagaacttggcacctaattgtcaattctgctttgagaagattagagaattatgtaacacactgctcattggaattttatcagagaaggaatagagcatccctctggcaattttccccctaaactttatggactttattttctttgcacagaaattggttgaaagcactgccatcccaagtcatttaagtaatgattacctacttagtgtgttgggcagcctcctgttccatctctgaggtttatgtgacacacacgccccccaacccccagccaaagaaaaaaaaaagtttttatcagcagacagtaattcttgctgctgagtcttcactttgaaaaagaaataataacacatcagacttctttaataaaagacattttaaaaggcaagaacagagatgaactttttgacttttctaaagttggaagaagggaaacaaataggttaaggttttgttattttgttagaagttgtttaacaaaggacagttggcttcattattaccttgtccaagtcagtgatccattgaggccattgaaattacttaatactgttttattgcagttatgtgtgtgttggctgggcacagtagctcacatctataatcccagcacttcgagaggctgaagcaggaggatcacttgagcccaggagtttgagatcagcctgggcaacatagtgagacctcatctctacaaaaaaattagaaaattagccgggcatggtggtgtgcacctgtagtcccagctactcaggaggctgaggcaggaagtcaaagctgcagtgagctgagatcacactactgcactccaatctttgtgacaaagcgagatcctgtctcaaaaaggatgtgtttgttttcaggagtgagtttgtttttaacctgtcagttggatcgttacctaatgataaatctcaactatcttctgagacatccccagagttgtcagtggcatcgcctctatcttactttttattatgttacatagttcaggcactcttgctagggttgtccttctgtagcatcattgaagcacaaaaaagggagcagtatgtaattctggacctgatggttcaagtttgatttggagaattaggcctcaaacacagtggcaaaagaggaagagcactacaataggcctcctttatcctcagagtaggtaccagaaaccacagatagtagtgaaccctatgcacaaatttctgtgtgtgtgtgtgtgcacgcgcgtgtgtatgacagagtctcactgtgtcaccgaggctggagtgcaatggtgtggtctcgggtcactgcaacctccgcctcctgggttcaagcagttctcctgcctcagcttcccgagtagctgggactacaggcgcacaccaccacgccaagctaatttttgtatttttagtagagacagggtttcactatgttggccaggctggtctcaaactcctgaccgcatgagccacctgccttagcctcccaaagtgctgggattacaggcgtgagccaccgcgcctggccagcacgaacttctttttacttcttcacaatctcacagatagaagattcgtccttaccataaatcttggcagtctcaacatatgattctttttcttattaagtcaagaacttgtaccttttcacttaaaggaagcactttacagcttctctttggcatatccatattgccagcatcactgctcttatactttcaggctagtattaagttaaaaaaagggttacttgaacacaagtaaccctttgataccacaacagtcaatcataaaactgagataactgattaatgggcagcatggagatgctagacaaaggataatccacatccagggacagtatgaggtatcatcacactgctaagaacagcatgcagtgtaaaacttacggatgtctgttgctgggactatgcatttaatgtttttggaccacagataaggtgggacaaagttcaccatttagccttattttctaaatattatgtgacaagacaaatatgtaaatttagcagggagctaggcaggaaggctagcttttcttgctttggtcaatgagatgtgatgttcaatatctgttgccaaaaaaaaaattgagaatttaaaattctgataactggccaggtacagtggctcacacctgtaatcccagcactttgggaggccaaggcaggaggatcacttgagactaggagtttgagataagcctgggcaacatggtgagaccctgtctctacagaaaattttaaaattagcccagcttggtggctcatgcctctggtcccagctacttgagaggctgaagtgggaggatcacttgagcccaggaggtcaaggctgcagttagctgtgattgaaccactgcattccagcttgggtgacagagcaagaccctgtttcaaaaaaaataataattaaaatgaaaataaaattctgataactaggtaagcatgtttctactcctggcttatgctgggcatggtgatgtgcgcctatagtcccagctactcaggaggcagaggcaggagaaccacttgagcctaggagttcgaggatgcagtgtgcagtgattgtgcatgtgaatagccactgcactgcagcctggtcagcatagctagtcccagtctcaaaaaaatggaggggagctctgttaacttagaagaagagtgtcaatctttagactctttcagttcccattgtcattttcagggcactgtgtttactggtttttgttgttggtttgagataaggtctcactctgtcaccgaggccggagtgcagtagcatggagcttggttcactgtggtctcaacctccctgggctcagttgatccttccacctcagcctcccgagtagctggaaccacaggtgtgcaccaccaccctcagctaatttttgtatttttgtagagacagggttttaccatgttgcccaggctggtctcaaactcctgggctcaagctatctgcccacctgggcctctcaaaatgctgagattataggcgtgagccaccatgcccagccattcttttttaaatctgctctttactaccttatcatactcattgctgataattggctgccaggttccaagacacttatcctaccaattgtgttcccttctattctgtcagctgcagtaatcacatgtgagttcttttattcatatttaccaggttattgagccctctgtgtgcctgctactattttaggcactggggttttgcacctaagtccctgccctcataaaatttacatttgtatggagaacacaataaatcatagcgtatgtgtaaataaaacaagcatgatactgtgagaaaagaataagttacaactacttttactctagctgcctataagcatagctccactttgaatctttttggaatgcctccatttctaataaacacctcaaattattacattacctttctctcccctacattacctattctttccctcccgtacccctccattcacctatccaattctacttgactgatgggtgatctatcgattatgatgatctccagtctattagggacttactgtttttagtcccctagccttccagtttcgcttatttttctacccctcttgaattcatttaccagctgattcatctatactctgataagtttgtctgttggtttgttttggttttggtttgttgttttttttttttttttttttttttttttgacaaaagacagtttcgctcgttgcccaggctggagtgcagtggcgctatcttggcttaccgcaacctccgcctcccgggttcaagtgatttctcctgcctcagcctcctgagtagctgggattacaggcatgtgccaccacacccggctaattttttatttttagtagagatgggggtttctccatgttggccaggatggtctcgaactcccaacctcaggtgatccacccgccttggcctcccaaagtgctgggattataggcgtgagccaccacacccccgataaatattcttatcttcatttatggcttatctactaggtcaagcactgttctcctagggccttttttttataacttctctttctgcctctaggttctgtcctattcaaacttcggcgtatttatataatatcttgttgcagggacacttatggttgtcattcccccaagtgaaactctcactggctcattgttagtttctgatgtcctccaaacactaagattggcatttgaagctttccaagattgaatgccaactatctttgtttcctgattctcttcgtgaactttttactgcattcaaattagattacttccttatcctctcatactttgtcttcatcttagttctgtctagaatttcctacaatctccttttcaaaattctgcccaatttccaagacccaggtaaaatgtcattttcataaagcatgcctttcacaatttcccatcctggtttcttccctaaatgatctcatacctccaaactgtacctaacatactctactgtacatattttactcattaatttttggatcccatagagtcagggatgggcatttaaatttgagtcctgcattttagaaggtgaaattagggccaggcgtagtagctcacgcctgtaatcccagcactttgtgaggctgaggcaagcagattacttgaggtcaggagtttgacaccagcctggccaacatggtgaaaccccgtctctaccaaaaatataaaaattagctgggcgtggtcagggctcctgtaatcctagctacttgggaggctgaagcaggattgcttgaacctgggtggcagaggctgcagtgagccgagattgcgccactacactctagcctgggcaacagagtgagactgtctcaaaaaaaaaggtgaaattagtcattggagacttggcattagaatctcataaagcaaattgttagccttaaatccaaaagatgtctgtcgtataaagggcttagagttgtttggtgtccctgtggcttgaacaaagctttgcaaaccgacatgtaatattaaaaaaccattaatgatttggtgaaaattcttaaatcatcatagttatgtctgttacctgagttgttcttttcaaatttatttttctctttcttaggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaatgctttctcagatgttctgaatatagaatatcagctctcattccagttttttctaacatgaattttcctggttgacattgatttcaaagggttttatgcattaaagtgaaagaatcttattaaatgtgaaacatggcaaggattccttctgtccatcatctttcaacactgaacagataaagaagttacaaacatgagtgagtttcttctaaaacactaattttcaaaacttgtaagaatagtaactttgatctagcctgactttcccaagtacatctacattccaaatatagtacaacagaagcaaaagacaagaagtaatgatgtagttgtttattttgaatataatcatgaagtggggaaaaattttaatacaagagtagaaagaggattccagagaaaaacattccagtgtatcatggttctttgtgagtgagtagagaggggtagtgaggatgctgtccacaatgtattcatctagttaatgaattgtatggcccacaagctcaaacgagagatacattacagatggttgtattataaacctaatcttaagaaaccttaccaagcaaatgcttaaagactgatttttttgtgatctgataaaaagcctgcaaatcgtgaatcacttttaaactgtacagaatggactacacaccagtatggtaaagttcttgtaaaacaccaaacacaatggctcatagatatatacctctctcactcttaaatggcatttcctaattatagaaaatgtttacaacaaaagaacaagagggatcaaactaacaatcaataaggagaactgatgtgaagtcccatacactgttactccatttttcagcaactctttataactccttcattgacttgactcctttacaacatacagctgaattgtagaactagttcttcaagtgtggttcctatagtagaacagcagcatcactggggaacttaataaaatgcatcttcttatatcccataacaaacttattgaataaacagggtggagcctagcgatgttttaacaagcccttaaggtaactgatgcatgctcaactcagagagccactggagcagagctggctttcattcagcccctgcatcatttttaccagtctcttctattaaaaaaaaaggtctggagcagtaagctctgacagtgttttttcttccaataaaactcttaatactatagttgcataaaactacctaatgcgcccagagtagcaggttctgctaggatttttctcccagtaaaaaagcactcaacactgtagttgcattaaaactacttgatgtccttggtgtattgataacctgttttgcttttgccaaagcaatttcagatgccctactggaaaatttatccagagtaggtttgatgtaataccagcaacatttttaattttttttttttccttttgagacacagtctcactcttgcccaggctggagtgcagtggtgcgatctctgctcactgcaacctccatctccagggttcaagcgattctcgcgcctcagcctcccaagtagctgggattactggcacacgccaccatgcctggctaatttttgtatttttagtaaagacagggtttcaccatgttggccaggctggtctcaaactcccgacctcaagagatccacctgcctcagcctcccaaagtgctggtgagccaccatacccagcctaaactggtttttgttttttttttctgagacagagtctcgctctgttgccaggctggagtgcagtggtgcgatcttggctcactgcaacctccgcctcccggttgaggcaattctcctgcctcagcctcccaagtagctgagattacagtagctgggattacagacatgcgccaccatgtccagccaatttttgtgtattcagtagagatggggtttcaccatgttggccaggatggtcttgatctcctgacctcgtgatccgtttgccttggcctcccaaagtgctgggattacaggcgtgagcca

SEQ ID NO: 14789 - DNA, 14862 bp, Human
gctcggctccgcagcggtgcagcctccttgggacggtcggggcagaatggggagagactccccgcgtccaagataccggactggagccgaggccccaaatgaagggaggccctgcctggaatggggcttcgaatagtaccgaggggcgcccaggcattgtgcggggcagaatggggtgcgggagggccgggggtcgaacccacttccggtcccctagccgggtggccgggtccacgcagacccaagtgcgcgtctgtgtgagcgctcaggccctgccttcacccgcggagcccccagccctgcctgccccgcccctcccgcctcccggattcggggagcgctgctcccggggcgcgcacaccggggcgtgggggcgggctggcaggcagatccaggcggttttctgggcatcccctctcggggcctcagtttccccacctgtagaatgagggtaacagaggcctaggaatgggtaaattgggcacccgagaatgtggcgcccctccgccctgctcggacacctcttggggttccccgtgactgaaggatgctcagagcctccacctgacactcgggcctcttggtggatagcacctatccttatagccaccctgaatccttgacaagcaacttaacccactgccaaggctttgcatgtgccgttccgtctgcctatcgcgccttcctatccgctgtgatgatccattctctagaacagcacgtccatcccccgaccctagccctgtccatcacagggcgtctgaacccgcagggctaggctgggaatgtgtgcctatctccgcctccccaggctgggactcctggggaataatcaatgccctgctgccggcagcctcccctcctcctcagctgcagtacccccaccttctcctggctccctgtccctgcctggggctaaggttccttctaagcacctccccatctgcattttgtgcctactctgggccccaggctggagctacctgccagcccactcactcctcctctgcagagactggaggtccatttgcttggactcacctcgaggcctttgcttgtgtagaggcctcttcctggactttgttccctacctcttagttcagctggcctgacccctctatggagctcccaaagcacccggagtggcctccattgcgtcctccctgccctaggtatctggccacctggctgctgccccctcatgtccaactgggccaagtcggcagatctaggtgtaagtcctggcttcctcctggcctactgcacggccctagatacctccctgctctgagcctcagtttccccatctgtaacaggggtgatgaaaagcctgtttactggccgggcgcggtggctcacacctgtaatcccaacactttggaaggcagaggcgggaggactgcttcagcccaggagtttgggaccaacctgggcaacatagcaagaccccacctctattggaaaaaaaaaaaaaaaggctgggcaaggtggctcatgcctgtaatcccagcactttgggaggccaaggcgagcagatcacttgaggtcaggagttcaagaccagcctggccaacatggtgaaacctcgtctctactaaaaatacaaaaattagctgggtgtggtggcctgctactcgggaggctgaggcaggagaattgcttgaacctgggagacaggttgcagtgagctgagatcacaccactgcactccagcctgggtgacagagcaagactctatctcaaaaaaaaaaaaaaaaaaaaactgatttactgagcatgtagtatacctggggcaggttcttgggaactctactcccagcagctccaagggaaggctgtcagtatacccattttacagatagagaagctgaggccctgagagggaccggccccaaggtcacccagtgattcagggaattccaaatcaggatttgggcccatctccgtgttgggggtgagaggagttggcctggctaacgctgccctatccctgtctccctaggtcggcgtcctcagctggccgagcatggtggcagcctgcacccttggctcccttgtctggtgcagccagcagagccgccagccttgggcgcccatggccctccgtgtgagggcgtgagcggcctgccccagcctcacctgctgatggaggactcaatggcccagtgacctgacaccacaccaccaactccctcccaccagctgacgaatggtggacccagtgacgagtggcccttgtaagggtcatggaataatttgaagcgaggcatgagcggcccctgtggtcgcctgtgactgctggagatagaggtcccagcaccccaagccaacccagcggaccctcccagccctgcttcaaccaatggggccagtggggctccaagcagccacctaaccatccagaccccaccccactcacgcggccatggcgggccctgagggcttccagtaccgcgctctgtacccgttccgccgggagcggccggaggacctggagctgctgcccggcgacgtgctggtagtgagccgggcggccttgcaggcgctgggcgtggccgagggtggcgagcgctgcccacagagcgtgggctggatgcccggcctcaacgagcgcacacggcagcgaggtgacttccctggcacctatgtggagttcctggggcccgtggccctggcccggcccggccctcgcccacggggcccccgcccactgcccgccaggccccgtgatggggcccctgagccaggtgagcagcaagcaggggccctggaaaggggggtggtcccctcagacccttggtctcctcttctgtccagtgaggcaatgggatctccaaggaaggaggaaaaaggacatttggtcatttgacaagtgtcttcagtgctaggctcagcagtggacacaaggcctgttcctgccctcatgagcttctggttcaagaagggatgagagtgggttcaggaggtgacacatgccatgaggaagggggcttgcgtgggaagatgcgagggtggaagctcaaggcagtgggggcagcgagggcagaggctgtggagtagaactctaatggcgggaacggccagcaggaggaccagagggaggaaggggagggcaatgtgcgctggcatggaggacttagtgggattgattttgaggacaatggagagtgttcagtaggattcagaggctcagcctagcttcatcctgccttttgcagacagggtcccttgaagaacccctttggagaccctgatttccaaaatgaagccacaaggagggtgggatgtgggctgctcagctgaggccacacagcacagtgggatatgaggaccccacatccctcttcaaagacccttggccatcaccacttgccaggggtgtgccaggtgtagagaatcgggggcaccgagcccactcagtgactgctgtttgatgggcagggagtgtgggctctggccggggaaactgtggcccaggttgcaaggaggaggctaagaggtgctgcatgctcggcatggtctgctccgaccctcccagcagcccagcaaaaggccctgtgtgcagaccgggaggcctgagtgcaaggccgtcaaatgccgtacttgaaaccagttggtcacccagggaggccaaagccccgggaggtgccaggcctgctttgtgccagggtgacattgcccaaaggcaaaccagagtcccccagcgcagggcggaatagggggtgctgaggtggtgcgacgctggccccagcctccaggcatctggtatctccagggcccaggcctgcgtcctgcctcggcctgaaggagcaggaggtggccccgtctgggctcccagccagaatctgcctctccccctggtaacagccacctccctcctctgcctggcctctgtccagccaccatacacggccccacgtggggcggctgcccagccccaccctctgaatcttccagggttatgtgacctcggccagaacccgccccctcgaggcctcagtttcctcatctggaaacaacagggttggtccctggggatgctgggacccaacccctcggaaatgtgctgaagtcacctgagccccacctggctgtgcacccacgggggaggttgcagcccctctgacccacaattcctcacctgcaaagtcggggtgatgcagttctgatgggaaccccctccccattctgcagattgatcccaggccactctcagggttgagtttcccaacccaccggccagagtgtcacccacctccacctcctccttgtccttttccttttttttttttttttttggcgttttcgttgcagctgggcctttctccagcttgaggcgccacctggcccatcactcagggaggccccgcaggccccggcttgcccctgctgtgtgccagggcgtccccgccgagggccagagcagcgtccaatggtggcagacagcgagctgctgaggcggggatgctgcacacaaaaggccctgtagtgctgggaagccagggctgggagggggctgggcccaggatgccgccggcacccgctaggaggggtttcagcttttccaaaaggggagcaataattttctttcttttctaaattttaatttggggaagaaataattttttagaagcaaaatgattaagaaaacgggtcatggtccttggaaggaagctgttctgacccaggccgggatatttttcttttctttcctttcaaccacttttttgtttgcatcaagaagggagaagcgggccgggcacagtggttcatgcctgtaatcccagcactttgggaggccaaggcgggtggatcacttgaggtcaggagttcaagaccagcctggccaacagggtaaaaccccatctctactaaaataatacaaaaattagccaggcatggtggcacccacctataattccagctacttaggaggctaagtcacgagaatcgcttgaacccaggagatggaggttgcagtgatccaagatcatgccactgcacaccagcctgggtgacagagcaagactccatctcaaaaaaaaaacaacaacaacaacaaaaaaaaaaaacgaggaggccaaggcaagtggatcgttaggggccaggagtttgaggctgcagtgagctaggattgcgccactgcactccaacctgggtgacaaagcaagaacctgtctcaaaaaaaatgagaggcaatgtcattggcccatttttcatttgaaggaactgaggcccagagagggcaggtcctgtggccaagattgcacagcaggttgtggcagagcccaaacctgctatatgactttcagtggctgccgcaaaaattaccaccaactaggtggcttcaaacaatggaaatgttatttattaattaatgtatctttttgttttgttttgttttgttttgagatggagtttcgctcttgtcgcccaggctggagtgcaatggcgcaatcttggctcctgcaacctctgcctctcgggttcaagcgattctcctgcctcagcctcccgagtagctgggattacaggcacgtgccaccacgcctggctaatttttgtatttctagtagagacagggttttaccatgttggtcaggctggtctcaaactcctgaccacaagtgatatgctcacctcggcctcccaaagtgctgggattataggagtgagccactgcgcctggcctcctttttttttttttttttttaaattatttaagagatggggtctcactctgttgcccaggctggtcttgaactcctggactcaaaggatcctcctgccttggcctcccaaagtgttgagattacagacgtgagcctttgcaccccaccacaacagaaacttattctgtcatgtttctggaggctggaagtccaaaatcagggtcgtgccccctctgaagtttccttccttgcagcttctggtgcctccaggcattcattcctctcatgcatgggttgattattccagtctctgccttggctttctcttcttttttttgagacagagtctcactctgtcacccagactggagtgctatggcatgatctcagctcactgcaacctccgcctcctgggttcaagcaattcctgcctcagcctcctgagtagttgggattacaggtgcgcaccaccacacctggctcattttttttttgtatttttagtagagatggggtttcaccatgttggccaggctggtcttgaactcttaacctcaaatgacctgctggtctcagcctcccaaagtactaggattacaggcatgagccaccgcacccggcctgttgatttatttttgaaacggagtcttgctctgtcgcccaggctggagtgcagtggtgcaatcttggctcactgcaacctccgcctcccgggttcaagcgattctcctgcctcaacctcccgagtagctgggattacaggcacccaccaccacgcccagctaatttttctgattttagtagagacaggttcgccatgttggtcaggctggttcgaattcctggcctcaggtgatccacccacctcggtctcccaaagtgctgggattccaggcttgagccgccatcctggccggctttctcttgttacaaggacatcagccagtgggtttagtgtccaccctaatgccaggctggtctcatgtacagattcttgctttccttacacctgcaaagacctatttccaaataaggtcacaggtaccagggatgaggacttggacatatctttttggggactttattcagcgcactccacctagtctgtgaagttgtgtgaactcctcatattctaacccagaaaattgtgtcccatcaattctgccctttcccagcccctccacccaaggtcttgcagcctcctgcggatgggagtcaaggtgccaagcacttgcctgagctgggccctgcctcaaactgccccagctgaggttcagccagcaaagagaggggctgggctccttccaggaaccccaccaacatgcaacccccctgtttcccccaccaggcctcacactccccgacttgcccgagcagttctccccacctgatgtggctccccctcttctggtgaagcttgtggaggccattgaaaggacaggtaagttccagcctggctgcagcccctggattctgcttgcttacctctagtgacaggcgactcatcctctcacagggcctccaagctcatgctgcacggaaacaggctgagcctggatgccctgggcctctatgttgaatagggcacagagtgactcctaagggaagatgggaaggtgaacatgaccaggccactgcatgtgctgtgccctctcccagttctccctccccacccctcccatgcccttatctctgggcagcaaagggagactgcaggggggttgagcggccagtccaggcctcacgaggtcggggcagcatttgagagctgactcgcctgtccccttcacccccagggctggacagcgaatctcactaccgcccggagctgcccgcaccgcgtacaggtgaaggggagcctcaatggggttgggaggaggctgggggccccagtacacatgagttggacgtgtgcccccctgcacccgcagactggtccctgagcgacgtggatcagtgggacacggcagccctggctgacggcattaagagcttcctgctggcactgcccgcgccgctcgtgacccccgaggcctcggccgaggcgcgccgggccctgcggggtgagcctggcgggtagcccgggggaaggagggggctgtagcgggtgggagggcccaggcctggctcaccctgccctggccatctgtccgcagaggccgcggggcccgtggggccggcgctggagccaccgacgctgccgctgcaccgcgcgctcacgctgcgcttcctgctccagcacctgggccgcgtggccagccgcgccccggccctgggtcccgcggtccgggccctgggcgccacctttgggccgctgctgctgcgcgcgccgccgccgccgtcctcgccgccgccagggggcgctcccgacgggtgaggggcggggcggagccggagcgagcaggggtggagtttggggtggggcgggcggggcatggccagagtgagcggcgtctagaccctaagaagggaggggatggggtccagagtgagaagctgcgttcttgtgatgacggagcggagacctgggctcctgagtcgtgggacagaaggtgaaggggcctagtcccgaagcatgtgggtggtgcctgcaccttcccttctgctcgtcgcagctccggtactggtctctcgctcgcctttgtgtgagaatctatggagcacttactgcatacagctatgagggagctggcctcgcacatgtgcctgtatcatctcctcctccgccctgcacatactgtctcgtatatacccccaggcgtgcaagcgcacgcacaatcctgtgcacatgcgtgggcggacaggccctacccagccctcaccacactccccttccccctaaggagtgagcccagccctgacttcccggcgctgctggtggagaagctgcttcaggaacacttggaagagcaggaggttgcgcccccaggtgagtcccctgtattgctgtcatttcttcccgttgggggccgtaaatactgatccctgagtgctgccggcatcagcaggctggttgcagtgggaggcagccacagtatacagtcggtgctcaggatgcatttgttttcctgtcccccagcgctgccgcctaaaccccccaaggcaaagccggcccccacagtcctggccaatggagggagcccaccctccctgcaggatgctgagtggtactggggggacatttcaaggtaggttgctggcagggggccagggaccaaggaggtgtcacagggtgagcggggtctccaggtggctcggcagtcccaatgttggatgttcccacagggaggaggtgaacgagaaactccgggacactcccgatggcaccttcctagtccgagatgcttctagcaagatccagggcgagtacacgctgaccctcaggtgggggcctgtccctgcaaggataaccgggggtcacaggtcacagagaccgggagttcagaggggatagaacatgtgcggtttcaagaatggggggccaggcacggtggcttacacctgtaatcccagcactttgggaggctgaggctggcagaacacctgaggtcaggagtttaaaaccagcctggccaacatggtgaaaccccgtctctactaaaaaataaaaaaaaaaaattagccaggcatggtgatggatgcctgtaatcccaactactcgggaggctgaggcaggagaattgcttgaacccgggaggtggaggttgcagtgagccgaaatcgcaccactgcactgcagcctggacaacagagcagcaagactctgtctcaaaaaaaaaggggacagggattgagggtcaggtgcggggtcccactgggtgccgacacccctctcctcccccaggaaaggcgggaacaataagctgatcaaggtcttccaccgagatgggcactatggcttctcagagccactcaccttctgctccgttgtggacctcatcaatcactaccgccacgagtctctggcccagtacaatgccaagctggacacacggctcctctaccctgtgtccaaataccagcaggtccgtgctggcctgggagccagggagggtagcacctggctggccccaggcctcagtttcctaggtagacccgaccaggctatgcatctcccctcattccgccacgtatctccaggaccagattgtcaaggaggacagcgtggaggcagtgggcgcccagcttaaggtctatcaccagcagtaccaggacaagagccgcgagtatgaccagctttatgaagagtacacacggacctcccaggtactccaggccccgtacatgagggaaaccgagacatagaggggcagtggcaaggccgggagcaggatgaccaaccccagaggacttgaggatgaatatccagttgcaggtcacagagcaggcacttagcaccaagggctgttctaaaaacatagaaataaggccaggcacagtggctcccgtctgtgtacttgggaggcagagacaggaggatcacttgagcccaacagttcaagatccttctaggcaacatagggagacccgtctacaaaaaaatttaaaaattaactgggtgtcgtggtgcatgcttctactcccagctactcaggaggctgaggtgggaggatcccttgagcctgggagtttgaggctgcattgaattgtgatcatgctgctgcactccagcctgggtgacagggcacgaccttgtctctaaaaacaaataaaaacagaaataagcgtacgaggctgggtggggtggctcacgcctgtaatcccagcactttgggaggccgagatgggtggatcacctgaggtcaggagttcgagaccaacttggccaacatgttgaaaccctgtctctactaaaaatacaaaaattagctgggcatggtggcggacgcctgtaatcccagctactcagaggctgaggcaggagaatcgcttgagcctgggaggcagagattgcaatgagccaagatcgtgctactacactccagcctgggtgacaagagtaaaactccatctaaaaaaataataataattaaaataaaaaaataagtgtacaagcttttacaaaaccaaaaaaggacagatgagaagggcccaaccagcctcacaggagtggctgagccaggacctggggagtgtccaggatgagcctatctccggctggccctcagttttcccatctgcagaatggaaccaggcaccttgattacttatgtccccttcaaccaagatgttattcaaaatgaaatcatgccaggtgcagggcgcgcacctctaatcccagctactcggaaggctgaggcgggaggatcgcttgagcccaggagttcaagactagcctgggtaacatagcaagactttgtctcttaaaaaaataaaataaaaattaagtgaaaggttttgtcactcaaggactgtgctaataagcttcttttgcaagttaagagggaatagattcaggtggaacagctgggaattcctcagtcgtccctagtaccctaagggttttctgtcctcttttttttgttttgtttttttttttttgagacagtgtcttgctctgtcatccaggctagagtgctgtggcatgatctcagctcactgcaacctccgcctccctggttcaagcgattctcctgcctcagcctcccaagtaactgggactacaggcacgtgccaccatgcctggctaatttttgtatttttagtagagatggggttttgctgtgttggccaggctggtctcgaactcctggcctcaagtgatctggctgcctcggcctcccaaagttaaaaaaaaaaaaagaaaaaaaaaatttaataaaattaaaaggtaggccgggcacagtgactcatgccagtaatcccagcactttgggaggccgaggcaggcagatcatctgaggtcaggagtttgagaccagcctggccaacatggtgaaaccccatctctaccaaaaagataaaaaaattagccgagccaggcacaatggctcaagcctgtaatcccagcactttgggaggctgaggcaggtggatcacgaggtaaggagttcaagaccagtctggccaacatggtgaatccctgtctctactaaaaatacaaaaaattaggcgtcatggcatgcacctgtaatcgcagctactcaagaggctgaggcaggagaatagcttgaacctgagaggtggaggttgcagtgagccgagatcacaccattgcactccatcctgggacagagtgagactccgtctcaaaaaaaaaaaaaaaaaaaaaattagccgggcatggtggctcacacctgtaataccagctacttggaaggctgaggcaggagaatcacttgaacccaagaggcagaggttgcagtgagccaagatcacgccactgctccagcctgggcgacaagagcaagactccatctcaaacaaaaaaaattttgaggtgctgtctcaccatgttgcccaggctggcctcagactcctcagggttcaagagatcctcccactttagcctccctactagctgggattacaggcattcgccaccacccctggcctctgtcccctttttactgatgtgttagctgaggctctaaatggacaagacagttgtccaggatcagttaggagcactgtaacctcagaattgactttggccctgagcctcagtttctctgttaatagttgttactttgttaggggttgttggaagggtccatgggacaaagtaaggaaagtcgtagtgcggcatctcccccaagaagccctgtgagctgtagcaactagatctgtcattcattcttagcagtgttaacaggtccaggtgtttgtggatacctataggaggatgtaaagaagaagagggtttggggggtggggttttgaaggctgaataggagttcatttggtgcagcaggcgttagaagaatgacactctgatagagggaccagcttgagcagtctccgtatcagagttgagatgtgcctttacccctcacgagggccttttggggagtcccaggaggtgctgagctgcgccccctcctccaggagctgcagatgaagcgtactgcaattgaggccttcaatgagactatcaagatctttgaagagcagggccagactcaagagaaatgcagcaaggaatacctggagcgcttccggcgtgagggcaacgagaaagagatgcaaaggtgagtctggcgcctctgccctgccccaccccaccctgatctggtgcagtacaagccagggagggaaggaagcagaaggaggccagccacttggaggcaaagagtagtctgttgaaatggactttgggcctggtgcgatggctcaggcctgtaatcccagcactttaggaggccgaggcgggtggatctcctgaggccaggagtttgaaaccagcctggccaacatggtgaaaccctgtctctattaaaaatacaaaaattagctaggcatgatggtgcgcacctgtagtcccagctacttgggaggctgaggcaggagaatcgcttgaacctggagttggaggttgcagtgagccgagattgcaccactgcactccagcttgggtgacagagaaagactgtctcaaaaaaaaaaaaaaaaaagaaatgggctttgaaggatgaataggagtttgctagaaagagaaatcagaggaaacagcatatgcacaggctcagaggctggaagcacatagtctggtgcaaagtaggtccttgagaaaaccctggaggccgggtgcagtggctcattcctgcaaccccaacactgtgggaggctgaggcaggaggattgcttgatcccaggagtttgagaccagcctgggcaacatggcaaaatctacctctacaaaaaatattaaaatgttagccagacatggtggtgcacacctgtggtcccagctactcgggaggctgaggtaggagggtcacctgagcccaggagtttgagggtgcagtgagccgagataaaaccctgaggtctctgcgccaccccacccctcccacaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtaagtggcggctccatacttccctgcggctccctggcgactgctgcggcacatggagatctctctaggagtctcagtctctctctctccaccaagtggcccttcctgggccccgagaccccttaaactcggttcctcccgggccccttgaaagttttcccataggtcagcctcagcttagtcagaggtgtgtgcaatgggagtgtcactcctatcccattccattttgtggaaagttggaagccttccacaaaaattcctgctgggctgggcgcaatggctcacacctgtaatcccagcactttgggaggctgaggcgggcagatggatcacttgaggccaggagttcaagaccagcctggccaacatggtgaaaccccgtctctactaaaaataaaaaatacaaaacccggccaggcatggtggtgggcgcctgtaatcccagttactcaagaggctgaggcaggagaatcacttgaacggggaggtggagtttgcagtgagcagagattatgccaatgcagttcagcctgggcaacagagcaacactctgcctcaaaaaagaaaagaaaaaaaaaatcgcccgctgtgcaacctaccatgctgggtggctgcggcagccctgtcctgggttcaaatcagttcaaatcctgcccccacccaccaacctcctgaagacctcagccagagcctccacctccctcttgggcctcagggagggcactgtcgcgtgccaggtgctgtgctaagcaccgtgctcgttatgagttcatttggtccttttcaagccctttgtaaagtttgccctttacagctggggagactgaggcacagaaccgacagctgccctgtgcaaaggccagcagtgctggagtgagcctctggtgatgatgaggggcctgggctggcatcttcttgggggactccataggcgttaacagaaacaaaaaaatgaggggtgtgggtcagggttccccagcagagctgggcgagcca

SEQ ID NO: 14790 - DNA, 8297 bp, Human
cactgtccttgtctgttttgtacagccacctctcaaggcccaacaaggctgaacctggggcaagtgcagaaagaaacctccactctgacccagtctactgctgggaccttgggacaggacctgcctcccttagcctcagagccccctagccttgccaggcactgtccctgccatgtgtcctgtctggagataacccataaataactccagcccagattgtgcctctcactgcataggtgctcacaggagaaaggttgccatctttatgatcccagctatgctgagctgggggtggaagagaatatcccgtgtggtctctaaaaacactcaaccactggctgtgtgtccttggcaaaatagccttccctctctgatcagccatttatttgttaccagctggagtcagtagcacctacccccagccccaactggatgcttctgagggttcaatgataaaatgggttgtaggcccactctatgcctggcaccaagccagagagcaatacattgtagggttacatttatgatttcttccaatagggctggtgcctggtaactactggaaaaattgtagcaattatatttatggttatttcttcaatcccacccggcatagggtaagcaccaaagttggggtggtgagtcttggggagcctttgccaacggtttggtcgtctgagggatgggctcggggaccatccagccactgggacttcagagaagctccggctcccaaaccagctactgtgtgtgtggccagggtcttccccacaactagaggggggcacagctggggactcaggtatatcttccagctgggtgtgggacattttcttccctaggatccgatgtgtcttgccctgaatgtaaggcctggcagggttggaatgtctcagttattcccccaacactccagcctccatctgggccttttttccaggctattctctctgccttcactgttggggccactgtcctgtgtaggcaccaaggcctgaccatgccatccagaagccccagcctgggacaactctcccccacctgcctctgagccctccatggtgactcttgttccccaaaccttatccttctccccattacacagaagggaaagctgaggctctgtcactcaaatccaaagccaggtggactccaagccaccccacccctatcccagacagcacaggctgcctctctcccccatgggcgtcccttgaaggccaggttgccccccaccccccacaagccttgaacgatgaaaagaaggaaggccagttctcttcaccccaagccagaagtggggctgggtgggtaccctagagaaatgacacgccactccctgcgccagcttctgctttccggcgtggctgtggtcaagcctgagtcagtcccacgggaccacggtgaggggtctggagcgtcggggtcaggagtttgaggggggaagggttgaggggcaggatgtgggggttgggtgtgagggaggtcacgggcgagactggagggaggagacctggccacacaggccttgcccactctcgggggcctgaatatttcagttactcccccaaaaccccggcctccatcccatccccagcctccatccgacgtcacccctgttaggtcacaggcccactctgagagtgggtctcgggcctcaagtcccctagccgcccctagaaggtctaggggtgcgtggagacaccaccattcctctcagcctgtgtctgtctcaaaggccccacctcacctcccctaaaggtagtcttgcgccagggctcacgtgcctgggcagggctgattgccaaggggcccaatggcctcgtgactggggacccagcacctggcaggggtgggggtgggacactcagaggaaggagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaaggtagggacggcgacagggcgggcaggctggagggaacaggcgccctgtcggggcacgcggctccttctttctccccagacttcacaggggaagaccagggccccgaggggacgctgtccctgccgggttcctggaaaaaccctgttcagttcccggcgctgcggccacactccctccgtgccgtttcgctttcgcatcccgcatctgagaggcgcagctgcctccacccgcctagtcccgcccaagggttcaatgagcgcctactgtgtacttttggggcaggagctggggtctccttttgtggcccagggcacaagttcagcagctggccaagggccgccggcatgcattcttgctgctacccttgatgcattcattccagccagggcagggctcgcgtgtctttgggacctattaggcagatgccctagaggctgagcgacttgctcaccgctccagcgacatgggccacccgccacccctcagctgaagccggaagtcagcacctattaggtgccgcctctattcagtcggacttggaaagggttcacgtggatcccttgctcagctcagaggcaaggtctccaggtgaagtgacaagaaatgagcatgggccaaggccggaggcggtggctcatgcctgtaatcccaacactttggaagtctgaggcaggcagatcacgaggtcaggagttcgagaccattctggcctacatggagaaaccctgtctctactaaaaatacaaaaattagctgggtgtggtggcatgtgcctataatcccagctactcaggaggctgaggcaggacaattgcttgaaccagggagtcgggtgttgcagtgagccgagatcgtgccgcagcacaccagcctagcgacagtgagactccatctcaaaaaaaaaaaaaaaagtctcaaagtcaagattccacctggcaagttctggaaggcgtgcaagatgaattgcgtatcacagccccctttctacaagactaccaagtggggttgagagaagtggggaactgcccagggctacacctgcctcccacgccttcctaatccacagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggtgtgtgggcgctggggaaactgaggcacgtgggcaggggagcaggggacccagcctaccagcaggctctcaccctgctgccttgcaggaacaaaatgtcagtggcaggtgggagttcaagtgccagcatggagaagaggagtgcaaattcaacaaggtggaggtgagcggccccagggccccacactggggtgggggaaaactgtcccacgtacaggaggcaaatacgaggatgccagctctgtcttctgcctcgtgtgctcccatttaatcacatctttattccctatctcctgggtgggtactggtgattattacgagagggtgtcagggtaccctaggccctcttcatgccctctcctgccccctctccaaaccccaggcctgcgtgttggatgaacttgacatggagctagccttcctgaccattgtctgcatggaagagtttgaggacatggagagaagtctgccactagtgagtgacgcccctcactccacccaaggagggggacatgggtggtaaccttccctgcatccaggcagacccaaattcaagtcctagccctgaccactgctgtctgtgcagcccaggaaaacaactacccttctttattttatttatttttttattttttcttgagacagagtctcgctctgtcgcccaggctggaatgcagtggcgcaatcccagctcactgcaacctccacctccagggttcaagtgattctccagcctcagcctcctgagtagctgggattacagttgtgtgccaccatgcccagctaatttttgtgtttttagtagagacagggtttcaccatgttggtcaggcttgtcttgaactcctgaccttgtgatccgcctgccttggcctcccaaagtgctgggattacaggcgtgagccaccgcacccagccctttttttttttttttttttttttttttttttgagacagggttttgctctgtcgcccaggctggagtgcagtggtgcaatcttggctgactgcaaccactgtctcctcagtttaagtgatcctcctgcctcagcttccccagtagctgggactacaggtgtgcaccaccatgcccggctaatttttgtatttttagtagagacagtgttcaccatgttggccaggctggtctcaaactcctgacctcaagttatccgcctgtcccagcctcccaaaggattacaggtgtaagccaccacgcccggccccagcctcccctcttgaagcctccatctctgaatcaggggaatgaatgcaggtctcttaggagcatgagtgatcacagaggacttactggaggaggcatttctgagctgggcatggaaggatgagcaggaatgtgcagagacacagatgatgggatgtggagatgataggacagaccccacctacttccccgggggattgtgaagaatgactcccagagaagtgactcattggctccaatcatttattcattcatcaaacatccgggtcacccaagaggcctcacctagtgacaccctagtcctgcagggttagatcagggctgagagagtggcaaggagagggcactgaggagacactgtggaaggaggatgaagggtgttcctggcagagggatcagcctgtgtggaggtcctgagtaaagtgagatactatgggggtcagaggcagtgggtctggtcttagggatgaaaccaagggagctaggaggcaggagcagcccaagccctgccttaggggcctccactcaagcatgtattgagcacctgctgtttgtgggctttgtcgcatcactgtgaagccaactgtaccctcttctcagtgacgaaacaggcttggctcagggctggtgggcgggaccgttgagataacggggaggaagctgaggcaaccccctgctccccacccacccagtgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatggggtaagaatctttttagccctcagcttgacactcatagtcccatggagtcagggatggacaagacagagggaccagagataaaggaacccaggcggaggttgcagtgagctgagatcatgccactgcactccagcctgggcaacaagagcaaaacttgatagctttgcatagggaaagagggcattgatgctggggttttgaaaggtgagtaggagtccatcaggcaaaaaaagtatgtattaattcgaagtattaaacatccctagccacccccattgggaaagatgtgccactgatttgcgaggcgggaggcgggggccagacttgggaatatgtgcagccctttctgggctggaaccagggtgcatgggttggggtagctgctgggaatatgcgacccctgtcttgctttgtgcagaaacccttggaagatcagacccagctccttacccttgtctgccagttgtaccaggtaagctgggaggggagcagtgggattcaggtggtgggggtagggtctccttccaggaccccaactcatggccttcacctccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagcccttctggatggtgtaattaatttgataagtcagccattcccccttccccaggcctggcaaaacccgctctctactaaaaatacaaaaattagccaggcgcggtggcgggcgcctgtaatcccagctacttgggaggctgaggcaggagaattgcttgaacccggcaggcagaggttgcagtgagccgaaatcgcgccactgtgctccagcctgggcgacaagagcaaaattccatctcaaaattttaaaaaagtgactggttgtggccgggtgaggtggctcacgtctataattcctgcactttgggaggtcaaggtaggaggattgcttgaggacaggagtttgacaccagctttggcatgaaagcaagaccctgtctttacaaaacatgaaaataaaaagaattagcaggacatggcagcgagcaactgtggtactcgggaggctgaggcaggaggatcacttgagcacaggaggtcaaggctgcagtgagccataattacaccactgcactgcagcctgggccagagagcaagactctgcctcttttttttttttttttttttttttttttgagacggagtttcgctcttgttgcccaggctgaagggaaacgcgtgatctcggttcaccacaacctctgcctcttcagttcaagcgattctcctgcctcagcctcctgagtagctgggattacagacacatgccaccacgcccagctaattttgtgtttttagtagagacagggttcttccatgttggtcaggctagtctcgaactcctgacctcatgatccatctgtctcggcctcccaaagtgctgggattacaggcgaaagccaccacacccagccaagactctgccttttaaaagaaaaagaagggaaagaacatgttcagtgttgtattttttcctactgatggactggtcaaatcatagatgtatatattcttccttcgaggaagtgaggcttaattccactccctacaaatatctttgtttctctttattttgagatggagtctagctgtgttgcccaggctggtctcaaactcgtgggctcaagcgatccttcttgaggatcctgaagtgctgcgattatagacgtgagccagcgtgccgggccctacaaccaccttgacagtgaactagattgagtaacttgattccaaagagtagaacaggaaaagtgaaaaagaataccccggctgtgcgcggtggctcaaacctgtaatcacagcactttgggaggctgaggtgggtggatcacttgaggtcaggagttcaagaccagcctggccaacatggcgaaaccctgtctctactaaaaatacaaaaattaggctggatgcggtgtctcacacctgtaatcccagcactttgggaggcccaggcaggcagatcacctaaggtcagaagtttgagaccagcctggcaaacatggcaaaaccctgtctctactaaaaaatacaaaagttggtcaggcgcggtggctcacgcctgtaatctcagcactttgggaggccgaggcgggtggatcacaaggtcaggagatcaagtccatcctggctaacacggtgaaaccccgtctctactaaaaatacaaaaaactagctgggcgtggtggcaggcacctgtagtcccagctactcgggaggctgaggcaggaaaatggcgtgaacctgggaggcggagcttgcagtgagccaagatcatgccactgtactccagcctgggcgacagagcaagactctgtctcaaaaaaaaaaatttaaaaaatacaaaagttagccaggcgtggtggtgcacgcctgtaatcccagctactccagaggctgagatgggagaatggcttgaacccgggaggcaggggttgcagtgagccgagatcacgccactgctctccagcctgggcaacagagagagaccccatctcaaaataaataaataaataaatacaaatcatcaagtagcaaaggtggcatgttttgaggt

SEQ ID NO: 14791 - DNA, 4531 bp, Human
tgaaattagttcacattctgactttcttgggtctgttatatgagactaagaacatatcaggcgataagacagaagaaggctggctgatcattaaaacttttattttctttccccagtttgcccgttcaccatatggaatgtattatgctacactggatcaagagtttatttatggagaaaaagaagatgctccaagagatggccttgattaacagttaagaaagcaggacacagagctagaatggggagaaaaaaagtcgaacacagactgacaagtaaaggattaaaagatcagaggctatagatatagatctatacagttttggaataatggggtctctagattaataagcactttgaacaaaacatttgattctgtttagatgaaaaataaaagaaactctttattccctttggacaaggagtaaaagttgtaatgacagtatagggcagggaaattaagcaggattatgttttgggatttccctaagagacaaagatagcactgaaatggctgcttgaggtgccattctcttacttatatataaaatcacaaaagcacctgaagaattaaagaatcaagattgctattcaatcactgaaaaacggaactcaatttatgaagcacagaatatctctgaaagagtatgatgcaaacagttttttcagagtctgtttataactaaaagcacttacgctaattttattctgtattctatttgtagctctaatcaagtatgacatttcatagtggagcccaaacaataactactttcctgtgactgacacacagttaaaataaaaacctctttggctctacacaatggaacagagaaacaaacagaaaacctgctggctttatatgtagaaacaatctatacactaaagaatgactaaatacatgatcagtttttttaaaaatgagaaaataacttatcaatttagaacataaaacatggataaaatagcaaattactagattctttactaaggaatattttaataaaaggaattttatctaatttgtactctgagcaaataaaatatgtaattaacatgaaatcaaaatacacatggtactagcatttttttgttttttcattgagtagttggagaggggtgagccttagagcacaaaggtaccttactttgaaaaaattacctagtaagctgggcacagtggctcacacgtgtaatcccagcactttgggaggccaaggcgggtggatcacctgaggtcaggagtttgagaccagcctgggcaacatggcaaaaccccgtctctactaaaagtacaaattaagatgggcgtggtgacaagggcctgtaatcccagctactcaggaggctgaggcaggagaatcgcttgaacccaggacgcagaggttgcagtgagctgagatcatgccactacattccagcttgggcgacagagcgtgacttcatctcaaaaaaaggaagaaaaaactacctaataagaaagtttaagtctgtaagggtacccttcataacccatttgcattctggttgcttccttttttgaaagaagggcagagctacctctctagtatgcagaggtgtgcagcctaaatgagaaggtattcaagaccctactagtgtctgacataataaatgtcaacttcattgacgcagttcttggtataaccaaaaaagcttgagatggccatgattatgtatgactagctcttctttaacatttttcttaacattatttctcctaacattatttcaaacagctacaaagatttaaccaaagggaggagaaaaaaaaactaccaattttaccctattatttaaagcaggtagttcaaataagtagcttctctcatagacagaaattaatgttggccgggcgcggtggctgacgcctgtaatcccagcacttcgggaggccgaggcgggcggatcacgaggtcaagagattgagaccattctagccaacatggtgaaatctcgtctctactaaaaatacaaaaattgctcctccacaggaggcctacacgccgccgcttgtgctgccgccatgtcgctagtgatccctgaaaagttccagcatattttgcgagtactcaacaccaacatcgatgggcagcggaaaatagcctttgccatcactgccattaagggtgtgggccgaagatatgctcatgtggtgttgaggaaagcagacactgacctcaccaagagggcgggagaactcactgatgatgaggtggaacgtgtgatcaccattatgcagaatccacgccagtacaagatcccagactggttcttgaacagacagaaggatgtaaaggatggaaaatatagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctatgaaaaaaataaaaaataaaaaaaataaaaaataaaaatacaaaaattagctgggcgtggtggcccgcgcctgtagtcccagctacttgggaggctgaggcaggaaaatcacttgaatcggggagacggagtttgcagtgcgcccaggtcacgccactgcattccagcctggcgacagagctccatctcaaaaaaaaaaaaaaggaaactattcataaaaaaaaaaaacttatacttccaacttagtagactgctcgacaggaattaaaattcagaatattctctagttaagcccctaagacaaacttgacagtgttttcaaaaaagtgactatctgccacaaaattaccaattttgcaatatccatggtatgacatattttaactatgattcctatgcacaatttcattaaaaatatctgacattcaaaaatggcttaaacttaacagcactactttcttgtaacggcaaggagacaaattatgtagaagttaagggatatttacttactctaagttaccaagaaaaagaccataataatttttctgataccaattagcaaagtaattctctactacttctccccacatgctaaaatggaaacatcaatattcatactatagaactaataaccctcaactgaaagaatggcaggtaaattatacagtggatttataatgacactcaaggtacattttgacagcacattaaacacgtctgctaccctcggtcaagacagttaacgagatggccttaaaatcaacacatgattctttaggcttttcctcaaactacgtctaaaattttttgcttttcctcaaactacttttaaacttttatgtaattttatcccacaatttccaatacaatttttttgggaaaaaaaattccctagtgagaaagtagtagatggtttaaatttaaattgttctttcataaggtattttactagttataaaaaaaaaaaaagacagggggtggggagggaagagagagatggagttccagcttaactaacagaattgtacgtgttttttaaaaaggaaatcctgggtccaaagtaattaacattacacttaatcttttcaataatttttgttcccaaggcaattaacatgaaacattatgttagtaggtctactagtggccttcatatgctattaatcgtttctattttctcatattaaataatttcgggaatgataactaaggtggtcagaatagagaataatgtttaaaatgttctaaaaacattttaaacagctcgcacgtgttaagtcacttgtcttgttatgtgcaaagagggagctggagagattacgtttcttttccttcacgcacaagacccgaatttagggagtggaatggacagaataaggatagctgtaacctgagtttaacgtcgtaacaaaatacaggaagagtcacgctagactatttagtcgcctaagtatctggcaagcggtcagctggcaacagcctaagggagatacttcaaagaaaagcaaccaaaccttagccctagaccccgcagcttaaaccagagggcaggcaaaggcattcctcttcccctccatcacctcggcccatcctgtcacagggtcaatattaaacttggaagtaaaggaaagagagcaggccggagttgtccacctcctcagtgaaaagggagcagcaagcgtaattaactcctgcgtgtaactgagaggccggcaccgtcagaaactcagcctgcggccagttcccgcggcaactactcggtggctcgcactgtgtgtatgttatgtctcatgagcgtctccggtgtgtgtgttttgtgtgatgtgcgtctccggtgtggcggtagcggctcctgcaccgccgctcctggtcccaccccgagttcggtctccctttctggcgcccatctcccttctcctcggaatcagggcctccgctggggccaggaggtgacgaacagtggccggctctccccaggcaaggaggc

SEQ ID NO: 14792 - DNA, 16374 bp, Human
tgagggatccacccctattacccaaactcctcctactaggcaccacctcctaacactgcctcattgaggctcaaatttcaataccattttgggcaggggcagaccacatgcaaatcacagcatggggtaatagtgggggcaggttgacacagggctgctgcctacccagcaccagctgtctcttggccccttccagatcctggcaatctggctacaggcatgggcccagccttggacacagatgtggccacaggaagctgttagctctccagatctgatcagcctgggagagcggcacaacaaaggctcccaaaggagagtcgggatcctcagctagcctcagctctgctacccacccatatgtgcccagaacaggaaagatacgtgtttcttactcctccgggactcctaggtgaagctgagaccaggctcttcttgagtcctctcagctatggtgcaaccaccagcctagcaaggaatcagaaacatcttccggaagagtcagcaccatagagggtgctgaatgggcaatgaagcatcccggagatgaaacatctgggcagtgaggcatcccacaggtgttgggctatgcagtcactccctttctcagaccgaggcaagtacataagcactctgggcccctaatcaggggcctggggccaggtgggatgaaaacagcagtgtcctgccacctgaacaactgctactcacgcaggccccacctggcctctcagagggaggaacctgggactcctgaaccagattcaatttctccttcaacagccgggacttttcgctcctgactgcagaaaaacagcttcaatgtgaccatccttgatagtccgaggctgagtaaaatggcctgaggaggcaaaatctgaaaagctctattaggtggcaaactgctgtcactagaagagttgaggcccccttctcctcccctgcctgaccgccttcattcctgggaatggaacaggttcttggggcaagggtgaatcctcgagcaggtcccaggatcactatcctcacctccccgcggcactgaatggctatagctgtaaatgtgcgtccacggggtcactgtccagccaccaggaccaggtgcctggccatctggggaatcggaaaacgctcagcgggatgctctggccacctcccctgccctcagttaagatgtagagcgttcaacctaaaatgcctagaaacaaagcccaggcccgggaaggtcgaacgagtgcgacgccgctccctcaagctcttccctcggagccgtctcatttcccaaaactcccaaacacatcacagagagaggtgttgagccaggtggtcactcccttttccagaaccacagcaagaagttgagcctgctgggctcctaacgaaggccctggggcccggtgggatgaaaagccctattaggtagcaaacagctgtcactagaggggttgaggcccccttctcccctgcctgacgacgacggcggcaggaactcgaccggcgccggacagctcgcaacttgccttaccaagcgtaaatctcggttcctcccaactacccgcggccacggcctccgcagcagagcgccggaagcagagacgcgtttcgggaggaaggtgcatgctgggagcggcggcgcatgctgggagctgtagtctgcgacgcaactcggccgaggtggctccctggtccctgaagctcccagagcccgcgtgttcaggcggtcccgacaccccggcccgagcctcaccggctggaggactgaacgcctgccggccctccgggtatgagcggaggccgggatagccctgggctccgccgcccccggaaggaaaaaatacagtgcggtccgccgcccgaccacgaaagagcggagctcgggagccccgccccctgggcctccgacgtccgtggcgctttccgtcgcgcgagtgcgattgggccgcctgtcacgtgacccgagaccccacgcccggttggctgccgcctggttaccaatgggagactagcgggccggcgtactggcctggtccagcacctgcggggccctcgggcttggagggctgggccgggcggggaacgggcggggcgggccggaggcggcggcggctgactcgccttctctccggggctgcgaccccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggtggggccgtgtggggtgcggtgggcgccgtttctggtttctgagatctccgctcctcgcagggagcggggcggggtgggcggccagggtagctccgaacgcagggtccgccgttgttctcctcagaagtgggcgcccggccccctcttttcgtacctccttcatacccccgcccagaacgagcaggactcggcgctaccctaaggacgctaaactaggtcgtggcctccgcctgcgagagctccaatccaggaggctcagagcgctgcgagaggcgttttaacagagccccaaaccccgccccacctgtttgctttcgccctgaagagcgtttgtgtctgctcctcccgcagagagggccgctcgtgcccctctgaagtggctaggccgagcccacaaagcaaagcgtgatagaatttcagttttggattttgtgcacctgcctttccagttgtaacacctagaaatggcacctccaagggatgccctggccgagtgctgtgttcatatttttagaaatggtttatctgctgaataagactgcccagggagcaaccttgccctaagtggatgcggtcttagcggagacaactgatggccgccagtcttcgaacagagctggaacttctgggctctcgtgactgagatggctttgacaggccacctggtttccttggacaacactgaagggcctgggaggaggcaagggtcagaccatgtagagccttgtcattggaatttgggttttattttgttaaaagattgattttaggtgcagctggaggccactagagggttttggtagaggagtggttctcttggatgtgtgtttttacaagctcactcttgctgctgggtgggaagtgggttgtcggggcaagaatgcaagggtccattgtagtggtcctggagaaagatgaaggggctcagattagcttgacgactgttaggatgtgggtttggagtagattggtttgagacgtaccttgcaggggggatcgagaggccatagtgactgattgaaatagagggtgaggatagtggagggatcaacatgccttctgggtttctggcctgaacaggtgggtggatggtggtcctgggacagagcctgggggtgacctagagttgggctttgctctcacgtcttcaggtggagctgtcctggaggcaggtggatctgtcctggaggcaggtggatacggagcagggataggctagaggcattcttctgggaggcggagcatattagatggtttacagtccacagcctgggagagtgtctcgggggagtatcagtaaagaagaagggggccttggggctgagccttgaggaaccctaacatttcttggggtcaggcaggtgccctgacagatagacttgagaagcagcaggcagtgagggagaggacacccggggagcatgcggcctcacagaagctgagtggggaccacctcaggggcagcagatggctgttctgctgttgtgaatgctgctgagtagttggggaagagagttgggaccaagagaagcccagtgggtttgataacatagaggtgacagcgacattgatcgaggcagtttaggggccatgattggctcagaagctagaggagcctgtgtggagagtgaatgggaagcaggtagtgggcatggcagctctttcaagagctgtaatgaagagaagcctgaaggagactatggtgctgagagataatgtcttaaagaacatgggggtgggattctgcccggggagctggaagggaaggagttgtgagaggagcccaggctctgagggcaggagagagggtcaggtccagaagcaggaggcaaggtcgaagctcagaggggtgggcaagggcagtgtggatgttttgagtagacggggagaaaggggaaggtatatgatagttagggggtgtgggaaatggagcctgctagagaaacagtaagatttccagcaggatggaggacacatttgagatttaccagcatgagtaaaaagtgaaacttttcgaagccaacatttagctgttttgagaaggagcttgctagagtttgggatttttccagtaaggaaggaaggcaccccagaattaagctggacagaggcatttgaagccaggagctgaaggacacccgctgcaggaaaccaccttcctgtccctttttgggtaacactgatgatcggaaaagctccaccccaactcctgtcatctagagccttgggttcttagtttgaagggttccacagcaggcatgatctaactctggacaactttctgtatctcaggagatttgtgccacaccccggctgtttccagatgacccacgggaagggcaggtgaagcaggggctgctgggggattgctggttcctgtgtgcctgcgccgcgctgcagaagagcaggcacctcctggaccaggtgcggggccccttccctgtgtttgtcctggagccggtttctttttgcgtttctccagcctgctgagtaccaggaggccttgcgaaagcagagctgtgccgcagccggatctcctgctgtgttgggggaaggcaggagagttccaaggcagaggctgaggactgcactctgtccctctgctgcaggggggggtgccttggcctcgccagaaggctccatcagggaggttcgccctgctctgtgctctcctgacccccggactccatggagtcagatcaccacgtttagaataaagagacaaatgtgccagctcacaggaggacggggctggctggcagcctctgcctcagatctctcctcagctagctcgctggttttcttacaggttttgaatataagtttgcaaaaagttattaaacctgtttctgtgggtagacagatactctgggaggagaaggccttctcaggttttccttacctgggagtgttcaccgttttatgcttggcttgttgctaagtgttgctgattaatgcagcggcgtcaacagtgtgacctcattcagagtttcactcatgtcccaggccccatggtaagcgtgtcacagtcactggctttcagacacatggtcttaccagctttgactttttttttaaacgagagtgctaaaatcactgccattgtgtttctggccgtaaagtggcagagccaggaccgcaccaggtgcctggtgcccagcctgcactcccccgatgctgggtcagaatgcttacccctgaaggagccctgcagtggacgctgtgggtgcaagcagctggcccagtgtcggggcgccaggctcccagcagcaggaggggctgctgttcctgtggtgacgtgttgcttgcagccagctcggtcaagaactgggtcactcatgcccttgaatgtcacatttgttttggcttcaggtcagatgcttttagtgagggcagcagagtgtgtcccgggatatgtggctccctcggtgtggtcctcaagttttgcaatgagaggtctgttaatttcatgtgggtgatgcagccctgtgcaggcgccgacatccaggtgtgccgaagagttctctgcgacatccaggtgtgccgtagagttctctgcgacatccaggtgtgccgtagagttctctgcgacatccaggtgtgccgtagagttctctgcgacatccaggtgtgcgttagagttctctgcagaccgcggtgcctgtggagcactcagctgtggccacaccgcggccgggacactggagtagcgccgggtggtgcttatatcacgctcgccttttgcttctccctgtgcatggcaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaaggtctacgccaagtgcgtgtgctgggggctgaagggcctggcctggggcaagtgggagctgccactaccatgggctgccccaggagggtctctgctcactctgggctgcagagcccccttcagttctgagggtctggcagctcattctgtgagtcaggctgacaggccaggtgcagagattcttcttttgggcctgtggattgcccactccctgctttcccttcccttgttccaaagcccagcgtggagtcgttctccacagagaacatgtgtgccgtcctccttattttatcggccccagcaagaaagatgcttctttatatttgttgtggaatggttgggacaggcagactcattgtgtagtcgttggggaggaatgaggctaccccagcataccaacacttgtgtatcacggtgcttgctggctcaggggaccaggaccctcaccatgagtcataattgaatagccttccctcttagaatgcatttgtcttcttgccaaaggcaactggactgacaggcaggcagggaagctggtgaacatgggaaggctggctggtgacatcagtgcccagtgagcccttccatcccaagggctgttttaggaaaagcagggttggagcttgagagccaagggatgtgggcatccatagcttccacgcctcctgccctgctcctgtgcccacaccggatgccagagagtttctgtgtgtgggcagaggactgcagggcgctcacgcttgctgtgaagtaaggcgtttgaaggtgaggctaagccttgacttggtgaggatgaggaagaaggcagaggggagtaaagaggtgggattgaggcagcggttggacgatttggggtgctacagaccatgggaatcagagagggggccatgctcaatgccagaggctcactcccatggtgattgtgtcccctagggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgaggcacgtggccagcatgggagggctgcagccagcgtgccccccactgccaggcctcaggcacactgtagctttttatgtgactggctacacagccctgtcaggactaagtgggaagaagtaagcttgttctcaagggtggtgtcctcagtttgtgaccttcccctgctgtcctcttccagagggacgtggcccttctctcccctgaccagtcctttccactagtgcgaggcaggaagaggtggcaccgagtcaaagcccactgtctgtgccatccctggcccagctggcaacctggcaaaatcaaaacctgttttttattttagtgatagataacattcgttaaaaacagtttgtctccaaaaaatgaaaggggccaggtgtggtggctcacacctgtaatcccagaactttgggaggctgaggtgggagtatcgctggagcccaggagttcaagagacccgcctgggcaacatggcaagatctcatctctacaaaaaatgaaggaaaaaaatcacttagatggaaccacatgtgacttttgagtgcgctctcagttttccatgagcacgcacggtttacgtgttcccttccgcaccgcttctcacactgccacacacgcgctgtcaaatgttcgccccatgagcgggtttgccacagtctcttaatcattcccctgatgttggatattaagatctctctggttttatataattataagcagtatcaatgaacatctttatcatttttttcatacttaggattatttttaaaatatgggttaaagaatatgaatatcacagtaaactgaaacaagttgtcataggccttggtctgggtcccccataagcagaccctgagatgaggttcaggagcacgttgagaggttcagagagcctggagggcgtgtactccccgccagccccgctggggtgccaggaaggacgctggcctcagagcctcccacctgggagtgagggcgctggtctggtgggcattagctcggggagctgttggttttgggtgctccagggtggggtagcgctaagtcctagcacttcaggctttagaggaagcccccaggcagagagagatggcagctggcactgactggaggtgcattggagcctgctgaggtggcaaggggccgcggcgtgggcgagactgaagtccttccaggagaccctcctctctagaccgttgccccgccacagatgtggccttcctctctgtttggctctttcttttctatgcccatctgtctcaaggtctctggccaggtggagctgttgcccccctgggcctccatgcctccagtgggcttctagccagggcactatctgaatgtcctacctctagcaggctttgccaagagaaacactctctagatttctggcagttgcagatgcatctgtgcagcatgtttgagaactggtgctgtgccaggcatcgtgcacagatgggtacggacgatgactgaggcctagagaaggggatgacttacccagcaccagacccggatggcagccgagtcaggccccgtgtgcttgctcctggagatgctcctgagctgatgggtcacagctgctaagaaaggagctctcgtggtccatggggatctggggtctcccgtgtagccatagtggggtgggctggagcatctccagaggaggaggcagaggcctgtgtgtccttgtcagtttgggactccatggtgcccttcctgcctgtgcctgcgccattcctcatgcaggtgcccgggagctgggggagttccatgccttcattgtctcggacctgcgggagctccagggtcaggcgggccagtgcatcctgctgctgcggatccagaacccctggggccggcggtgctggcaggggctctggagagaggggtgagtgctggggcctggaccatgctgctgtcgggaggggggcccagtgccagtctggcctgtgtcctggtcaccttcagctgtcaggactgtacttggctgtctccagcaaggcccctgagtccctgctctcgtgacaccatgcttgtcttggctccaggcaatccttgtgaggcctgggaccaaggtggccattgggcctggggtttcaatagggcagacatcatcacgggctcgggcagcagtcctgggaagacgcatccagaggcgtgaagttcctctgggaaaagagagggctccagggtggccgctgcccagaaggccctgtgctgcagagctgcttcgggtgtgggaggggctgcagagctggggcacggggtcgctggcaggaactcagggctctctgggtcccctccaggcttccccccagcctgccggcaagttgacactaccagttctcgggaggggcttctgctgagatgaggtttcttccaggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacaggtagtgccccgaggggctgtgctgggcacgtgctctgcctgccgaagtgaggaggctgggcaggtgcctgggttccccctgcccaggcccagtttggttctcttcagcgtggagagatgattctgtcccaggagccgggaggagggtgatgattctgtcccaggagctgggaggagggtgggcttgtgggaggggctggctctgtctgtggccgtagctgctgcttataccctgccagggttcatgaggccaccgtggcgggaggccagcgaggagccgtgtcccacagctgatgcctggtgttttctcactagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtaactcagccccgtctggctcacgctcggttcagcaggtggtgtggaggcccatggaggtctgggttctaggactggctctgccgggacacatgtgactctgccacgggccccaccagtctcccccctccttgggctgttgcacggggttgacgtctgctggtgctcccagacccggctctgacctgagactgcaggtctttctgccttgccgtgtgcctcattggccaaaggaaagcaacagagtctgcagccagggcaggacccgcaggaggggcctggacccggggggctcctggcagcgccgtgcctttctgaggcaaggaggtagagccagcggctgaggacctgtcagggccagtcccagctctgcagcttgctgtgtgacctggcacacatcctctccctgcctccctcagtctcttcccctgcaagacggggtcctgacacggatctcatgggattgctctgaggcccaggcagtcccaggctcaaccactggttcacaaagtgtgttgtttccaggaagaacagatgggggcgcctgagggcaaagggcctgagtgtgggtcgaggatatgccggctgctcgctcaggggctgggttttcatcttgtgtgtcttgacagggtgtgacacttggcaccacactgttccctgtcccttcatggatgtggcccacatgatgttcctttcctcttgcaaaagaagttgctggaaggcccactgtccagcagcccccaggttgcctgggccacggtgcctttgtgggcccagctacaaggaggacttgcaggctcgtgtctgggacagatactggcgccagggccaagtgaagcccgggattggtgggcatctctagctggtccctgagagagggtggagggtgctgacaggccttggcgctttcatctgtcaactccagaggcccttgtgcttgcagcagggaggtcaaggccagggcgtctgaccccggccgctcctccacactgagcctcctgcacgtgctcacaggtagagaagcggcgggtcaatctgcctagggtcctgtccatgccccccgtggctggcaccgcgtgccatgcatacgaccgggaggtccacctgcgttgtgagctctcaccgggctactacctggctgtccccagcaccttcctgaaggacgcgccaggggagttcctgctccgagtcttctctaccgggcgagtctcccttaggtgagaggaaccgcgcagtgctgctggctctccgaggccacaggcccttccaaggcaggatttgggcactttccctctgtggttggcaggtgtccatgtgggaactgaggccaccgggaacctgctgccagcgccctcccatgtttgtcttcttggcagcgccatcagggcagtggccaagaacaccacccccggggcagccctgcctgcgggggagtgggggaccgtgcagctacggggttcttggagagtcggccagacggcggggggcagcaggaactttgcctcataccccaccaacccctgcttccccttctcggtccccgagggccctggcccccgctgcgtccgcatcactctgcatcagcactgccggcccagtgacaccgagttccaccccatcggcttccatatcttccaggcaagctccttgccccagggagggagggggagcagaaggggccctcagagaatttgcatcttggcctccattgtcccaacagagggctctgggctcagtcacttgggctccccctgcccttcgaggcgctgcctagaacccgcacagggccctctcccatctccaacctctcagaggcaaggccgaagatggcctctggaagggccgggggcctgggaggtgggcagggctgatccaggcagggcaggtttccagaggaggtggtgagtggggaggaagggagaagtttggagaggacaggaggccgaggttgagaccagcgggggtgggtcgagccctggcttgggaacgcagggggctgatggactcaggagtgagaggaggggaggcccaggctggctggccacagcagcccctcgggtgtgaggaagtccacagtcactgagctcagccagcagccccttgtccacttaccctgactcagaatgactgtgtcccaaggttcattctctgcagacatgtgtcccctggaatgcaggggccctgacgaggaaggcactgcaaccctcggttcacagtgggctgcctggggacccttggaccctcgctgtttgccctgggccaccggctcaggtcccctagagctctgaggaaaacacatgccagggccagtgggagcccttggggcgggctgggcagtcacaggtgttaaagcccctgatgatgtgacaggcctccaggcgggggccccactgccggcaccttctggcaagggtggccaggccttggtgaggaggcgagtccagtgtccaggcctggcagcccctcctcagagaaggggctgtatgtgactcaagagggccaagggcatccgagcagatggccctgggctgggctccctaccccaaggctggccccctcagtctgagcctgcgctttcctcaggtcccagagggtggaaggagccaggacgcacccccactgctgctgcaggagccgctgctgagctgcgtgccacatcgctacgcccaggaggtgagccggctctgcctcctgcctgcgggcacctacaaggttgtgccctccacctacctgccggacacagagggggccttcacagtgaccatcgcaaccaggattgacaggtggggctctgggacttgggggcggccagctggaggctggggtgctggagtcttagtgctcgcctgtccccccacgtctcctgcctgcccctcaccctcaagcccctatctgtcctggcagaccagggctgtcctgcctacctggggacccttccttgctggtctgagcctggaaggagagtctagtgggaggtgggccaggagcacacagccacttgtgtgacaagtgcagtctgggagcgctgatctggtgtctctccacaggccatccattcacagccaggagatgctgggccagttcctccaagaggtgtgtatgcagccccgccagcccggctcacctgcctggggctgcctggtggcctagggtctacctgcaacctcaggcaggtggtttctgcctgggacgtgaggtgcccttgactcttcctgtgagagccccgggcggtgccttgaagggcagggggagctgaggctgcgtcccattccctggctgcactcggggtggggtgtgagaaggggcgagtgccaccgctgcccgggccccccatctgtctttgcaggtctccgtcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccagggggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaacatgagcgctgatgatttgcagatcagtcttgctccaggtagttccaggctgtgcctgctcttgccaagcaggctgtggggagggctgggtgcctgccgagatggtgaggatgaggatggcctctggaggggctgggggcctgggaggtgggcagagccaacccaggcagggcaggtttcagggggagatggtgagtggggaggaggggagaagtttggaggggcgggcccagggcatgccccaggccagggggctgaggttgaggctggccggggcaggtcaagccctggtcttgggggacacagactgatagactggggagtgaggggtggggagagccagcgaaggcactgccaaggctgtggcgaagaaggacatctcggaaacgggtgttagaaccggagttgcgcagagggaggaaccccaggttcacgtggactgggagccttggatctggacggctcctctgcctccagccagggttcacctgcgcagtgtcctaggattgtttatttccccaggcctctctccctcgtccctcacaccaaatgctgtgatgagagctgtagtgtcactgaacggtgcagaagacagttccagacatgggtggggagggctgtcactaagcccttttgttttagagacagggtcttgctctgttgctcaggctggagtgcagtggcatgatcatagctcactgcagcctcgaccttctgggctcaggtgatcctccctcttcagcctcccaggtgggtaggaaaacaggcgcacactccatgcctggttagttttttcaagttttgaatgcttaggggtcttagtatgtggttgcctaggctggcctcagtgatcctcctgccttggcctcccaaagcactaagattgcaggcatgaccgccaaccccagctctaatcccttttaaattccattcgcttcctgagtccctttgtgcctggggagaccccgtgtattggtcctttttcacattgctgtaaacaactctgagactggtaatttataaagaaaagaggtttgattgcctcagttccgaagactgtacaggaagcatggctggggaggcctcaggaaacttagaatcatggcggagggaaagcaggcagtctgcaggtgtctggagaaggaggaagagagcgaaggggaggtgctgtgcacttttaaatgaccagatcttaggagaactcactatcaccaaaacagcaagggggatatccgctcccatgatccaatcatctcccaccaggctcctccaacactggggattataattcgacatgagatttgggcaggaacacaaattcaaaccatagcacccagtgagcctgatttgggccttgctgcccgatcacgaccatctctggagtcctggtgtctgttcccactgggacctgtgccgctgtccccctctccacgccctggccacgccaagccaccctcctgactcacccacaggaagctgccctggccctggagcctgccccgtgagcccctctgcttgctggttcaatggccctccagcagcagtggctgtggcagctgggttctcggcatcttcagacacggattcttgagcagcaggatggggctccatctccctgcgtgcagagcctgccacagatctccctcatccactggcttctgtgctgacttcggatgaagccagtggtgccgcctattggggtacagcaactcagggcgaacagtgaggggcggctcaccaaagaaataccccgcagggcagtgcccaagccagaggcttgagctgggtcggagctgccctagatccctgggtttgtgggcggacaggtcctgtgcagggcgcctgatggtgcaggttgaggtgggacagttggggtcaaggtatttctcaggcacagtgcctatgaagggaagacagttgcagggactgtgtccatgtcaggatagactggtggggaccccgtgaagagttctggagcaaaccctgcctgcagggccccacctgggctggccaggccctta

SEQ ID NO: 14793 - DNA, 16374 bp, Human; identical to SEQ ID NO: 14792

SEQ ID NO: 14794 - DNA, 16374 bp, Human; identical to SEQ ID NO: 14792

SEQ ID NO: 14795 - DNA, 16374 bp, Human; identical to SEQ ID NO: 14792

SEQ ID NO: 14796 - DNA, 16374 bp, Human; identical to SEQ ID NO: 14792

SEQ ID NO: 14797 - DNA, 16374 bp, Human; identical to SEQ ID NO: 14792

SEQ ID NO: 14798 - DNA, 16374 bp, Human; identical to SEQ ID NO: 14792

SEQ ID NO: 14799 - DNA, 16374 bp, Human; identical to SEQ ID NO: 14792

SEQ ID NO: 14800 - DNA, 16374 bp, Human; identical to SEQ ID NO: 14792

SEQ ID NO: 14801 - DNA, 16374 bp, Human; identical to SEQ ID NO: 14792

SEQ ID NO: 14802 - DNA, 16374 bp, Human; identical to SEQ ID NO: 14792

SEQ ID NO: 14803 - DNA, 34977 bp, Human
tgagggatccacccctattacccaaactcctcctactaggcaccacctcctaacactgcctcattgaggctcaaatttcaataccattttgggcaggggcagaccacatgcaaatcacagcatggggtaatagtgggggcaggttgacacagggctgctgcctacccagcaccagctgtctcttggccccttccagatcctggcaatctggctacaggcatgggcccagccttggacacagatgtggccacaggaagctgttagctctccagatctgatcagcctgggagagcggcacaacaaaggctcccaaaggagagtcgggatcctcagctagcctcagctctgctacccacccatatgtgcccagaacaggaaagatacgtgtttcttactcctccgggactcctaggtgaagctgagaccaggctcttcttgagtcctctcagctatggtgcaaccaccagcctagcaaggaatcagaaacatcttccggaagagtcagcaccatagagggtgctgaatgggcaatgaagcatcccggagatgaaacatctgggcagtgaggcatcccacaggtgttgggctatgcagtcactccctttctcagaccgaggcaagtacataagcactctgggcccctaatcaggggcctggggccaggtgggatgaaaacagcagtgtcctgccacctgaacaactgctactcacgcaggccccacctggcctctcagagggaggaacctgggactcctgaaccagattcaatttctccttcaacagccgggacttttcgctcctgactgcagaaaaacagcttcaatgtgaccatccttgatagtccgaggctgagtaaaatggcctgaggaggcaaaatctgaaaagctctattaggtggcaaactgctgtcactagaagagttgaggcccccttctcctcccctgcctgaccgccttcattcctgggaatggaacaggttcttggggcaagggtgaatcctcgagcaggtcccaggatcactatcctcacctccccgcggcactgaatggctatagctgtaaatgtgcgtccacggggtcactgtccagccaccaggaccaggtgcctggccatctggggaatcggaaaacgctcagcgggatgctctggccacctcccctgccctcagttaagatgtagagcgttcaacctaaaatgcctagaaacaaagcccaggcccgggaaggtcgaacgagtgcgacgccgctccctcaagctcttccctcggagccgtctcatttcccaaaactcccaaacacatcacagagagaggtgttgagccaggtggtcactcccttttccagaaccacagcaagaagttgagcctgctgggctcctaacgaaggccctggggcccggtgggatgaaaagccctattaggtagcaaacagctgtcactagaggggttgaggcccccttctcccctgcctgacgacgacggcggcaggaactcgaccggcgccggacagctcgcaacttgccttaccaagcgtaaatctcggttcctcccaactacccgcggccacggcctccgcagcagagcgccggaagcagagacgcgtttcgggaggaaggtgcatgctgggagcggcggcgcatgctgggagctgtagtctgcgacgcaactcggccgaggtggctccctggtccctgaagctcccagagcccgcgtgttcaggcggtcccgacaccccggcccgagcctcaccggctggaggactgaacgcctgccggccctccgggtatgagcggaggccgggatagccctgggctccgccgcccccggaaggaaaaaatacagtgcggtccgccgcccgaccacgaaagagcggagctcgggagccccgccccctgggcctccgacgtccgtggcgctttccgtcgcgcgagtgcgattgggccgcctgtcacgtgacccgagaccccacgcccggttggctgccgcctggttaccaatgggagactagcgggccggcgtactggcctggtccagcacctgcggggccctcgggcttggagggctgggccgggcggggaacgggcggggcgggccggaggcggcggcggctgactcgccttctctccggggctgcgaccccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggtggggccgtgtggggtgcggtgggcgccgtttctggtttctgagatctccgctcctcgcagggagcggggcggggtgggcggccagggtagctccgaacgcagggtccgccgttgttctcctcagaagtgggcgcccggccccctcttttcgtacctccttcatacccccgcccagaacgagcaggactcggcgctaccctaaggacgctaaactaggtcgtggcctccgcctgcgagagctccaatccaggaggctcagagcgctgcgagaggcgttttaacagagccccaaaccccgccccacctgtttgctttcgccctgaagagcgtttgtgtctgctcctcccgcagagagggccgctcgtgcccctctgaagtggctaggccgagcccacaaagcaaagcgtgatagaatttcagttttggattttgtgcacctgcctttccagttgtaacacctagaaatggcacctccaagggatgccctggccgagtgctgtgttcatatttttagaaatggtttatctgctgaataagactgcccagggagcaaccttgccctaagtggatgcggtcttagcggagacaactgatggccgccagtcttcgaacagagctggaacttctgggctctcgtgactgagatggctttgacaggccacctggtttccttggacaacactgaagggcctgggaggaggcaagggtcagaccatgtagagccttgtcattggaatttgggttttattttgttaaaagattgattttaggtgcagctggaggccactagagggttttggtagaggagtggttctcttggatgtgtgtttttacaagctcactcttgctgctgggtgggaagtgggttgtcggggcaagaatgcaagggtccattgtagtggtcctggagaaagatgaaggggctcagattagcttgacgactgttaggatgtgggtttggagtagattggtttgagacgtaccttgcaggggggatcgagaggccatagtgactgattgaaatagagggtgaggatagtggagggatcaacatgccttctgggtttctggcctgaacaggtgggtggatggtggtcctgggacagagcctgggggtgacctagagttgggctttgctctcacgtcttcaggtggagctgtcctggaggcaggtggatctgtcctggaggcaggtggatacggagcagggataggctagaggcattcttctgggaggcggagcatattagatggtttacagtccacagcctgggagagtgtctcgggggagtatcagtaaagaagaagggggccttggggctgagccttgaggaaccctaacatttcttggggtcaggcaggtgccctgacagatagacttgagaagcagcaggcagtgagggagaggacacccggggagcatgcggcctcacagaagctgagtggggaccacctcaggggcagcagatggctgttctgctgttgtgaatgctgctgagtagttggggaagagagttgggaccaagagaagcccagtgggtttgataacatagaggtgacagcgacattgatcgaggcagtttaggggccatgattggctcagaagctagaggagcctgtgtggagagtgaatgggaagcaggtagtgggcatggcagctctttcaagagctgtaatgaagagaagcctgaaggagactatggtgctgagagataatgtcttaaagaacatgggggtgggattctgcccggggagctggaagggaaggagttgtgagaggagcccaggctctgagggcaggagagagggtcaggtccagaagcaggaggcaaggtcgaagctcagaggggtgggcaagggcagtgtggatgttttgagtagacggggagaaaggggaaggtatatgatagttagggggtgtgggaaatggagcctgctagagaaacagtaagatttccagcaggatggaggacacatttgagatttaccagcatgagtaaaaagtgaaacttttcgaagccaacatttagctgttttgagaaggagcttgctagagtttgggatttttccagtaaggaaggaaggcaccccagaattaagctggacagaggcatttgaagccaggagctgaaggacacccgctgcaggaaaccaccttcctgtccctttttgggtaacactgatgatcggaaaagctccaccccaactcctgtcatctagagccttgggttcttagtttgaagggttccacagcaggcatgatctaactctggacaactttctgtatctcaggagatttgtgccacaccccggctgtttccagatgacccacgggaagggcaggtgaagcaggggctgctgggggattgctggttcctgtgtgcctgcgccgcgctgcagaagagcaggcacctcctggaccaggtgcggggccccttccctgtgtttgtcctggagccggtttctttttgcgtttctccagcctgctgagtaccaggaggccttgcgaaagcagagctgtgccgcagccggatctcctgctgtgttgggggaaggcaggagagttccaaggcagaggctgaggactgcactctgtccctctgctgcaggggggggtgccttggcctcgccagaaggctccatcagggaggttcgccctgctctgtgctctcctgacccccggactccatggagtcagatcaccacgtttagaataaagagacaaatgtgccagctcacaggaggacggggctggctggcagcctctgcctcagatctctcctcagctagctcgctggttttcttacaggttttgaatataagtttgcaaaaagttattaaacctgtttctgtgggtagacagatactctgggaggagaaggccttctcaggttttccttacctgggagtgttcaccgttttatgcttggcttgttgctaagtgttgctgattaatgcagcggcgtcaacagtgtgacctcattcagagtttcactcatgtcccaggccccatggtaagcgtgtcacagtcactggctttcagacacatggtcttaccagctttgactttttttttaaacgagagtgctaaaatcactgccattgtgtttctggccgtaaagtggcagagccaggaccgcaccaggtgcctggtgcccagcctgcactcccccgatgctgggtcagaatgcttacccctgaaggagccctgcagtggacgctgtgggtgcaagcagctggcccagtgtcggggcgccaggctcccagcagcaggaggggctgctgttcctgtggtgacgtgttgcttgcagccagctcggtcaagaactgggtcactcatgcccttgaatgtcacatttgttttggcttcaggtcagatgcttttagtgagggcagcagagtgtgtcccgggatatgtggctccctcggtgtggtcctcaagttttgcaatgagaggtctgttaatttcatgtgggtgatgcagccctgtgcaggcgccgacatccaggtgtgccgaagagttctctgcgacatccaggtgtgccgtagagttctctgcgacatccaggtgtgccgtagagttctctgcgacatccaggtgtgccgtagagttctctgcgacatccaggtgtgcgttagagttctctgcagaccgcggtgcctgtggagcactcagctgtggccacaccgcggccgggacactggagtagcgccgggtggtgcttatatcacgctcgccttttgcttctccctgtgcatggcaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaaggtctacgccaagtgcgtgtgctgggggctgaagggcctggcctggggcaagtgggagctgccactaccatgggctgccccaggagggtctctgctcactctgggctgcagagcccccttcagttctgagggtctggcagctcattctgtgagtcaggctgacaggccaggtgcagagattcttcttttgggcctgtggattgcccactccctgctttcccttcccttgttccaaagcccagcgtggagtcgttctccacagagaacatgtgtgccgtcctccttattttatcggccccagcaagaaagatgcttctttatatttgttgtggaatggttgggacaggcagactcattgtgtagtcgttggggaggaatgaggctaccccagcataccaacacttgtgtatcacggtgcttgctggctcaggggaccaggaccctcaccatgagtcataattgaatagccttccctcttagaatgcatttgtcttcttgccaaaggcaactggactgacaggcaggcagggaagctggtgaacatgggaaggctggctggtgacatcagtgcccagtgagcccttccatcccaagggctgttttaggaaaagcagggttggagcttgagagccaagggatgtgggcatccatagcttccacgcctcctgccctgctcctgtgcccacaccggatgccagagagtttctgtgtgtgggcagaggactgcagggcgctcacgcttgctgtgaagtaaggcgtttgaaggtgaggctaagccttgacttggtgaggatgaggaagaaggcagaggggagtaaagaggtgggattgaggcagcggttggacgatttggggtgctacagaccatgggaatcagagagggggccatgctcaatgccagaggctcactcccatggtgattgtgtcccctagggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgaggcacgtggccagcatgggagggctgcagccagcgtgccccccactgccaggcctcaggcacactgtagctttttatgtgactggctacacagccctgtcaggactaagtgggaagaagtaagcttgttctcaagggtggtgtcctcagtttgtgaccttcccctgctgtcctcttccagagggacgtggcccttctctcccctgaccagtcctttccactagtgcgaggcaggaagaggtggcaccgagtcaaagcccactgtctgtgccatccctggcccagctggcaacctggcaaaatcaaaacctgttttttattttagtgatagataacattcgttaaaaacagtttgtctccaaaaaatgaaaggggccaggtgtggtggctcacacctgtaatcccagaactttgggaggctgaggtgggagtatcgctggagcccaggagttcaagagacccgcctgggcaacatggcaagatctcatctctacaaaaaatgaaggaaaaaaatcacttagatggaaccacatgtgacttttgagtgcgctctcagttttccatgagcacgcacggtttacgtgttcccttccgcaccgcttctcacactgccacacacgcgctgtcaaatgttcgccccatgagcgggtttgccacagtctcttaatcattcccctgatgttggatattaagatctctctggttttatataattataagcagtatcaatgaacatctttatcatttttttcatacttaggattatttttaaaatatgggttaaagaatatgaatatcacagtaaactgaaacaagttgtcataggccttggtctgggtcccccataagcagaccctgagatgaggttcaggagcacgttgagaggttcagagagcctggagggcgtgtactccccgccagccccgctggggtgccaggaaggacgctggcctcagagcctcccacctgggagtgagggcgctggtctggtgggcattagctcggggagctgttggttttgggtgctccagggtggggtagcgctaagtcctagcacttcaggctttagaggaagcccccaggcagagagagatggcagctggcactgactggaggtgcattggagcctgctgaggtggcaaggggccgcggcgtgggcgagactgaagtccttccaggagaccctcctctctagaccgttgccccgccacagatgtggccttcctctctgtttggctctttcttttctatgcccatctgtctcaaggtctctggccaggtggagctgttgcccccctgggcctccatgcctccagtgggcttctagccagggcactatctgaatgtcctacctctagcaggctttgccaagagaaacactctctagatttctggcagttgcagatgcatctgtgcagcatgtttgagaactggtgctgtgccaggcatcgtgcacagatgggtacggacgatgactgaggcctagagaaggggatgacttacccagcaccagacccggatggcagccgagtcaggccccgtgtgcttgctcctggagatgctcctgagctgatgggtcacagctgctaagaaaggagctctcgtggtccatggggatctggggtctcccgtgtagccatagtggggtgggctggagcatctccagaggaggaggcagaggcctgtgtgtccttgtcagtttgggactccatggtgcccttcctgcctgtgcctgcgccattcctcatgcaggtgcccgggagctgggggagttccatgccttcattgtctcggacctgcgggagctccagggtcaggcgggccagtgcatcctgctgctgcggatccagaacccctggggccggcggtgctggcaggggctctggagagaggggtgagtgctggggcctggaccatgctgctgtcgggaggggggcccagtgccagtctggcctgtgtcctggtcaccttcagctgtcaggactgtacttggctgtctccagcaaggcccctgagtccctgctctcgtgacaccatgcttgtcttggctccaggcaatccttgtgaggcctgggaccaaggtggccattgggcctggggtttcaatagggcagacatcatcacgggctcgggcagcagtcctgggaagacgcatccagaggcgtgaagttcctctgggaaaagagagggctccagggtggccgctgcccagaaggccctgtgctgcagagctgcttcgggtgtgggaggggctgcagagctggggcacggggtcgctggcaggaactcagggctctctgggtcccctccaggcttccccccagcctgccggcaagttgacactaccagttctcgggaggggcttctgctgagatgaggtttcttccaggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacaggtagtgccccgaggggctgtgctgggcacgtgctctgcctgccgaagtgaggaggctgggcaggtgcctgggttccccctgcccaggcccagtttggttctcttcagcgtggagagatgattctgtcccaggagccgggaggagggtgatgattctgtcccaggagctgggaggagggtgggcttgtgggaggggctggctctgtctgtggccgtagctgctgcttataccctgccagggttcatgaggccaccgtggcgggaggccagcgaggagccgtgtcccacagctgatgcctggtgttttctcactagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtaactcagccccgtctggctcacgctcggttcagcaggtggtgtggaggcccatggaggtctgggttctaggactggctctgccgggacacatgtgactctgccacgggccccaccagtctcccccctccttgggctgttgcacggggttgacgtctgctggtgctcccagacccggctctgacctgagactgcaggtctttctgccttgccgtgtgcctcattggccaaaggaaagcaacagagtctgcagccagggcaggacccgcaggaggggcctggacccggggggctcctggcagcgccgtgcctttctgaggcaaggaggtagagccagcggctgaggacctgtcagggccagtcccagctctgcagcttgctgtgtgacctggcacacatcctctccctgcctccctcagtctcttcccctgcaagacggggtcctgacacggatctcatgggattgctctgaggcccaggcagtcccaggctcaaccactggttcacaaagtgtgttgtttccaggaagaacagatgggggcgcctgagggcaaagggcctgagtgtgggtcgaggatatgccggctgctcgctcaggggctgggttttcatcttgtgtgtcttgacagggtgtgacacttggcaccacactgttccctgtcccttcatggatgtggcccacatgatgttcctttcctcttgcaaaagaagttgctggaaggcccactgtccagcagcccccaggttgcctgggccacggtgcctttgtgggcccagctacaaggaggacttgcaggctcgtgtctgggacagatactggcgccagggccaagtgaagcccgggattggtgggcatctctagctggtccctgagagagggtggagggtgctgacaggccttggcgctttcatctgtcaactccagaggcccttgtgcttgcagcagggaggtcaaggccagggcgtctgaccccggccgctcctccacactgagcctcctgcacgtgctcacaggtagagaagcggcgggtcaatctgcctagggtcctgtccatgccccccgtggctggcaccgcgtgccatgcatacgaccgggaggtccacctgcgttgtgagctctcaccgggctactacctggctgtccccagcaccttcctgaaggacgcgccaggggagttcctgctccgagtcttctctaccgggcgagtctcccttaggtgagaggaaccgcgcagtgctgctggctctccgaggccacaggcccttccaaggcaggatttgggcactttccctctgtggttggcaggtgtccatgtgggaactgaggccaccgggaacctgctgccagcgccctcccatgtttgtcttcttggcagcgccatcagggcagtggccaagaacaccacccccggggcagccctgcctgcgggggagtgggggaccgtgcagctacggggttcttggagagtcggccagacggcggggggcagcaggaactttgcctcataccccaccaacccctgcttccccttctcggtccccgagggccctggcccccgctgcgtccgcatcactctgcatcagcactgccggcccagtgacaccgagttccaccccatcggcttccatatcttccaggcaagctccttgccccagggagggagggggagcagaaggggccctcagagaatttgcatcttggcctccattgtcccaacagagggctctgggctcagtcacttgggctccccctgcccttcgaggcgctgcctagaacccgcacagggccctctcccatctccaacctctcagaggcaaggccgaagatggcctctggaagggccgggggcctgggaggtgggcagggctgatccaggcagggcaggtttccagaggaggtggtgagtggggaggaagggagaagtttggagaggacaggaggccgaggttgagaccagcgggggtgggtcgagccctggcttgggaacgcagggggctgatggactcaggagtgagaggaggggaggcccaggctggctggccacagcagcccctcgggtgtgaggaagtccacagtcactgagctcagccagcagccccttgtccacttaccctgactcagaatgactgtgtcccaaggttcattctctgcagacatgtgtcccctggaatgcaggggccctgacgaggaaggcactgcaaccctcggttcacagtgggctgcctggggacccttggaccctcgctgtttgccctgggccaccggctcaggtcccctagagctctgaggaaaacacatgccagggccagtgggagcccttggggcgggctgggcagtcacaggtgttaaagcccctgatgatgtgacaggcctccaggcgggggccccactgccggcaccttctggcaagggtggccaggccttggtgaggaggcgagtccagtgtccaggcctggcagcccctcctcagagaaggggctgtatgtgactcaagagggccaagggcatccgagcagatggccctgggctgggctccctaccccaaggctggccccctcagtctgagcctgcgctttcctcaggtcccagagggtggaaggagccaggacgcacccccactgctgctgcaggagccgctgctgagctgcgtgccacatcgctacgcccaggaggtgagccggctctgcctcctgcctgcgggcacctacaaggttgtgccctccacctacctgccggacacagagggggccttcacagtgaccatcgcaaccaggattgacaggtggggctctgggacttgggggcggccagctggaggctggggtgctggagtcttagtgctcgcctgtccccccacgtctcctgcctgcccctcaccctcaagcccctatctgtcctggcagaccagggctgtcctgcctacctggggacccttccttgctggtctgagcctggaaggagagtctagtgggaggtgggccaggagcacacagccacttgtgtgacaagtgcagtctgggagcgctgatctggtgtctctccacaggccatccattcacagccaggagatgctgggccagttcctccaagaggtgtgtatgcagccccgccagcccggctcacctgcctggggctgcctggtggcctagggtctacctgcaacctcaggcaggtggtttctgcctgggacgtgaggtgcccttgactcttcctgtgagagccccgggcggtgccttgaagggcagggggagctgaggctgcgtcccattccctggctgcactcggggtggggtgtgagaaggggcgagtgccaccgctgcccgggccccccatctgtctttgcaggtctccgtcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccagggggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaacatgagcgctgatgatttgcagatcagtcttgctccaggtagttccaggctgtgcctgctcttgccaagcaggctgtggggagggctgggtgcctgccgagatggtgaggatgaggatggcctctggaggggctgggggcctgggaggtgggcagagccaacccaggcagggcaggtttcagggggagatggtgagtggggaggaggggagaagtttggaggggcgggcccagggcatgccccaggccagggggctgaggttgaggctggccggggcaggtcaagccctggtcttgggggacacagactgatagactggggagtgaggggtggggagagccagcgaaggcactgccaaggctgtggcgaagaaggacatctcggaaacgggtgttagaaccggagttgcgcagagggaggaaccccaggttcacgtggactgggagccttggatctggacggctcctctgcctccagccagggttcacctgcgcagtgtcctaggattgtttatttccccaggcctctctccctcgtccctcacaccaaatgctgtgatgagagctgtagtgtcactgaacggtgcagaagacagttccagacatgggtggggagggctgtcactaagcccttttgttttagagacagggtcttgctctgttgctcaggctggagtgcagtggcatgatcatagctcactgcagcctcgaccttctgggctcaggtgatcctccctcttcagcctcccaggtgggtaggaaaacaggcgcacactccatgcctggttagttttttcaagttttgaatgcttaggggtcttagtatgtggttgcctaggctggcctcagtgatcctcctgccttggcctcccaaagcactaagattgcaggcatgaccgccaaccccagctctaatcccttttaaattccattcgcttcctgagtccctttgtgcctggggagaccccgtgtattggtcctttttcacattgctgtaaacaactctgagactggtaatttataaagaaaagaggtttgattgcctcagttccgaagactgtacaggaagcatggctggggaggcctcaggaaacttagaatcatggcggagggaaagcaggcagtctgcaggtgtctggagaaggaggaagagagcgaaggggaggtgctgtgcacttttaaatgaccagatcttaggagaactcactatcaccaaaacagcaagggggatatccgctcccatgatccaatcatctcccaccaggctcctccaacactggggattataattcgacatgagatttgggcaggaacacaaattcaaaccatagcacccagtgagcctgatttgggccttgctgcccgatcacgaccatctctggagtcctggtgtctgttcccactgggacctgtgccgctgtccccctctccacgccctggccacgccaagccaccctcctgactcacccacaggaagctgccctggccctggagcctgccccgtgagcccctctgcttgctggttcaatggccctccagcagcagtggctgtggcagctgggttctcggcatcttcagacacggattcttgagcagcaggatggggctccatctccctgcgtgcagagcctgccacagatctccctcatccactggcttctgtgctgacttcggatgaagccagtggtgccgcctattggggtacagcaactcagggcgaacagtgaggggcggctcaccaaagaaataccccgcagggcagtgcccaagccagaggcttgagctgggtcggagctgccctagatccctgggtttgtgggcggacaggtcctgtgcagggcgcctgatggtgcaggttgaggtgggacagttggggtcaaggtatttctcaggcacagtgcctatgaagggaagacagttgcagggactgtgtccatgtcaggatagactggtggggaccccgtgaagagttctggagcaaaccctgcctgcagggccccacctgggctggccaggcccttatgttgagcatcccttcccccaggccctcaggagccactgtccccgaggcaggccctgaaggtggcggccacaccctcctgctgggcagctctgcccaaaggccacagccaggacctgcttcccgcgtcccaggctactgcctgagaggaggcctcgaaagcgcagggttccgtgactttagaggccatggttggcacccatcatcgccccagtgtagattggctccactcgacctggctgctttggccatttggtctaccagctggaaccatgttcctgggtgtggaaaacgctccctccgaagcctgcggagagccctgaggccttgtgcttccttctgatgggaggttccagatgcagttggaggggatgtctggcagggctctaacccccagccaacctaaacatttctggtgcagaaggccccggcctggtgttgtttgtccctggctgcctcctgctctgacaccatcagcatcctgttgccaaggtcatggatcagtgcggtgctcttcagggtgtccggccagctggggtctctgtcctgtattccggcagaggccccaggagaaacagcaaatgcctttgtccattccatacaaatttcatataaatgtgagcagcttctgatcttccgtggcgtattcgtccagttgatggccaaccctgggtacctggacctccaggacctgctgcactgggctgcccctcggctgtgtgtgcactcgccacgtggccctccaggaatcccatcccacggggccacactgaaccaaatggagagagcagggccaccaccctctctccgcatgccacggctgctctgggacccgggcaggaggggacagtcttggccttccagtgtccctcttggccttcccacggccatctctaccccaaggatgcagcagagatatcggtcgctccccaggtgtcaatcccagtcacaggctcagagaccgggacatggccccgggtgggtctgtaggccctgtgggctcatgtgagctggtcctgggcaggactccattattaactgcctgtgatgtgtcccactgtcatggagccctggtgactcttggggaccagcatcagctcggggcctgtgtgctcagtggttcccagatgcctggatattctcttcctggtgcacatagtccccggggaggtccttgtcatgcacacttgctgatgtggggagtgtccttcatcttgcaggcctggccacctcttcagtcagcagatacctgggctgaaaaccgactcgggcagtgtgggcccaactggggctctatcggagtgaccaccctcagccctcctggacccctctgccggctccacctgagcgctgccctcgctggcagccctgccttgctctgctgccattccgtaagccctgcaggcaggccccttggcgcccttcagccgtgttcatgattgtctcctggcctctgctgtttagaggtctaatgccctccgcccccggcgagccaaacccagtgatggtggttcctgccaccagcttcctgtggcaccgctgccactcccgccaggctcctggggcaccgccaccactcccgccaggctcctggggcaccgccggccactcccgccaggctcctggggcaccgccgcccactccctccaggctcctggggcaccgccgccactcccgccaggctcctggggcaccgccgccactcctgccagcctcctgcggcacagctgccactccctattaaccagcatggcacaggtgagcggtgtgaccttggtcttcccagggaaccagtgcttggcagctcacaccacacacgcctacgcctaccctccaccagccacagcagttgtggcatctctaccctgcccagcaaaagtggaagtgttgcctgtgccgctaggaacctccaggtttgctccacctccaggggccttgccagggtgtcaaacctgtgtctcgggacactgctgttaggtctccagcttccctatcaggcgcctcagcacccagtcctaccagtgctcccgcctcccgtccccagctggctgggcctgcagccccctcctgtgccccgagctggccgggcccgcagcccactccctggtcactggatgttgctgacacttcactcggtcagagccctagcacccaaggggggccagggcctgacgggggtggagcgaggggtgggccgcgtctgtgcaggctcagaagcttcctaagaggctggagagtggaaccttcaggcaccacgcactgcctcctccctgcccacggtcctggtttctccagatggggccttggccttggctaggtgttgatcaggagctgggagtgctgcgccccgcccaacttctccaaactccagccagggcacctcagtgaggcctcagccacctgcgccttatttgcttcctccttggaggccctcgtgtctgttcattcatcaaacagcagctggggcccccagcagacccccttccccaactttcccactggacactggaaccagtttcacaactggactggacaggacgaccaccttgtgccaggcgccagctatctcccctgaccagtgatgggtcctcattgcccgtgggccgtgagtgacccagttccaaatcccaaattagtgactctcttctccaatgggggttggattctccagaagcagaggcagacatagaatttgggtgcaaggtatttcggagggaaggtggaagaggtggggttggtgagggagaagcctggagtgtcggtggccggggtgcccccacctggctgaaacgcctggtctttgtgccctgcctggctcagcctccccaggcagactaccccatggcatccctggacaaggctgcccccaagaacgctgcccacagcccagccatgggccttcccttggggctcccgccccggctcacacctgctggccagcgtatttactccttgctggctgcaccctctcagcagtggctgtgtagaccataaccctgggaacacctgcggggagaagcgcccttggcctggcggcttgggggagacacctggggtgtcaggagggaaggaaggcaagcaggggtgaggcactgtgggacttttcctgctttctgggccagtggccacaggccacccagtgacatttctctctcagcgtctgctggggtggactctgcagcggctgcagccagcctggatgggctcctcgcacagctctgcttgagggtgaaggccatctagaaaccctcagtcccctctcagcctcagagctgatagcgctgcctgaccatcagcaagcttgtaatcagcaccacctccagcatgcctgctcctggatctccgtgaggctcccctgcctgtgtcacccaggggcctctaggggtgctctggagctgggagccactgtccagcacttcctgccctctccggcctctcttggctgtctgccaagcagtcactcagtctcctattgaccactcgttttgccgcaaggctgctggtttacgtgaaaatagagaaagccaaagagtttcctcacccctgtaagatttactggctcttctggcattgcacctgcctgagttccttggtggggcccctctttgagttcctttgggctgctgtaacaaagcaccatagcctgggcagctcgtaaacagtggaaatgcgttgctctttgttctggaggctgcaagtccaagattgaggcactggaagacctggtgcctggtgaggacctgcttcctggtccagagacagcaccttctctctgtgtcctgatgtggtggaagggcaaaggaactccctggggcccgttttatgtgggcactcatcccattcgtgacgcctctgccttcatgacctcatcacctaccagaggtccccaccttttcattcctcaccttggggatgaggacttcagtatgtgaatttcggggacataaatgtgtcatctatagaagggcccatctcttacacaaatgctgggtccccagtggcctgtgtcctagcaaatgagagccaccctgaaaaataaaatcctgtctccccaacgccagccctggcaaggcacccagaactctccggaatgcttgaaggcagggcctggcctttccatggggtccagggctgtggggtccctggcggtactgtgggcctgcagagcggggcatgtgggctgaagaccgtctccccaccatggtgggaagggacaaagggtggccctggcagatccggacgggcaggactgggtgtgtcccatgagagcacctccttcctggcctttcctgtggactttgtcccacaccacctgcctgggttccttcctttagtcacttccagctccaggcacagcagttggtgactccttggtgggagccgtgtcccacccggtcctgatactgccgtcttctctttcacagtcctccaggcttgggccagccttgggggcagcagagcttctggggtgagtgtcgagatcctgtgtcctgagagcggtagtcagggagagggctggtcggggcagggctgcccgggcaggacacaggatgcggccggccaggctggggccaaggtgttcagacctggactttgggctcgtgctttcttcatggttgcgccttgctcgctgtcccttggagtcttcatttggttttgctttttttgtttgtttgttttcacctaatttttgccagacttaagctagttttgctgccttttgaaactagtggaagaatcattttattcctggggataatttggggccttttgatcccaacgtgaagccctgcacatggctgcttcatcaggggaagggtcttttctgctttggaggaaaggctttggcaggcaggctgacctgggagtctccggagctcttggctctctgtagcatcctggggagctcagaccatggctgcagggctctggccatagcttgcaggccatctggttagtgctgccccccaaacccggccattcctctctagtccccagcaggtatagccagtgtccacatagacagcactgcctcagatctgggctgggaccacaacactcactcagggatcccagggaacatggcaccaggtttagtaggtttagtcgggcatatgcagtgtcccttacccaggtcaaggctcaggctgggcccatcttagctgcctgggacacccagtccttttatgaatctgccaggggaggagcagccaggcttgggctggggcctggatggacgtgacatcgggcactgtggcattgtgtgcctgtctctgtgttgcagctgacatgggctcattgctccttctccaagccctctgaggacatcaaaagcgtggacgcatcactttccaccatcttgctgcccactgtccctccatcctgaggcctcctaagcacatgtgtggggtggcaggcacactgctgatagctgtggatgcggccgtgacatccttcacccctgcccccatggcatgcatgatccattagggaggaccgtctgcacaaaggtaatccattgactcagacagggggttcatagaagaacaggtgagagtggcagggggggtattccttgaccagctgagggtcagccaagggcaggaaaggggctgggcaccctcagggaattgaaagaagctctctgtgcctgcagtgcggggagtgggcttggagaatatggcaagagctgaggctggagatgtaagcaggggccttaagtgttgtttaaggagcctgagtcttatctcctgggcaattgggagccactacatagtttaaagcagggcctaacatacatatgtttgaaatctttctctggctgaagtctcgaggatgaattggaagtagaggaccaactaaaaagttgttgcagacattaaggtggtgtcctgggttaggtgggaggtgatggagaggagaataggctagtgttgacatatacccaggaagcaaaaccattggggcatggtgcttaatgcttgattggattgatcacatagatgactatgaggaggactgacatatttcaatctatgaacgtggtatacccatccatttacttatttttaatttttaaaaaattttttttttttttgagacaggatctcactctgtttgtccaggctgaagtccagtggcaggatttcagctcactgcagcctcaacctcctgggctcaggtgattctcccaccttagcctcccgagtagctgggactacaagcacagatcaccacacctggctaattttttgcatttttgttttttagtagaaacagggtttcgctatgttgcccaggctagtctcaaacgcctggactccaacaatccacccaccttggcctcccggagtgctgggattataggctggggccactgtgctgaaccctgtccatttatttggatcttctttaatttctcccagcaatattttgtaacttcaagcatacgtttcccacttgtgcctaggtactttgttttccaatgcttgtaaatggtattgtatctttagttttattttccaattgttttttgctagtatatagaagtgcattttttggtatattaatcttgtatcctgtaaccttgataatgcatttattagttcatagtgttttttgcttcttttgttcttttctggtaaatgccttaggattttctttttctcccgactccccgccttcctcctcttctttttcttctgccttaggattttctttttcttctttctcctccttctcttcctcctcctcctcctcctcttctttcttctttcttcttcttcttctcttttttgtttttaaattgagacaggggctcactctgttgcccaggctggagtacagtgatgcaatcttaactcactgtagtctcaaactcctgggctcaagtgatcctcccacctcagcttcccaagtagccaggactacaggtgtgcaccatcatgcctggctaatttttatatgttttgtagagattgggtcttgctatgttgctcgggctggtcttgaactcctatcttcaagcgatcttctcacttcagcctccccacatgttgggattacaggcctgagctactgtgccaagctgaattttctacatgcatgattatgtcacatgtgaccataggtaattttacttcttccttttctatctgcttttttcccttgccttatttcctctggctgggacctccaataccgtttttaatagaaatgtgagagccacttcgtttgtttctgagtatagtgagaaagtttggtcttttaccattgcccagcttgaagtttcctatagtttatctataggtgatctttatcacgttgaggaagttctcttctctttctagtttgccgagagtttctattattcatggatgttgcattttgtcaaatatttttctgcatccattgagataaatatatacattttaccatttattctattaattgatgttctaatgctaaaataaaccttttatttcttgcatactttttcatgatgtgttatttgttttatatattgctggatttgatttgctaatattttattaaggattttatgtctatgtttatgcatgatattggcctgtagttttcttttcttgtaatatctttgtccagttttggtacagggtaaaacttgacttagaaaatgagctggccagtgtttctccttttttctgatgtggttaagattggtattattttattcttaagtgtttgatggaattcatcagtaacaccatctgggtgaggtattttctttgtagaaaggcttcaaattatgaattcaacaactttaatagatataagcttgttacattttatttttcttgtgtaaattttggcaagttgtgactttcagtagatgtttttccatttcatcaagatgtcaaatgtaatttcatgatgttcttactaatattcttgtattattcttctgatgtctgtagggtctgaagggatgtctcatcttttattcctgatattagtaatttgtggattttttttctttgatcaatctagccagagctttctcaatttttttttcttttcaaataaccaatctccattttattgattttcgtttttttctgctagtacatcaaattttcactctttcttatttcttctgcttacttgggtttcatttgttcttggtgttgttgttttctagattctcaaagtggaatcttaggtaatgattttagacctttcttctttcctaacatgaacactgagagctacagattttcctctaagcatcacactaaccttatctcacaaagaccggaaagttgcatttttatcatcacttagttcaaagtattttcttatgtctccttgattacttctttgatccctgagttatttaaatgtgttgcttaattttcaaatatttgggcattctttgtgtgtcttataccttgttgctattgatttctaattaagctctgttgtagttagagaacatattctgtataacttaaatctttttaattttatggaggcttaatttatggcctagcagatggactattttggaaaatgttcaatgtgcacctgaaaagaatatatattctgctgttgttgggcatagtgttctataaacatcagtttggataagatgattggtgttgctcagggctatcatattcttactaatttttggtttacttgttctgtgagttactgagatgagggtgtcataataaccgatcacaatcatgaatttgtctgtttatcctttcagttctatcagcttccttcattttttggattctttgtaattaggtacatacacatttagaattgttagatattcttgatgaattgacccttttttcatatgaaatatcctttttttttttttgagatggagtctcgctctgtcaaccaggctagagtgcagtggcgcaatctcagctcactgcaacctccgcctcctgggttcaagtgattctcctgcctcagcctcctgagtagctgggattacaggtgcccaccactgcgcctggctaatttttgtatttttagtagagacggggtttcaccatcttggccaggctggtctcaagctcctgaccttgtggtctgcccacctcagcctcccaaagtgctgggattacaggcgtgagccaacacgctggtccgtgaaatgtccctttttttattttgcaatattccctatactaaagtctactttgatgttaatatttttattcctgctttcttataattaatgcttgcattttataaatttttccattcttttacattgttttcattcttttacttttaacttttgtttatatttaaagtatatatcatatcaggcagacagcatattgtcatttcttgctttcttttcccctaagacgaagagtctcctgtcactcagcctggaatacagtggtaccatcagggctcactgcagcctcaaactcctagattcaagcaatcctcccatctcagcctcccaagtagctaggactacaggcatgtggcaccacacgtggctaagtttttaacttttttttttctttttttgagacagtcttggtctgtcacccaggctggagtgcagtggcatgatctcggctcactgcaacctccacctccctggttcaagtgattctcctgcctcagcctcccaagtagctgggactacaggcgcccgccaccacgcccggctaattttttttttttttagtagagatggggcttcactgtgttagccaggatggtcttgatctcctgacctcgtgatctgcctgtctcggccacccaaagtgctggggttacaggcatgagccactgcacccggcctgtctttttgtttttttgagatgaagtctcactgtgtcacccaggctagtgtgcagtggcatgaactctgctcactacaacctccacttcccaggttcaagtgattctcatgcctcagcctcctgagtagctgggattacaggtgcgtgccactacgcccagctgtgtttttttgtttgtttgtttttgtttttgttttttttcggtagttttagtagagatggggatttccctatgttggttaggctggtctcgaactcctgaccccaaatgatccacccacctcggcctcacaaagttctggggttacaggcatgagacaccgtgcctggccaatagtctttgtcttttaactggattgtttacctcagtcacatttaatgtaatggttgatatggttgggtttgaacctaccatctgctatttgtttcctattcatctcctctgttctttgtactcattttccctcctctttttctgccttcttttggattagttgactattttgtatttcacttatctcttctagactattatacttccttgttttatcatttcattagctgcaatagggtttatgatatgcatatttaacttatttatgattgattggatgtaggaggaatggggggagaaagattccaaaatgacactgacatatgtggcctgggtaacaagaggaaccactctctgagatggagactttgaaggaagattagtttggggagtgatgaaagggctggatgatgtggtcagttttggacaagttgcatttaaagtgcttctgaggcatccaagaggagatacctggtagacatttctttacaaggtccagagctcagggcagtgtccggggctggagctggctctaggggtgaagggcagaggggtgactgttgaatgaatgggaacaaggtagtctgtggatgcagaacgtgcgatgggacaggaagagtccaggaccaaaccctgaggagccccaacattttagggacccaaatgcaggacagtagagatgaaaggagaggccagcgaaggagcaaaacaaggaagcgtgtgtcatggaggccacacgaggaagtggctttgtggttacttctgggacattggcagaaggatgtttcagggcaaagtgcaagggggcctcaaagatcatcttaagttctgttccttcactttcacggtgggtgcattggtgttcatttagatctactcaacatcttattaaaacattttttaaaaaggactagggactgggaggccgaggcgggcggatcatgaggtgaggagatcgagaccgtcctggctagcacagtgaaaccccgtctctactaaaaaaaaaaattagccgggtgtggtggcgggcgcctgtagtcccagctactcgggaggccgaggcaggagaatggcgtgaacccgggaggcggagcttgaagtgagtggagatcacgccactgcactccagcctgggcgacagagcgagactctgtctcaaaaaaaaaaaaaaaaaaaaaggactagggacttactgacttggccaaaggctgctggtgggtgcgtggaggtgctgcctgtcagctgtgctctgggctctagggacatgggagtccaaagggctctcacctcctcagtgagaggttctggtgggctgaccatggtgggatccagatttcagcaggtggaccccgagggggtgtgaggaaatggactctgtgagtgggaacttctctttcagaggaatttgcaagactggcctgagccgcacacggctcttcagcagggcttggcagccagcggggcctcgggaggaggcaaacagctgatcaaatccgggcttctccagaggaagaaggggaagggcaggtctggggaggtcagagcgtgggtgagaaccgtggccatgggtgggatccacatcccagcctgcagggcctcctggtgatggttctccagaattctgcgattggagctgtgctcacagagtcactgtccccgacctcccaggggcgcggacataacccagcctcagctgcagacagcagagactctgcacaactgcagaagctgagcaatcagcctcatcagtggcaattcctggaactccaacctcaactgtaacatgagctgtggcagaccttcagtaaccccagacgaggagtgaggcagagcctgatagctcagggaccagctgggatgctcagtaaacaagagctccagaagatacgcggaacaggagaaggtgaagtgtggggacagcaggcgctgcaggccacccagaaggaggaggagaggggacaagaaacactgaccaggccttcaagatgaggagtgagcagagaggacagcagaacatgggaaaacctacctggcactatgagggtggagaggggagtgttggagggtgtgcatttgagtgcaagtgtgtaaaagaggccctggacaaggagtgaagaatctcatcagatggttaaagtgagggagcaccaagtaaaccataatgaaccataagtcatgtggaccccaaccctaatgctaatcataaacctaaacctcgtgtggcctggaaccctaacctgaacccaaatcctaaccataaccctaaccataaccataaatcatgtggactccaaccctaatgctaaccataaccctaaaattcaggcagaaccgaacctaactcgaacccaaaccctaacgaaaactctaaccctaaccctaactcaattcaaaccttaaccctaaacctaaccataacactaactccaccctattccgaaccttaaagctaattaacaatgcctcatatggacccgaaccctaaccctaaccgaaaccctaactctaaccctaaccctaactcaacccaaaccttaaccctaaccataacactaactccaactacaaccataaccctaaccaaaactctaaccctaaccctaactcaacccaaaccttacccctaaccataacactaactccaacaaccataaccctaaccgaaactctaaccctaaccctaactcaacccaaaccttaaccctaaccataacaccaactacaaccctaaccatatcccgagccctaaacctaattaacaatgcctcatgtgggccctaacgctaaccctaaccatgcctcatatggacccgaaccctaacccctaattccaaccctaaccctaagcctaaccctaacactaaccctagccaaaaccctagcactaaccctaactccaacccaaaccctaatcctaagtctcatgttgaccataacctggctcaaaccctaacctgaaccctaaccctaagccttgtattgaccacagcctggctctaaccctaaccctgactctagtcctcactgtaattctacctctagccttaattctaaccctaactccaatcctaaccctaatccaaatgcaccctctgatcgcaaacaactcttcagccaatgtcagacctcaccttaaccgtcaccttcacgatcaccattccagttctcccttcagacttcccagggacttgagccagcccctggcccccaggccttggtttccccacctgtgcagcatggatttggggctgagggtacaaagactggcacccacctgagccgttggaacaggcctgcccctggtcccgaggaggactctgctctcccggttctccccttgcccatgtggaagggggctcatccccccagcatgggtgcttcctgcctggtgtccatctctgtgtgagttcctttagggagggaccgggtaggcgcagttggcatggcaccgccatgcccctggctcgggcttatgcgggctgacagtcctgtccctccacccagaggcccctccaatgatgtagcttatcagagtgtgtgtgtatgtgcacatgtgcatgtgtgtatgttgtatgtgtatatatctatgtatgtatatgtagtatctatatatatgtgtatgtgtatatatgtatatatgtgtgcatatatatgcatttgtgtgtgcttgtgtgtatgcatgtttatgtgtgtatttgtatatgtatctatgtgtgtttatatgcgagtgtgcatgtgtgtatgcagtgcttgtgtgatgtgtctgtttttatgtgtgtgcatgtgtatagtatatgtgcatgtgtgtatgtttacatgtgtctgtgtgtgtatgtatatgcctgtgcttgtgtgtgtgtgtgtgtacacatacacgtggacaggcgagggagaagctgtattgcaccaccacccaggcccttcgagcccaagtgcagtctccccagggctcacgaggccccagcacgctgccctcctgctcagatggtgcccaaaagccccttgccgagtcctctctaagcctcatgtagacccgtgagtcccttctccgtctgtttcccctgcctgtgatgcttagggatcgttcatttcagggccagtgaggaaaccccatcttctcctgcactgccgtggagttaaaggagaaggccacaacacactcccacgttttctacagactagcagtggggtgtttggccacctttggttttgaccttttattttggaaatgttcagactgaaataagcagaagtgtaataaccccttgtgcccatcaccccacctttggcaagagccaaagagtcacaactgattgtgcttcaccacactccatctatgggctcaaaatgttttgagataagtgccagacatcatatccttctatctacaaaaaatgccacatgaataaaagataaggacttttaaaaacacatgaccacagtaagcattatcacatctagccaagaaatgaacctttccttaattgcaacaaacaggagttaacttttacattttctctacttctacaattttttagagaacagtaaggtagactttattcaacggaggctaccacaatggagttttgcagcagggaagggagatgaggctcaattcccaccttatacgtttttaaaaagagcttatttggttgaattggatctgaggagtctggctgcaggccaaaatcctctgtgtgatcattcaggcccaaccgcagttgttgccagcaggccccacaggagaagcagccctcctgccccagacggcactttccacccttagcctcctccacggttccccaggccagatccttttgtttgagccttctgtttcgcctgcttggtagtgagatcatctccccatctgcctgatgtcatccagggggcaaaaatgggacgtagaggagccggcacctttttccttctgtttgcctcttgcctgcactattgcagtcgtgaatacaggcctgagggtgaccttccattgggctcgtggtcccaacctcgacagcagtggctccacaggatgcatacgaggtccccgcggtcccggccgacatacctgttgggttcttagttggcagcttcctcctccttctctctattcccctcctaggtctcttgccctgtgcagcttcctgcagactggacttgcaaagtccagcctgtatggctggagttcccatgcctgccaatctcctgtcgactgcgagtcagctccgatacttcaccagattcaggtgagagttttggttttttgacaagcccacttcatcagcagggcatgcatttctgccaggggtctcatgatatctggtggtctctttgtgaggccagcagccaccaatgatcacgaatgtggcaggaagctgccaagagaccccccagtgggtgattcctgcctcctgctgtcatgcaattccctcctgaagggtggctggacttactcacttataacaaacaatacagtaaaaaaaaaaaaaaaaaaaaaagtgatgtgttgtctcttccgtgattaggttgaaagagaccatggcatctgtcttggatgcatactctctctcgctggctctggggtagccagatgccatgctgtgtgctgccctgtgaagaggcatggccagtaaggaactgagggcaggaaccagggaagatttggggtcctcaggccagctgcccattgggaatgaaactctaccaacagccacctgggggagctggaagtgaatctcatcttagctgagccttctgatgagactgcagccccagctgacacctggattgcagactcatgaaagacctgaaactctaccaacagccacctgggggagctggaagtgaatctcctcgtagctgagccttctgatgagactgcagccccggctgacacctggattgcagactcatgaaagacctgaaactctaccaacagccacctgggggagctggaagtgaatctcctcgtagctgagccttctgatgagactgcagccccggctgacacctggattgcagactcatgaaagaccctgagcagaggacccagtttggcagagcccgaattcctgacccacaggaactgggagataaaactctgtggttttaatcttctcattttagaggtaatttttttgtgtagcaataggtagctgacaatgcacagctaaaataatagataattaaccctaatgctagtttcattcatccatcagggtttgcaaagtagtgatattctacttctgtcttccttcattatttattagcagaaatgtatctataaaaagaagtgttccttcattaactctttggtcatgttgaggtacagtttgcataggaaaggcagggcaaatgcttgattctttcccttcctttcctcatttataaaataatgaactgttttcctggcatctttcaacaatgactaatgagtttttaaagtataattacaagttcatgagtttaaacattttttgatgttcccattaacattattatccttattgatattcagatcttcctgtctttgtccagtgccagcctatttgatttaactcctgagcccctttggcactgccctaataatctttgacagctactttgttctctggcataagaagacattccagaattacattagacatttcctaacccagattggacagcatacacttctctccaagagcccctcttcctcttcaagagaaatggtacttagagaccacagtctgggtgttaggtgtgcttgtggttactggatttgtcgtcatttttaggccttgtcagtggacagaactaaggcttttttttttgaaagacacattatgagtacaaatggatactttctatttaaattcggatttacatagtttttacttaatcttattgataatatatctgcatctcctttctcccacaccaaaaatctcaaacaatacccaacatagttattcatttgttttatcctgtaacacacacaatattttcaaaatgactttaccaacactaccatcaacagtatataaccactgaaaatagtttaaaattatttttagatacttttaaagtccttgggttgtgtcgacgtacagacaaaacagtgttttaaaattatttggaaaatgattacttaaaataatgaaaacttcttttgccattctttcttgttgtcaggctatatggatatacatccaaatgactggattttaaaatcacttggaagagtttggtaggttcatattgtcaacccataatgcaagtcagttagtttcattttgctttcaattttaagaattccttttacaagttaatttaattaaattaagtaattacacaaacatttgacatgagtctaaatccaaatctagaaaccaagatatggtcacagaagtccgtccctatccccatcccatttccacctgtttcctacaggtaacagtttaatttaaagcaaattttgtggcttatctttccatttgtaaaacatacagctgatggctccatctaaaaacacatcaattgtctatatgtacataaacatgctttttttcatttacaaatacattctggagatgaccatatgacagtgtgtagaaatatttctccctcctctttgcaagtgctcagtgtcctgtggtgtgaacacgcttcattcaacctgggcccttgggagagatgctgagtggttcccgggctgtccccactccacaccgtggcagtgaagagctgctgaagtacatgcttcatagtcctgcgtctctctgtgagtacattcctagaagtggggttattgggtcaaagagtaaatgcatctctaatttggctaagatattgccaaatccacctgcctgggggtttgtgccaccttagagatcagtgatcaatgggtgatatccgaggacgtctttctattgtggtcagactcttggattttgacctgactaatggaggagaaatggtgttgcagtgaacttttgatttgtgtttctctttttatgatcgttttgagcttaatttgtgtttctctttttatgatcgttttgagcatcgtttcgtatctttaaggagcaatttacatctcctctgtgagcgtctactcccatctctatcagcaggcgtcttgcctggctccggaggaagtgtctctgaaggctggtggtcccaggatagggcaaaagaacgggagtgagaactctccacacagtgcttcttctggggttaaggaccctctgcctcagtggctcctgggcgtgattaaacttgccatttcctgggcccatcctagacaggctgctgcaagccagccaggccgggatcctgctgccccggggaggacgtggggaaaatccctgctggagggactgccccttccttgtccagccactgggtgtttatggttcagtttagggcggggatgacagcacacgacacacactccg

SEQ ID NO: 14804 - DNA, 34977 bp, Human; identical to SEQ ID NO: 14803

SEQ ID NO: 14805 - DNA, 34977 bp, Human; identical to SEQ ID NO: 14803

SEQ ID NO: 14806 - DNA, 34977 bp, Human; identical to SEQ ID NO: 14803

SEQ ID NO: 14807 - DNA, 34977 bp, Human; identical to SEQ ID NO: 14803

SEQ ID NO: 14808 - DNA, 34977 bp, Human; identical to SEQ ID NO: 14803

SEQ ID NO: 14809 - DNA, 14185 bp, Human
tgtggggccccactccacagccccaggtttgctgctgcgctgtctgcttggagattaaaatgaaacgtgacttctaggtgagacgaatctgtgtgtctttgcattcctgagaccctcataaatcgattctgcagcttctccggtggatgagtcgtgcccagccacaccctagcaaaataccgtgggtcacacaccacctgcatttctgagttccggttaccatctcactctctctccacgttattttacgttttctgtaaatgaatatttcctctccctgcgtcaaggtcacacagtggtagaacaactgcgaccaccaacctatgttcagtgtacaacctcctgagacctgggaggatccccttgaactccgccttagacttatacattcagaaattcgggcggtgagactcagacatctgcattgtaaccagctctcacaggcgatttttagctggcttaagtctgagaattactgcccatgattatagtaaatgtatcctttgctggccttttggagggagttccgaaaaaaaactgccaatacagaggctccctaaaatcttaagtcatttggaaagctcatttgaaggcttttgatgttaatatcagatgaaatatgtagttggggccaatatttaggattgttcaggtaagaaaggtgcttgaagagttgcctttcctctggtgtccttgttacacacataactgggtgtgtttggaaaccagcaacaccgttgcccgtatgttgatttgttggtgatcttgacttgagcactattagcatgctgttgtggtgaggcaggttttcttccagaccgggggacggtctaggtctggaggctgaactttatgtaattcagggggtcctttaaaagaaaatctaaaatatagttttgcatattttacaaaaatgggactgacgaatgcatttccttggaagggaccctgaaccttaattttctgtgggataaagctgcctctgtccacagcaggtcacacttaagcccctcctccccagtaactgagtggtgctgggattatgcaggctgaggcctctccacacattttcatgaagtggttgctcaccctctaagtgagacgtaaagactgcagtgttcggagccctttgggaaataaatgtggtgaaaagaaaggagggacgaggtttaaaggaaggggaaatggaggttaaggaaaaatggctagaaggtgtgttctggaacaatcagaaacctgaggcaacttgaaatgggggaaaaaggcaagaatggagagatgttaccagaacgaaatctagtttgagcagagaaaaagactggctttctagtaggcttgtaaaatgctttcctgcagcaagctacttgtgtccatagatcttctctggagggttaaggtagccttttgtaaaccaaaggaatctataatatctatatttgaaataattaatgagttggaaaagccacccagcgtagaagagtcaatccaagctttaattctgccatctcagaatggtgataaaccatttctcccccatcatctaaatggaatatattgtgcttatagatattttctttaaaagaaaaaaaagaatatattggaagggactggcaggggtcactttccctgctaacttggtgtttgtagattaaattcttaatgttactgggatgactcagtctctatgttattaatctcatcagccttaactaaggcttttggaaagggtgtaagtttcagtaaccctctgggtttacctgggctttcttcagggctggggaagggcaggtaagtagcctgctgtagggaggatggagcaggacacatgtgttaaggatatattctgatgccaccagtctgtaaccttgaaacttacatcttggctttaggtcctctgaagtataaaactagtgatgttgctgttattaacaagtcagttttgccttcagtcttctaacttgttttctgtttccttcataattaaaatgctcacttgataatactgccttcctgtaatgattgatgttcctcattctaccagcgtcacctggaggacagtgttggtaagcttgaagaaaaatcgtgcatactggaaacaatggtcttgcctcaaacctgttgagaacttctcttccctgcttctctccataatttgaagaagcaagaaatgtttctgaagtgaagcataaaggagtatcttcaagctctctctatctcatacctaccagcttgcatagagtataatagtgggaagaaatattgtgaaagattctagaacctaagtcctttctaggctaggcaattctaggctacacaattcgtagtctctgtaaataccatttgataactgaaataaacctataaagtgggattaaatgttagtccagaagactaagtgatttaaggaaagagggaaaataaccagatagatttctggtggatattcatagacagacataatttcatcatgtattatggccctaagtcatctattttatattaaaacatagatggtaactgtaaagttatcaaatgtaaaaattactgggctagcattgtgttttaacactgatacaccagttgattacagtgttgacagaaaacgggcagaaacacgtttaaagtacctgcagaatatatatatagaaatcttttttttttaatcagtgttgaccaggttggcctcgaacgtgtagcctcacctccccgagtgccagggcaaccggcctgagccacagcggctccctagaaatcttaagtgcaggaaacaaaactacagtttaaggaaacaggagtcggagaggaggggcatttggcccaaccactggcaaaaggctgttgttgcaacaactgtgagattctgggaagtggggaaatgagcaggtgctgtgtaaaagtgcacagctgactgccccaggtgagacagatcagtgtcacagagagtaggaggattttgaggtgtgattagtatttttttttttttcttaaagagatggtctcgttctggaacccaggctggagtgcagtcgtggcacgatcataattcactgtagccttgagctcctgggctcaagtgaacctcctgagcagctgggactacagatgcatgccaccgtgcccagctaattattaaattgtatagacaggatctctatatggtacccaagttggtctcaaactcctggcctcaagcagtcctcctgcctcagcctattaaagtgctgggattacaggagtgagctaccacacccaaccagtaggaaatcttaaagccacattgatactacagtttgaaatatgtaaaaactagggagctatgtttcccactaactgggcatttaaaatgtaatcgtctttgaggaaggaagaaggccctggattattcttgtaatagtttgaatttaaaaggtcctttcaggtgggcaaacagcttacgtggctttcttgcactgaaatagaaactgtagtccccatgtgggtttgggtccctgaattatccccagaagaacttccacagtccggaactgactcccttaaagaaaccaaaaatgtattttctttggtggggattttctttagttggtctttgtctgggattttatatcagtgacagactgtagcgtcacacttttccagaaatacggtttcggagagggtacccctaacgttttatgtgtgtgtgtgttacatttagcaagtttatataacatattttacttttttttttttttttttttttgagacagtttcgctcttgttgcccaggctggagtacaatggagcaatctcggctctctgcaacctctgcctcccgggttcaagcaattctcctgcctcagcctcccaagtagctgggattacaggcatgcaccaccatgccatgcccggctaattttgtatttttagtagagatggggtttctccatgttggtcaggctggtcttgaacacccgacctcaggttatccacctgcctcggcctcccaaagtactgggattacaggcgtgagccactgcgcttggttagaacttatttaactttttaggcacttggtaaacggtagctgttagtccatgtgtacttttttttttggtgggggggggagtcatgctctgtcacccaggctggagtgcagtggcaggatcttggttcactgcaagctccgcctcctgggttcacgccattctcctgtgtcagcctcccaagtagctgggactacaggtgcccgccaccttccatgtgtacattcttgtttaacaattcaggataggtactgttactcccctttacaaatgagactttcagaggttgattttctcatggtcaaacagctagtaagttgtgaattcaagattcaaactcaaatttagagctctcattttaaccactatgtaacaatgccccatgaggcaaagggataatatgtctagtatacattctggtatattaaccattgtcagcactggtgactgaaatccaagaactcttcataagtgggcttactaaacaaataattttatctgttgggtgcaagtcatttttttttttccaaatacgattaagaacaatctgccatttatgggttttagctacaacagagaaacataagagggaaactcacatatctggattttgcttgttctgaaggcttggaggccttttttttttttttttttttttttttttttttttttttgcttaacaaagtattgaatttgagtttctcctgagttaagaagtgcaggactatgttacattttatttggggtattttaagaaattatttcatattcttggcaccagttgtttctccatattgcctttaatgtatttttctccctgcaccctttagtatatttttatgcaggccccaaaatttctgtctctaggttgctggtaaaattcctcctagtgtccaagtggaggcagcttgtcttctgtcccagcattttggtgctcctcccgcccctactcctggctgcagtggcattcccttctgcggtggtgagtgttagcacttccaatgatccgaacctggcacagcttctgaagccttcaattcggatgcctctagggacagtagcatgcagtaatgccattcagatggtgttgtatttaatccttgccaatccccatgaaaatgttcagttatgtcaaaagcaaggcaaaaacagtctcttggctatacaagggtagctgttttatttgactaaaatttagcttagagtggatgttacttacccgaacttgcctgctctgagcttgaagtttagcctatttgtggtcttacagaattgcagcctcatcctggtgaggataaggggctcagcctgaccctggctggtgatgttcttgcacagtggcctgtaggacttggtctgttggtggatatctttccagcttggggcaggccaggcaagatcctcacttcctaagcattaacttgggaaagagctcagcaagctttcatccctctagctcattttttgtttttttgagacagagtcttgctctgtcgcccaagctggagtgcagtggcacagtcctggctcactgcaacttccacctcctgggttcgagcgattgtcatgtcccacccaagtagctgggattacaggtgcacgccaccatgcccagctaatttttgtatttttagtagagatggggtttctctatattgactgggttggtgtcgtactccctggcctcaagtgatccgcctgccttggcctcccaaagtgctgggattacaggtgtgagccatcacacctggcccctcaaaccctcaaactgacttttctcacacagacacacacacatacacgtacacacacacttctgccaaagaagcttaaaggttttatgatgtggttatgtttacttaatcatgagaatcatttactcatatcaaaagcaagctggttgatagcatgtaggtgtgggtagctataaaggatgagcccatagcatgtgtggagctgtgaaggatggcagcatattcgagtgaggtagcattacccctaacttaggcagctatggcctggcagctcgggggtggcatttttgtttgctcagtgttacttttgatgttggatgtttcccagattgagaactttaaattttcctaaatagtccctgtactgtttttggcagtggatctatttttactcacacacatagttttttgccttgtgagtagtgggtggaggcccttaggggtttttgggtaaatgaatagtgtcataggaagataagtgaatgatcagcaggccaggtcatttttgacatttagtaatgttgggggtagtcctggagcagagaaaatgtgtgaagtgagtgccctggggtggggactaggtgtagcccaaggctgtttggtcaggacgtgagtaaaactggctgacagggaagtccaatccttaaaagaaatggagaggagggcctttgtgcatgggaagagcccatcagtttaaggttgtccttcaggaagggtgtaagtaggattacagagggtgggaaggcaggcaggacacctagaaagcagagaggctgtgagcaggggtggcgaaacccctggtttgtggcccggtgaagactcagtgcctagtgtggctacactgagggaaggtgccgtgtggcagaaatgactgttgtaatcttggtgttagagcggaaagaggctgaaaactattgtctaggcctgtctgtaaaattctgtcttgttgttgcttcatgttcctgatttgtggagatgcagcaaatgtgatttcattagattttgcagatgatcttaggtagcatggtcggggcctggagagcatccattactctgtattgccacccggtgtttgcctctcagtacagtttatgactgaacttttcattagttctcctggctcctgtatttcggtatttgaagtgttgggaactggtgctaagtatcatccatcaagattggctatccatctttttgttttaatggactgtctgattttacatgggtctataattttccagtctgggaaaaactcagttttctttagttatctggtcaagtagtaagccatcttcatttcatgtttccttttgttaactgaattataacccaggagtattaaaaaatactgtatttaaatgtatccagttatttcctagttaggctctggctggggtattaggaacaatatttgcttgctgagatatgttagtcaccctcagctaatgctgatagtgattcattcagactggcaggcaaccagatgatttttacataaacactaatactcccagtaaatgatttttcttgtgaaggtgtcatcataaatactgcccagtagccttttttggcagcttattcctgatggagaaagaatatgcttacagatacacccaaacttcacgttagtaggaagccctgccacaccttttattggtgcacaggaaaaacgaaatcatggaacattggagctgaaggaggccttggagatcatttgggctaatcctgcttattttactttggatgtccaaaaaggttgtgatttgtttaaggtcacatagctagctcagactaaacttcagatgtcttgggtttaataattataccgccttttgtgttatgcaagcattctgtattatacatacatgtatttcagatttgcactcactttaaatgatatactctgggaagttaccttggtgtatctttgccagtttcacagaagcagctttgttagtcacaggaggaagtatattgtgactccttatggatattatttgtattttaatgccaaatggccttagtttaattactacaagatgaaaggagctctccaaattctgttgttgccttatgctttgttttattgaatattgctctagaaacgcaagtcattctagaggattcaagcattctgaaatttatcagaatatttgggatggaattttgattcagaagtgttgttcgttaaaagactaagtagttactcatctttttgtagttcataagtgtgatgattgggttttgacatgcaggtgtgagatgtgccaccctcaaaccttgttacaacatagacatgtgaccctctgatgtgggcaaaaaaagactaagttattaaatatttacaaagtctctattttccgtaagaaaatgtatgtaagtgtttaaaggcacttactggaggaggaaactagtggggttataggtgtttagctggatttaaggggagcatggattgtagattcatggtagactggggcagatcacagtgagaggtatggagactactaatgaatatgtgaggatgaataatgagaaccctggcttgaccagagtggaggcagcacccctggggaatggtcaggatagctgttagccaaagaccacactgaagaaagaagtgggtaggcaaaggagagacttaatcctgtgttaagggtttgtagcagaagagtaggggtcctggggacagggaaatggagaaattaagagtgagctggtatttttattttgtctggggcttgggggtagggaggactcagacaattgcttgttttactttgtgagaacttggcacgttttctgatttttacctgtaataatgattacacttgctgcttatgtccttgaaccactaattccccaaataaaccatcattgttcatgatttctgatactccactgctcagtcttctcaatccattttaagtgtgtctatttgaatatgctattgataactttccccaatgaacttggccttttccctctggaggttctgtccttacagattggtttaagtaataccttttttgtttagtgttttatggtttcctaagtgctttgctttcttttttttcattattgaaattaaagaccttttggataagcagagactgatttaataaaattaaagacctttaccagtaggtcatattaaggaatccctctactttagacgacacaccatcttttaagggcttgtgaaatgtcctgggtcaatttaggaagtcattttctttgcttgggcccagaccaactctgttagcaactctgttaggaactcttgttaggaaactctgttagtttcctagggggtgctgaacctagtacgacaaactggatagtttaaaataataaatgtattctctcatagttctggacgctagaagtttgaaagtgaggtgtaggcaggccacgctccctctgaaggctctagggaagaatccttcctaggcactctcccagcttctggtggcttctggcaacccttggtgttccttggcttgtagatgcgtcactccagtctttgcctccactgtcacatggcattcttcctgtgtgtgtgtcaaaatctcactatccttataaggacacctgtaattgcacttagggcacaccctaatgtccagtatgacttcatcttaactaattacatctgcaaagaccctatttccaaataagctcacattcacaggaacctagggtcagaacttcagcgtatcttttggcgggggatacagttcaaccactgcaaagtctaataatgctcttcctactaactgcatagctagttcacttgtagttggcatcatggagaactaagggaagttaaagcttgtgaaatttaactcttccacttaaaataattgatgcttccatccttgatgaccagagtttcctgtgaggtaggtcagagtacaacttgctgctgagtagctgtgcttcctttcactaggagctgggggtactttcatgtcacttatgaattgttcttcattttggtttgggagagggctgggagtatcagttagggttccatgtgtagccacacagggcgaagctctggccactggatctgtgtgatgttccatctgatctgtgaagccccaccatctgttaatgtgtatttgaggagtggttggttctttccagagtataaagctggaagcagagtctggaacacttccagtctgttgtctttgaacatttgacaaagggaccgtacgatcttactgttcagagtatctttttttttttttttttttcttttgagacggaggcttgctctgtcgctagctaggctggagtgcagtggcacgatctgggctcactgcaacctccgggttcaagagtttctcttgcctcagcctcccaagtagctgggactacaagcgcgtgccaccacgcccagctaatttttgtatttttagtagagatggggtttcaccatgttggccagaatggtctcgatctcttgacctcatgatctgcccgcccttggcctcctgaagtgctgggattacaggcataagccatcgcgcccggcctgttcagagtatcttttgcagaatggctgaagctcgaggttttcttcttcaccattatgtactgctgctgtacaaccttttcataattatccttagtcccattcctctaccaaggtgaaagcaacatcttatcagacccgaattatgaatttctcaagcccctatgattttctgttttgggtgccaagtatttatctcttctgttagactatagtctttcttcacatagggttcatgtctatattggttttatccatgggtggtttttattctccagagtgactgacctgttcgtaattccgttcttgagaaggattgttgattatgttgaagggaaggcttcttaccaagattttcagattttgctttcaatgtttatctttttggggttttgcaggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatattatctctgtttggtcttgatttttcccccctcgaggaactgtttaaccagtcacaaattgtggtttgaatctctcaaacatggaagcatttgtagtacattatccaagttttcctcccctcattacattacatattttgcagcacacacataggattcatagattttaaatagttttctgtgaacccagctaacatagcctctctgatcaattttcctgataactggtgctttttaatgagcctcgcagaacaaaatgcagtcttccacagtatagcacctctgaaacattgtgggctctgtttaacttgagagtgtatttaacactgaaggtaaatacggagcttatacacgtcctcaagttttcttaataagatactaggggcacaacttgcacccctgaaatctttagtgattattgttaagcatttagtattctttaaaatagaaaagcaaacctcattgagttaaaaagcctaacctaccccttaaacacttgcttaaccccaatgtgtctctcgagcctcagcatcactggctgactgttcttgagtgaggtggtttccagctcctcacgatttttatcacctccagagtggcacctaggaatgaacgtttgttaggtgagttggttcagttacacagaacccttaaacgcctttttctatttgtttgtttttttgagatggagtctcgctgtgtcatccaggctggagtgcagtggcatgatctcggctcactgcagcttccacctcccaggttccagccattctcatgcctcagcctcctgagtaggtgggattacagacgccaccaccacaccaggctaatttttgtatttttagtagagatgaggttttgagtgttggccaggctgctctcaaactcctgacttcatgtgatccacccaccttggcctcccaaagagctgggattacaagcgtgagccaccgtgcccagccttaaacaccttcttgactaaagtttggcattagactgatggaaatggccatgacacaatctctgcccttgaatttatattgtggagcacataacttgtaagcatgtaagtttaacctgtttcttattctgaagtagagtatgagccccgccccccatgccggggccgatgaatacggctcaggaagcctgtttcaagttgacctaattttaagataaagtggttattgagtttcacttcagttagtaggtcaggtatttgaaagtcaacaagctttatatggctaatacttgcttttgataagcacgtagacaaaatgttgctgggccatggtggcgtgcgcctgtagtcccagctgcttgggaggatggagcccgggaggtcgaggctgcggtgagccgtgattgctccactgtaccccagcctgggagataggaagacctttttttttctctgtctctgtctctgatagcaagacctctctctctctctcttttctctctctgtctctctctctctcacacacacacacaaagggctcttacattttctttttttgtttgagatgggagtctcactcttgtcacccaggctggagtgcaatggcacgatctcagctcactgcaacctttgcctcccaggttcaagtgattctcctgcctcagcctcctgagtagctgggattacaggcacccactgtcgtgcccggctaattttggtatttttgtggagatggggtttcaccatgttggccaggctggtcttgaactcctgacctcaagtgatcctcccacctcagcctctcaaagtgctgggattacaggcatgagccactgtgcccggtcgcttttacatttgaaatgtcctttgcagttgctaaagcattcacatttacgtttcacagctgtcttctgaaaggttttgtcccactttacagatgaggaagctaaagtgcaaaggttgtggatctctggaatttatacagctggtaagctagaggacagcttccacccaagatttattcagaattttaacggccctc

SEQ ID NO: 14810 - DNA, 174170 bp, Human
  misc_feature (1)...(174170): n = A,T,C or G
taccttcataaaaggatctttgacttggtaagtgtgtgcgatgcatacttttcatgttacaccacaagtgccacttagcaactccactagacagggcagtgtttcagcatggggtggggtgccccctgacaggcttttaaaaggcccggatgccaatgcacattccaacactatccacaaaaaggagactggagcagtgctcttccctgcattgggcaaggagactctccctccctgcctaaccacttgcctgccctgttttgtgggagaattacaagtaaatgctacagaggcagtggagaaaaaagggtgttttaattcctctccagagtttcctttatttgatgtatgttgcatcctttaaacaagttgtgcaaaatggctgcagggtagattggctctcccttttaaagctctccatccggctgggtttatttgtaaatactgcatctatccttcttagtgttttaggactggctggaaagactcttcttcctgtaggttgggtcagtgtgagagatctaaaaaatcattttcccttaaaattactgtattttaataaaaggattgggcaggggctggaatgagagaaaactggtccttcaaaatgtaaaactgtcatacttaaaccagtttacaaaatatgcgtttaattatgtggtgggatgtgtgtaggtgtatgatgagagaggcaaccaacatggctatttggggtgcaaggatgtgggaacaggcaagtaattttcacattggactttcatcctagggagctgggttctagtcacagctctgagctgtgtgaccttgggtaggtctcatctccccggggttttgtttcaccagttgaacagtatgaggatgagtcacagctaacatttgttccatgatatttacccagcaccatacaagtgttatttctgtcctcccagttaacactgacgtgggtagtattatatgcccattttacagatgaggaaactgaagcctgaagaagttaaatacttatcccagaacacacagctggtaagtggcagacctggaattggaatctagttcagtttgattccccaacccatgctcttgaccactatactgttttttcaagtccagatctgaaatctcattttctgtgtggctgtgtgtttgggacaggggtaaccaattcctgactactctatatgctgcatagaacctggagaggatttttcaaagtaaatgaatctcgaaagctggattgcagagcaaacgagtgcagtcaattcagccaggggcttgcaagagggagaaagagaaaaagactgtggaatggaaagtttcccaacccaagcctttcccaaggggtagccattctctgttctacagtttagggcttgcatgtgctttttctggagtggaaaaatacataagttataaggaatttaacagacagaaaggcgcacagaggaatttaaagtgtgggctggggggcgaggcggtgggcgggaggcgagcgggcgcaggcggaacaccgttttccaagctaagccgccgcaaataaaaaggcgtaaagggagagaagttggtgctcaacgtgagccaggagcagcgtcccggctcctcccctgctcattttaaaagcacttcttgtattgtttttaaggtgagaaataggaaagaaaacgccggcttgtgcgctcgctgcctgcctctctggctgtctgcttttgcagggctgctgggagtttttaagctctgtgagaatcctgggagttggtgatgtcagactagttgggtcatttgaaggttagcagcccgggtagggttcaccgaaagttcactcgcatatattaggcaattcaatctttcattctgtgtgacagaagtagtaggaagtgagctgttcagaggcaggagggtctattctttgccaaaggggggaccagaattcccccatgcgagctgtttgaggactgggatgccgagaacgcgagcgatccgagcagggtttgtctgggcaccgtcggggtaggatccggaacgcattcggaaggctttttgcaagcatttacttggaaggagaacttgggatctttctgggaaccccccgccccggctggattggccgagcaagcctggaaaatggtaaatgatcatttggatcaattacaggcttttagctggcttgtctgtcataattcatgattcggggctgggaaaaagaccaacagcctacgtgccaaaaaaggggcagagtttgatggagttgggtggacttttctatgccatttgcctccacacctagaggataagcacttttgcagacattcagtgcaagggagatcatgtttgactgtatggatgttctgtcagtgagtcctgggcaaatcctggatttctacactgcgagtccgtcttcctgcatgctccaggagaaagctctcaaagcatgcttcagtggattgacccaaaccgaatggcagcatcggcacactgctcaatgtaggtttatttttttcccttcttctaccaagaaaaaaaaaattgtctctcttgcatgcaataaagacgttggaaataaactgcattggtagcaagacaaaggatttaatgatttaatgctgaaggggtgtgatatgctggcatgcatattgattccctttgctgaaaatttcctgttagatgttttcttcccaaataacccctcccgcccccatgctcctctccttaccaaccttatagtctcttgaaaacagtttttaaaatatgcataaaaatgtggggggtggggagtagagggtgaccacaagactttaaaacattcttcaagtagggcaatttgacacattttgcagtttttactaaaatgtatgcagagtggaatttaactttgctgttctttggattagctactagttgtataggtccccccaccccttgtgtattccaacagtccaaagtaattaaaatatgacattttccttgaaaggaatttagtttaattaaggtggctgctgctcccgaagttcataaaccaccagttcaagctgccgcttccaatgttttccttgctaaggaaaggcaatatttcttagcattgaccctgctgccacctttccaagtcactttgttggtctaagaagttgctgttttgctagaaaactactggcaatgaacaccccttggactgagccatccattatttccatatcttgcagttcagcccggaacgtggacatcagttaaaggaaaggaaatataagtggggtagcccaatttaaaaaaaaaatattgactattttgttatctgatgctgacacagtgccgaggtacgcacctggtcaacagtagcctggctgcaggcttgagaaatgatcaggagtcccagaaaatcccaccttcgggtggctgtagtgggagcctgcaggatgcttcgccgccctgacagtgatttagataaatggctcagctatctatcaaaatgtttttagtactttatttgacaattcattggagcattagcctgaaaatgacattttaaatctttgttttcaaagaggtcaaagtttaactggaagaaattgagttttcctaataacatggtggcttatctaaagagagaagaaaaaggggagaggggacaatgacaggatttaaattgccctctctgaaactttttcttaagaataaagacttgcttcttgggccgggaaatcaacaggtttgtagctgaaaaatcaataaccatttgatgccaacagcctggctgtctgacttaacattttgtagagccataagcagggcaaaaagaatatcgttttcagaaggcgccttaatcttcagctgctccccaaatgccttttcttttttggtgcccattttatttctggagaactcaaagaaactggagtgttacaaaataattttctaatccaagaagagacttttcagacctgtcctctttgtagcaattaaaacagtatgaacaatttctgttggaatcccagggaactggggctctctgaaactttttcttgttagagaaagtggtaatgaaacatgttttttaacagaaggaaaaaatatgctcaggatcctcgccaaaagttattagacctaatagagtttttacatgtagacattcttccttttgtaattaaccttccaaagatgcctattaagttgtaagagtagggggaaaagctttgtttgttcttggacaagttaaacaagggatttgctttatctagggagagcgagcggtgaatgtgtcattcgcctaaaactacccgataagcaagaagtgttgataacagcaaagtttagctaatcaaagaaacttgcattagacaaagtaaataaaggcatttgacaaagggatttcagaaattccagtgtcttatttttgtaagcagggcaattagttcttattgtggtcagtttcacaagagtttgaatcccacaccccaactttaggttaaatgaataaaatgtaaatattgcttgtgcccttgcagagttgctttaccctcataaaccactttatgatggtcagttgttccaacgatttttttttttttttagcataaataaaactaaaacttttttttttttttttttttagagattctaacaaatgtcttgtgccatgcagtgtttggttcagggtggtacagctagttagggctattgaaataaaagtatattagggctacatttgtgtaagtaagaacataaccacaaccttttccattttacttaatggctattttgacgagaagcagatctgtttttgcttttaacacagaggaaacagtgggcaaagaagaaaaagtactaaattccaaccaaaactattttctgctttgagttttttttatggtgtgtgtgtgtatgcatagtaaataaagtaagacctttgaacatggagcacaccatcacaagctcactttgaaaggtgttaaaatattccctttattttctttttaattttaaaggcagaaaaatgatatgccagccagctgccatttgtagtagtgtctgtgaattgcttcttataagcattcaaagtcaggattaggggactactaagggaatgtggtctaaatattacgattgacgactgcccctggaaggtataggagtcactaaatttctgttcagatgtctccaggattatcttggttttaggcggctccagatgttttcaacattaattgctcagtgggtataggataaatcttaatattttgtggtctaaatatagttgctttggtgaaataacgagtgtgacaacttcttggcctttttccctgtcttttctccctactcaacacatcaaaaggaaaaagaaaaaaatattttctttttgaaataggactttgcccattaatgagaagaaattatttttaaaacaaccagtagtgatgtttgattagggaatgagaaaaggcctcttttcaaagccctgggacccaaattttaagtattaaacagtatctaaatcctctcctagtgagatataaattggggtcaaagtggcaaaatcaaagataccctctgaaagaaagactaaataaagactgacagccaccgtatgaattgaatggggttttgaataaatatttcagtgaaaaggcccaattgtttttctaaagtaggacataattttctgcttctcgggcacatgacggtggtaactaataccatcagaaagaagagaaaaagagggacttttccttaaatcgcaaagagagtacaggcagggttgtgggttgttcgaaaacaagtgaaagattcacaaagttttccttccttgtagaaaaaaagaaatcatattgtgaatattggataaattggtacatttgacaagggagtgagtattgatgtgcaacttagaaaagaaaaagcatgtgtttaaattttattgccagaaaaggatggattcaaaaaactaaacagtagaaaggtagacatctgtttgcctaaacttaagctatggaattgacttggaagctttagttagaatttgatttgccagccaataatgtaaagcccttgcattgaatcaggtcttttttccttaatagataaatgaccagaatggctatttctgataggctagctgacctgaatcagaagtttccttctcatttctagaagcctggcgctgatatatacaaccgagggtattgttatgcacttttctctaaagcgtaagaataaaaaaaagttcttctggatatcagatgtttataatttaccttcgacatatgttaagctctgaggtggctgaaaaagaaagaaaacctgttttctcctttacacattccacagatatcattaaactctatctgagaagggaaatacatgataaataacaaagattataaattctactctcaaggaatttataattttttaaatcagtaatttagaaaaagctgagaattttaagttactctttgggcagaagatggagatgtaaaaaccaagatgcaaaatacaaaactctgttcaagtcacacaggattttaacaataaatgcaatgttcattttagaacatcttagaatcttctatacagtttgagttatgtgtaagtgccatacatttatccttaaatgacatttttatactttaaatgttctaatataaattcagttaactatcaattaaatagattatttcagaaatgggagtttttgatgaaggttaatcagaaaaatcttggctgaaaacctttccaaagatattaatgtagatagaatcttgcctttcaaattacagggtagttatgacaatcatgtatctctgattttctagaataacccactttcaaatatcctgcacagttcccacataaatcattgaaatatgccagatatttaatattacaacatctcctaggctgccccttgaacccaggagtggcacagaaagtctttgtttggattctatagtcaatataagtagagctctcacagcttaattttttcattatgtctgaagatcgccttgtgtttctgggtcattcttatgaacatgaattcctttcgtagcaaactatagatctgtgaatagaaggcattccttgcaaaatggactgggctgtgattctcactctagcacctgtgtgtgcgtggacagggtggggaggagggagtagaattaaattaaattgttatgaacaaatctgtatcagcccttgccagcttcctcttaaaaagttggagctggggtgatggagggagaagagtagagttaactcaggtttcagatttatcagtatcctgcttgtaagtggcttggtctaagtacctcttgttaaataggagatgagataacctgccccatctgtaagatctaataacacaacctcatcagtcaatatgttgctctgaattctcctcttttcattcccagcttccttaccccatcattaaaaagcatgatctctgtcccatcccactccccaaacccctttaaatgaatgaaaaataaagttgcaaaagttctctctacctaggaagcaggagagcctaagtctactggcattttgtcttgagctttcagagcttcttagatgggaagtcaaacaggcaatggaactgctgacttgctctttctctggccctgtagggtgggggagctacaaggggaccatttagtaagataagactctctgccccctgcgcgataaggcgaggataacaggaactgacgtcagcaaggcgactcaacctggccaagcatttcctctagtcagggctcagggattccaggagtctctaggcttcccccagcagctgaagaactgaaccagctcaggggagggagaaagaagaaagctgatttttacaggggtgatagtgggtgatgatgtccctgatttccaaaagcagatttctttgaagagaacaaagaaaaactgggaggaagaaagtcgtttaataaaagtggattctgagattataattgtcattttacattgtcatagaatagatatttgtgttccagctgtcaacaattcactgctgatgtctcattagacagtctatccagcaatcaccaaatatcatccactcacaaacctcgccaactctccatatagaacaaaacgtgagggatttcacgttgtcagagttaatccttggtactccttttttttttttttcctttttttttttttgagatggagtctcgccctgttgcccaggctggagtgcagtggtgtgatctcagctcactgcaacctccacctcccagattcaagtgattctcctgcctcagcctcctgagtagctgggactacaggcgtgtgccaccacacctggctaatttttgtatttttagtagagatggggtttcactatgttggccaggatggtctcgatctcctgacctcgtgatctgcccacctcggcctcccaaagtgctgagattacaggcgtgagccaccgagcccggccttgtatttacttttgaaagtacaaagttcccatccccatctgcatcagatgacaacattgctaaagccatttcatttgctaccagccctgaaaccacttagcagttttcctcccctttttccttcttccctttctcttaaacccagatttattttcattttattttattctttgccttccaaagtatctgatttgagatttggaggaggagaaaagtcaaacagaaggattttatttcttaaaattcacagattctcctcagtccactgctgtcttaaagatagcttcttattttttaagtttcagtgtttgacaaagaatcactgtcctaatttgacccatatttagtggaatgtttgctatgttgttgttgataaattactattcatcacagaataaaattttgtcaagtcaaaaaaatagctaaattcaaaataatgtgcaggtaaaagaacaaataagatgagtgcatcggttaactagggagagaagatctggatcacatcccaatttttttcccatttccagagcaaatgaagacctcatgtaataaatttgtcttctcaaaaatattaaagctttcaacggctacagtacctttgtcatgtcatcaaagtccataattataaaaaggccgatgatctgaaggccatttcagcttcaaaagatttttttaggggctggtctattggaaagcttgggggtttaattaactaaaatggaaatggaggcagcgaaattcagttcctgatgttttaatttagctcagtactgccatgtgttattgaagagaattcttaaaggcaaacataattatttcattatggtcctcagaatgctttcattggctttaatgacaagaagctgtataaaaaggcatatattttaattagtcctttttatatttacatcagataaacaacaaataattgatgaaaaacaagtctttggaatggatgatttcacatagtgcactggttacagtttaatgatgaaacatttctctgttgctttgcattttaattatatatacattatattacagtagtcgtgccatggagctactaaaataccgttgttgccattttattacaaaaaaaatcacgattaatgcctagaaattgaaagctgaaaaatgtagctagacacatctccaaggaagtaaattaccggttccattaattttactacatttgttagaactcattttgatcacttttatcttttacgcttcatctttttggattaagatcgtcaggggtttcatatgcttttttatggccacatcttctcctgagcacctttctttcgctcttgctgcctgttttgaggatttgcatgtgaaagtgccttgccaaatgtgcactggaaattcagagagctttttttccatgctatcggcttgctttacctttgattttatatgaaaacccatttcacatgattcatccgttttggtgtacagaacactaattgttattattgattttaaattccgtgaccattacaagtaacccagatgactggcagataaagggtaataatccatggagttctggaactgtttcatgtttgtctggagtactttatgtgatcaatattaactgccccattgaaactaactgctgtatcaaataacagtcaatcaaatgaatgtgcttagagattatttattgaaagctttaattgttcactggggccctccttatcaggggaaacaatacaaactagaggtaggatgaacaggtttggatttgcagggaaagttgggggatgcagatgaacaaggcatctctctgcttctcgggcaagagtttccagaaacccatgttgggcttatagttcaggcagaagttgtgaatactcttccagagcttatcctatcacctgtacctcaaaggctttctagagaagggggtataataattttcttgcactcagcagaagctgtgaaaagttctccctttccaagagttttactgctgcttctccctggtcctctcagaattacccttccatgcatctctccacctctgcttccccatcatggcctgatggtccaagataatgcaagtagcctgccttgacacaggatcggtttctacagctatgaaatgggaataatagtgtctacattgcaggatctgtagaaggattagagatcatgtaaattaagattctattcttgtcttgaaaacatatggaagtcaccaggtaggccttctgccctgattttggcatgacacctgtggcttacgtgcctttgctaaaagcaaactttttttttttttttttggtcatatctaaattaggtatctcttttctttggtgaaatgatccctcggtctatagctcataacctaggtggcagtcctttctgtttgtcaggtagcactgtgccctgattcaggggcatccatttaccagatccccagatttcttgcaaatgattgacttttacaagtgagcattgtcaccttcaaagttgtcacaatacacttagcccaaagatgctgtcgtggcacagtacatttttattgctcattgatggattagtttttgcaacgtgccattcagcaaatggctcttgggtgtctgccatgtgccaggctccttgatatgatctgtgggggacaccaagatgaatcagacactgtcccttctccctctgaactcatgatataatgggaagaacttgtgacacaagtcgttgtcacataacccccttataacaaacccaaaaatctccccatgtctttgaacctaagattgataatggaaagaactaagaactgccaagaaccacagctggtttatatggtgggtgatcaagtggattatacatttttgtcacagtggagcgggcgtgaagtttttctgtgtgcaggcctcatagatcatctctaaaagtagttcacaaaggagttctaaacctatcttacacagtggaataagtgcacaccttccaaactagcttcttgaagactttcatgtggatgtttctggagcgtgttaagtaatcatgttccttggggatgggtttgattctattggatttttaaaaatcacttatttctctatgatttctgtgacttattcctgtgtaacaaaccatcccaaaacttcctggtctaacaatttattatgacattattctgtggatgggctgggctccgctgggcagaccctctgctccgcatgctgtcagctggggctgaatcatccatggctaaattgggctggcaatccaaaaagtctcactctcatggctggtggtggatgttggttgtcggtgagagctctaggggatctgcatgtgacttgtgcatgtcacagcatggcagcagtattccgagagagagtgtttcgagagtgaaccttccaggaaggaggcagcagaggctcccagtcctcttaaaacctagacccagagagtggtatacagtcactttcactatattctgctggtgaagcagacacagggccagcccagattcaataactacctttcagtttgggagagaaaggcaaagaatgtccaccataacaatcgtagcgtatatgcactataacaagaaagaaagtattgtcttctgaaaatgattaaattaaagaacagttgtggggcttttagttttttggttggttccatgtttaatgaaatgctactctaatgacaacatacatcattttcagttaatcctcacaaccctataagtgagatgtcatcttcattttacagatgaggaaatggaggctcagggaaggtgaataacacggattgtaaggggcagagtgtggtttcaagtcccatgaaaggcttttctctaggctccatgtgctgttactcacttgggggtcctcagcttcaggagttgtcatcctgtcagctgagtgaagaattcctgaaaaatgtttcatgccctaataatcccaagaataaaacaccatcgagtgttttggttaaggggaaaggtaggaaaaagagaggtaaagaactgtaactcgcatagcttcctctgattacattattttctctactataaaccagtcttttacattgtggaggaaactctgcccaaactatgaggctattttactcttttgcccttttgtttttacatcctgtttgctgttgaagtctacgctggcctagtcactgctgtagctcagggggttcagaccaggattagtctggtatttactgaagagtcacaagaagatgagagatgggaaactgggcttttcatgttactctagtttactggtaacccttatctaaagatgggtgctaagtgtttgtgctagagagtgtctcttcattaagtggagctattttgtcttccactaccaaaagcaaaaaagtaaaagacaaagaggaagaaagaaaactttctgatagtaaagtcgaattaatgtttatttgctaggtattttaagtatctattgtgtgcagaggatcccaaacctagttaaccattaccatttagtgaaacttacatgaatcatagtgcatctaattggcctctcagataatgctctcatttcagtgacttcaaacatgtcttattttttatttttttgagacagggtctcgctctgttgcccaggctggagtgcagtggtatgatctcagctcactgcagcctcaacctgctgggctgaagcaatcctcccgcctcagcctcccatgtagctgagactacaggtgtgtgtcatcacacctggctaggtttttggagagagagggttttaccatgttgcccaggctggtcttaaactcctgggctcaagcaatctgcttgccttggcgtgtcaaagtgctggaattacaggtgtgagccactgtgtcccgctcaaatatgtcttaaatggaatgtattctgtattttgaattttcatataccgtattctacctgtttcttttgtttgaaatctaattgttgctgaattatatattttgaggaaaaagagacaggtggacaaattgaagtgacttgctagaagtcgtgtagtgggttctaagtggaagcagatctaaatctgtaagacgctaacatgtgatgcagtgaaatacagcatgggaccctgcagtgtgatacagtgaggttgggtagacattcttcgtgcactgtacctgctgtggaagcttgagctccaggttttgttttggtttttttctaatctttaaaatgaatccataacacctcccttgaaagcctaagatcagtcttaaagccttaaataagacaaacatgatgctcagtaaatagattgtttttacatatatacatagttgtcaataagaaacttgttttaggcttgcatggcgactcataccggaaattctagcacttcaggaggcccgaggcaggcagatcacttgagcctaggcacttgagaccagcctaggcaacacggcagaaccctgtctctacaaaaagaattatgtggccgtggtggcacgcacctgtagtcctagctactcgggaggctagggtgggaggataatcggagcctgggaatgttgaggctgcagtgagccgggattgcaccactgcattccagcctaggcaacagagggagatcctgtctaaaaaataaaaaaaaaaaaagaaatttattttaaaaaaaaatccaggccaggcatggtggctcacacctgtaatcccagcactttgggaggccgaggcaggtggatcacaaggtcaggaattcgagaccagactggtcaatgtggtgaaaccccgtctctactaaaaatacaacaattagctgggcgtggtggtgcccgcgcctgtagtcccagctgctcaggaggctgaggcaggagaatcgcttgaaccggggaggcggaggttgcagtgagccgagatcgcgccactgcactccagtctggatgacagagtaagacaccgtcccccccaaaaataaaaaattaaaaaaaaatccaaatgctagcattgtccagaaaaatttaacagatttatttataattattataaagttgaactactgaaccttgttcactgaaacattttgatttgcattaatgctttacatccccacatttatattaaaaattcacacgcaaatgaagatggaaaaactgccaatacctaatttctgtcctctatttttccacttgcaatcatatacctaggtaccttttgactgcattagaaaaaaatacctaatattcagaactaccaataacaggaagaagaaattttttttcgggggggtgggtgggaatgaaatgtttcccatcatagtggactcctaagcacgttctctacgtatgcagtgtgctgatgtcttctggcataattgttaaacgtttgatatggataacacacaggttagtgccctcaaaaaggccaaccagataggcctcacttggctcctgcaaagcaccagtagctgcgctctggaagctcagatctgttttaaagtcctgagcaatttcttgcaccacatattggaagggaagtttgcgaatcagttcactggacttcgtataaagcctaatttcacggagtaccccagtcccaggcctgtaacaatgaggtttctccaccccgccagtagagggcgcactctcgtgaatggcttttgtggccagtttcttcccggatgcttttccacgggttggattttcgagtagtgtgctttgtaggaaccgtggtatggacacctccttactttcccccttctccttcgcccagagctcggcgaactagaggtggcgctggcgtcagagagccccaactgcaaatccaattccccgatattttatgaattttttttaatgcagaaaagttacaacagctttactgcaaacacctggatacctactgccatagctaccattaaaattaccaggtttcttttctgtgttctcacccttttctccttttgcatatgtttgttttgttttgttgactgggtcttctcactaaactgagagtctttgagttcaggtattgtgctttttacctctgttttcccagtgctaatatagtacttggtctatgatcctcagtaaactatggttgaacccacatgtatgttctaataaacaaccctttaatatactcgatatcagtgcccttcaatagaacttcctacaatgaagtttccaatgatggaaaggatctataattctacattgtctaatatcatagtcgctagccatttatggctgttggaatttgaaatgcggttaatacagctgaggaagtgactttttaattttattttatttttatttatttatttatttatttatttatttatttttgagacggagtctcactctgttgcctaggctggagtgcagtggtgctatctcggctcactgcaacctccgcctcccgtgttcaagccattctcctgcttcagcctcctgagtagctgggattacaggagcgcgctaccacgcccagctaatttttgtgtttttagtagagacggggtttcatcatattggtcaggctggtctcgaactcctgacctcatgatccacccgcctcgatcttccatagtgctgggattacaggcgtgagccaccacacctggccaattttattttattttaattaatttaactttcaatagccacacatggctagtggctactgtattaaacaattcacttctacatacttcagctattattattctttcagtatttgttcattttctttatttcctttttcccttcagcctttactcttctctcctatggctattaacaagctctaattatccctttatgtagcaggtaaacagactgcaggaaaatgtaaacagaatgctgtagggtggtgatttcagtcattgtttaactccttttccttctgggtggaactatttttcctggggcctggcaagtatttagcacttgttttgctaacatttagtttgcacagctaaaccaagatttttgcagaatctcagtgggcgggaattacattccctgtagcaatcaaatcatggagacatacgatgtctattcccgtgctccacacctgcttggttttgagatgggcagagtatctcccaacattttcaagctttcaactcagcttgaacatttcaacaaacttcagggaggcagagaggaactggccatattctatggaagcctcagtttgccttctgggaaataccatgagctctcccccgggtgcctcctcctgcttacgtgtgtcctctgctcataacccagagtgcggcacacagtaggtgctcagaaatatgctgagtgtagttcagtgaaaacgaaattgagaacatctcaagtgagctaatattttttggttattcaaaacacctctagtaaacttgatgggggctgtcaaaaacttgggaggttcagtttggctgggatggcaaagtaagtaagcccttataagtgcatttgctggcaaactggcctgaaaacatgagagtggaatatttccctgggctactggcacttactttgaggtcacagaaatagattttctgatggtacttcctgttagccaggacattattgctcccccttgtcccccccaccacccctttttttttggcctatccctagaaatggtgtgaagaaagtaaataaaaataaagctaaagcgcgccggtaatctcagctactcaggaggctgaggcaggagaatcgcttaaaacccgggaggcggaggttgcagtgagccaagattgcaccatcgttctctagcctgggcgacagacagacagtccatctaaaatatatataaaaaaaaaaaaatgataaagctaaaggaccggttgcggtggctcatgcctgtaatcccagcactttgggagtctaaggtgggcagatcacctgagctcaggagttcaagaccagcctggccaacatggtgaaaccctatttctactaaaatacaaaaattagctgggcgtggtgatgggtgcctgtaatcccagctactcgggaggctgagacaggagaatcacttgaacccgggaggcagaggttacagtgagccgagatagcaccactgcactccagcctagacaacagagctagactctgtctcaaaaagtaataataataataataaaataaataaatcgctaaaacaactctcaagagaaacttttgaaccacggtttgcttccccacccccatgatttaaagttgcgattgatttttattaaagtaaaacaatcactatcataattaatatttattaagtgcttattatgtgtcaggtgcttaaaatgaaccatgtcatctagtcctcagagcagcctgaagagaaaggccctgttatccccactttgcagacgcagattcctaggcactgagaggttcaaatacctaccttgaatctcccgagtaggagaaagtgagtccaaagttcccaactcagctttgtataatgtagggttccttttctttgccaacgatataaatttctattttgtttgcagggaagagggatggggaagattagaagcctcagaacccacagaataataaaagggttaacaagtgaaagctggaaataatacgtttttaacaaaatgggcagttcttctaattgctgtgcccctactgttcaattcctttttatgtcctaattcattaaattatgtacacatcaggcttattatttacagatgtatacacttccaagtggctcatatgaaacagatgtttcatgaaaggtaacagagaacaagtgatctaaaccctcctttagtgggtatcaagtgagtattatggcctattacctgcaggtcttttgctattattttgaactgcagtgtccagtacgggcaggaagattcaatgtatctcctgtaggaacaagtaaaaatacaacagcactataagcaaacatctgcatctcaaaataaaagagggtatgtgcaagtgataggcaggtggtattcacatttgggctccggtagatgtgtgagtcagttttacaagcaatttgagaaaaagagacccattgcattacaggaggtgaggtgtattgagcagaccatctttagagaccagtgttaccatatcagttagctggagaaatgaatgaacacctcttttcttttttctttttttttggagacagaatcttgctctgtcgcccaggctggagtgtggtggtacgatctcaggtcagtgcaacctccgcctcccgggttcaagtgattctcctgtctcagcctcctgagtagctgggattacaagcacacatgaccacacctggctaattttttgtattttagtagagacggaatttcactgtgttgcccaggctgctcttgaactcctgagctcaggcaatctgcccgcctcagcctcccaaagtgctaggattacaggcatgtgccaccccgcccagccaaacacctccttttcaaaacaaggttaacatggcctaattaaaataagcatgaccagttcaccacgttgccgtaaactgggtggcatatgtcagtagacagttatttcatacttcttcagaatatcaaagagcagtccggacgcatagctcacgcctgtaatcccagcacttaggaaggccgagacaggtggatcacttgaggtcaggagttcaagaccagcctggccaacatggtgaaaccctgtctatactgaaaatacaaaaaattaacctggcatggtgggggcacgcctgtagtcccagctaccgagaggctgaagcaggnnnnnnnnnnnnnnnnnnnncagtagtacatcaagccccgataagtgcattagctgctaactgccctgaaaacatgagagtggaatattaccctgggctactggcacttactttgaggtcacagaaatagattttctgatggtacttcctgttagccaggacattattgctcccccttgtcccccccaccacccctttttttttggcctatccctagaaatggtgtgaagaaagtagataaaaataaagctaaagcgcgccggtaatctcagctactcaggaggctgatgcaggagaatcgcttaaaacccgggaggcggaggttgcagtgagccaagattgcaccatcgttctctagcctgggcgacagacagccagtccatctaaaatatattttcaaaaaaaaaaatgataaagctaaaggaccggttgcggtggctcatgcctgtaatcccagcactttggaagtctaagatgggtagatcacctgaggtcaggagttcaagaccagcctggccaacatggtgaaaccctgtctatactgaaaatacaaaaaattaacctggcatggtgggggcacgcctgtagtcccagctactcgagaggctgaagcaggagaattgcttgagcccaggaggcaggggttgcagtgagccgaggtcgcgccactgcactccagcctgggtgacagggtgagactccttctcaaaaaaaaataataaggaatatcagagagcaataataattgcctctcaaagtccacagtgagagttattatttataaattgtcaggagttctctaaacaagaacaaaaaagcaattggagcgaaaagatggctggaattgtgtcattttggacgttgaaagctgggaacagttacaactgaaatattaaatgggacatgaaatattaagtgacataccaggtttattgcatatatgaccatgagagtgcatttcattttgtcttatggagctctaaaaaaatccatgtaatggattaaaggtattaaaactcccatattctccctggctctacgccagggaacaaagcatgataaataatcccaatagacagaatatgtgggaaggaattttaaaatgtatttatggcggacatattgacctccctaactaataaaaatgtatacatgaggttttgaagaaaatgtgtagcccttacaacacactgtagtgttagtatctttaaaatattacccacgtctctgtgacatatggctgtcatcctctgtctttaccctggaagtgaggaaatgcatgaattttatagtaacatgtacagtcactgttaggaggaatagtttttatttcctttatcttaaagctgggctgaaaactacaccaaatctggattttgtaaataaagctttcttggaatgtgtcacacctatacatttacattttgtctgtgactgccttcccccatggggggcagagttgaatgactgtgacagagaccagacagcccacaaagcctaaagtatttcctatctgaccatttacaaaatttgcagaccctgccttaaaacattaaaaaatgggccgggcgcagtggctcacgcctgtaatcccagcactttgggaggccgaggcgggcagatcaagaggtcaggagattgagaccatcctggcgaacacggtgaaaccccatctctactaaaaatacaaaaaattagccgggcgtggtggcaggcgcctgtagtcccagctacttgggaggctgaggcaggagaatagcgtgaacccgggaggcggagctggcagtgagccgagattgcaccactccactccagcctgggtgacagagccagactccgtctcaaaaaaaaaaaaaaaaaaaaaaaaaaaattaaaaaatgaataggactgttaggaatataaatgtgtacttggtttctcatttatactaatcttgcgtgtggattcaggggatgaactcactttcagttcatttcctaactgtgtgaccttggccaagtcatttaacttctctaagcttcagtttcctcaggtgaataacagagatttaaaaaaagaaaaaaaaaaactgatcgtgttaataatccttgctcttcacacttttgttaggaggcagcaaatggggtaatgtgtgtgaaaacacccctcaagttgtcccccgccatataaagtgtgctgttggcagattctgctgaactggctgaaagtatttatttcacatcacatgtaaggatttgtatgcagatttcatttttttaattctttttttttttaaccaacactgattgaacttttgatatgtactggacactcttttagccctgagtatttaaagtcaaggccgccaaaatctttgtgtatgctagtaacacacccactcatgacagcctctgacccccatcagatcctttttctagctggggccatgtttgccttgtggcatttttcagttgtctgtttgcgtgggcaggagatagtgtattctaacttctttataaaccagcatgtatcaaggggtctggtccctggcaggtgctcaataaatgtttgtcagcagttgatgttgctgactgataatcactgccttctgctccccaaaccaccttggtccttgcaatgatttgggactttgggttttgaacagcaattgaaggctctccaatgagagatcgctgtggtaaagaggggtttaaagaagccatttctgagggggctaggcagcctggattggggattggccaggaaatcctacgaggaatgagagcacttctgattaatgcctgtgggcctgggaaggaaaggacagctgagagagggaaaactgacatgacttgctttcctcacattagtttttagagaatctcttaggtacatcagaagggaaaattattttgagagggaaaatggaagtgaaggtcaccaaatcaagatggggaaagaagggaaggtgaatagcattgagattcatcagcataagcatgatacaataatgataataattgcttgtgtaacactattatgtggcaggcattgtgcaaagtactttaaaatgatgttatttaatgctcacaatgatgcaatgaagaatatactatcattttatacaagcagaaattgaggctcagagaggttaagtaactttccaaaagtcacacagccagtaagtaggagagtgaggatttgaatccaggaaggccgactcccgagttcatacttccaaccatatgcctcagacaacttgcctataaaggtggacaagtttcgggaatatcaaaaaaagacctgaaccttgggggactgctctcaattggaaggttggtgaaaatgtctttgaattattttttcaagattttcttaacatttttaaaaaagaaataatgctaaagcactttgaaactcttagctttctcatacctaggaatcactgctctgaaggaaaaaaaataaccaacaatgtagcattcctgtagtttgaacagttctatatagaaacttgagaatcttttctttctttttgttttttgagacagagtttcactcttgttgcccaggctggagtgcagtggtatgatctcggctcaccacaatctctgcctcccaggttcaagcaattctcctgcctcagcctcccgagtagctgggattgcaggcatgcaccaccacacccagctaattttgtattgttagtagagatagggtttcttcatgttggtcaggctggtctcaaactcccagtctcaggtgatccgcctgtcttggcctcccaaactgctgagattataggcgtgagccaccgtgcccggccgagaatcttttcaaatgaaatatcaagtgcatcctttgaactgatgcattatgtattagccaagtagagggcacagtaaggatgttcagtgtctacttcaagttactcctctcacccccctccacccccgcaatccccagacatcttgggaaaagagtcattcagcccctcatttggggcgtgctagttctgtagacagtgacagaaaagctattgcacaaccaattctggatattgggttcattcttgtgccaaataaattttggttaagggagtatatgtggccttcaggtgagggaaggagaacctgcgtaggggctgggggctcagagtcctctcctcctctgcctccccgaagagccctggagctggtggttgtgcagactccatttggcctgagtgactgctcctgacagtgttcagccacacgccgttggactgccgccagaggcctttggaatcttggtcttagctgctgccattctccctgctgagggctgggttctcagcagggaacatgcagaaggggttagtgagtgtgtttgtgtgtgccttctaattcctgtgtttgcttctgggggactttcctattttattgctctgactggaaagaaaacagggcattatttctgtctccttaacttctttcttttgaattttccagttttacttttgttctttatgctgggttaactgtgtgtctgtctgtctgacttagacgtaccctgcatactctaaaacttcctgccagggacagctgcttgtgacaggagttctgcacagtcctaagaggggatgtcatagtcttctctcaacatgggggtcagacccattcccttgaacttaagaccatttaagttcaaatccatgctttttatttagcagctgtatggccttgaacaagttacctaaccacattatacctctggtttcttcttgcctgtcaaaaagaaatagtaaaactagactagcaatctctttctctctctcttttttttttttttagacggagtcctgctgtgttgcccaggctagagtgcaatggtgcgatctcggctcactgcaacctccacctcctgggttcaagcaattctcctgccccagcctcccgagtaactgagattacaggcgcacgccaccacaaattttttttgtgtgtatttttagtagagatggggtttcactacgttggccaggctggtctcaaacttctgtcctcaagtgatccacccgccacaacctcccaagtgctgggattacaggcttaagccactgcgcctggccaagactagctctcttattgggtcactctggggatcagatgtactaatagatgaaaaatgcttagagtagagtgaaggagcatgactagcctacagtatatgctccatgagtgttagtgattactattgttgaaatgtttgactagactctggagatggttctgttgttttctgtggtgaccatattagtcgcattattgatacggacttaatccacttttccccagataataaataataattaataaatttctaataataaagcattagctattatttttacatgtttttatactttttatagtttacaaagtgtaaatcctgcaatgtagtaagcgtggttgtcatctcaatttttctgaggatcaggaaggataagtgactgctagtaagaggcagaattaggaactgagctcataccatctgcattgtaggactctgcagtttccatttctccagagctgtagtattttctttgttgtccccactctttggtcccagagtctccccaccagtagtatcctcagcctagatcagtgtttttcaacctcagcactatctataattggggccagataattctttgttgtgtaggaggggcctgtcctgggcattgtgagatgttttgtagcatccctggcctctacctactagatgccaggagcagcccccaattgtgacagccagaaatgtctcctgatgttgcagaatgtcccgtgagagacaaaatggtgctggctaaaaacccctacccggccgggtgcggtggctcacgcctgtaatctcagcactttgggaggccaaggaggaggatcacctgaggtcaggagttcgagacgagcctggctaacatggtgaaacccggtttccactaaaaatacaaaaaaatagccgggcgtggtggcgcacatttattaattccaactacttgggaggctgaggcaggagaatctcttgatcccgggaggcggaggttgcagtgagctgagatcgtgccatggcatggctgcccatgccaggttgggcaacaagagcaaaactccatctcagaaaaaaaacaaaaaaaaccctgccctagattaaggaaggtggaagggaaatgtgtttgtgggaggaggggaaaagtggaggtgaaggttggctatcatttattgagcacttactgtgtgtcaggcaaattgcaaacgttgtctctggtttaccaacagaaatcaggattatctgcattttcagcaaagaaggactagggctcagagaaataaaactctatggccatttgtaagtggcagaagagagattcaaattcaggtccacctggcagcaaagcttaccactttcccgtcacctcctccacacaattttatgcaggctcatggcattttctttctttttaggaaccaagaaaacccacacagtgaggattaaatcggtttcaaagttattttgaggctgttcatatggtgcatacctgtaagaaacaaaacagaaaaatttctttgcagcaaaattctgagtaagccaagcattattttattgagaaaaagagggttttggctaaattctagtgtaatcaatcatacttgaacttccttagatcttagacgagtggcaaggtatgtgacaaagcataatttcatcgttgtcttccaagtatttcccttttggttttctgtcagactggtactaatgtggttttcaaatagatatatagtacataagcaacgaatgtgtgtgtggatatctgaaatgaatgtgaatgtgtgtatctgaaatgatatacatgttaatgctcctgttttaatctactctgtgtgcaggaaattcgatcagataaaataatgtcatttattagtgtgatagttccttttgtaaatattatgggaatcccgatagaagatagaagtgaaatatggaactgagtgagttgatgttgagaaaaactcttcaggggacctcaatattgcaaagcaattagcttcgtctacacatgactcccgagacctgttctagcatttgttcacttaatgcagtttcatttctgatgcctccacgttcagatcattaataagcagttagatgtgtcggcctgttaagtgactgtaagagaggatttatttgaacactggcataagctatcttagtatgtcctagaaaatagtgatagaaaacgtgtttaaaatgtcatgcaaaacaacctatgagatatttttgaatatattccttgtggtgagaacacatattatcaaaatgaaatgttggtgttgaacgtgtcatggtaccttatgaaaatatgacagcacttcccgtggtaaaagccagtcccaggaataacttctattgctggccgtaagcccagacaggtgtagctacaacacagagtgattagtgggtcctgagtcttactctctttctaaggcccaaactatcttgtcaaatttaaccatatcttgaatggaatcagtgtttggaaagttataaccgtgagttaaaagcaagagaattacaaagttctgcacttctcaaatttgagtaagtaggcctgaccagagcaaaccctgtgaccttcccagactaggaaacaaatcagggagatggaaaatgagaatttaaaaagcggggggggtttggtgagataatagtaaacatattaagtcatttacatctcatttataaagtctgaaaggattgttgtgttttaaatttcctaattctaaggtgctcagttctccctctcctcatggtatgggggaaggagtaaatgaactaatgtctattaagcactttgcatggtccctaacacagtaggcgctcagtaaatagtaattactattagttcaggctcttctggtacaactttgaacacactgccaactaaaagccactgccaaagttctgtgagagtgaacgaagacttctggtttatggtaagcataaacacacacagcctgaagatcttaatgcattaagtacttaacaaggtggagtatttagtaaggacctgtgcaaagggcaagttgacagagttctgatgctaaattaactcagcaaaatgggattacaggaaggttaggacaataacaagacattttttatgttagggtgtctcagacatcaatgtgcgtaaaaatgatcaaggggtcttgttaggatgcctattctgattctgcatttctggggtggggccaagattctgctttttttttttttttttttttttgagacagtttcgctcttgctgtgcaggctggggtgcaatggcacgatctcggctcactgcaacctccgcctcccgggttcaagcgattctcctgcctcagcctcccgagtagctgggattacaggcatgcatcatcacgcctagctaattttgtatttttagtagagatggggtttctccatgttggtcaggctggtcttgaactcccgacctcaggtgatcttcccaccttggattaagtgctgggattacaggcatgagccactgtgcccggccaagattctgcattttaacaagtttccaggtgatgctgatgctgcttgtccaggaccacactttgctgagcaaggctttattaaagactcaaaaccaaattctttcccccagcccttccttttgtctcctgcctatgttcagcacctgtttcatatgtggtcagaatagcagagtttctcacaacccagctccagccctcggccaggatccctggtgaccccggcaaacacacacttctttagggtcacgggcaggttactgagtcaagactgccaaagcccaacaatgatattttccttcactccccatcgtcctccctctctagccaccccaaacccgggactaatcttggagctgcttaataataacaaagccagcagcagagtaaggcaagatttcaaagcagagtttttcttgtttggcaattacctaattcaggatgcgattcacagatttgcaaaacccatgtgtgtggaaaccgtttctcctgaaagatgattaaaagcagatcctctcctgaaaaggcgacataaaaattaagtgagtgacagtatggagtcttcccgtgccccaaatgtttggatgcatataaattacattttactaaaatgtctacacacgagttcatacacgcatgcgcacacgcaaatagcggagaatctggttctaattacttgtactttagttgaactttggcgtttcctttgaatctctccctaatgtatgtgagctgtaggctttgcagtcctgcagtgaatccacagaaaaagggagaaaaaaatccagataggctctctttggtgccaacacaaatgaagtccaaacgaacattttgaccaaacgcaactttgctcttcttccttaattagctgaaattactcccttccactgggattcggagctctgggctcaaaattcccctggggccatgcaggaaatgtcttttgctttataactcctttttcttttaaagctcagctgcccagagagtgcattaaaatactgtcttaatcacagaaggttctagtaaaaaggctaggctttcctaatgcatgatgcctgcctgcctgtaatcaggcccaacctaaaatcctgaaatctgtcaacatcgttttagccagccgtaaattagctctcacaaagaaaaaaaaaaaagtatactgagctctcttaaaaatgttatctgctacttaatctaacctttagaaaaatgccaagcatgtaaggaattgtgaagggagctattgtcgaagactttctgtgtgtttaaatgacactcaggtgtgttgtaacaacaaggacatttatactgtgttttctcaggtgagttaaattcgtaagtgccaagtcctcttaacaggcagcaatgttaatttcttttcttttgggaatgaatcaacccaagagctgtggcagtgtttaagaaagcttcgtcagtgggaactcgggaattctgcttttgtaccatcccagtcggtggagattttgtttagctttgtttttgttttgtctgcaaacaacctctgagtttgaagtccttttagaggactgtttctcaaaatgcaatccggagacctgtgcccgtccgcaaggagagaagttcagacattgagagcaagtgtttcaaaacttttggagcaatttgacagggtaattttatgtccattaaatctaattttttttaaagagttggagcttgtgctttggacgtcgttgtttttccttaactcctatttcctggagattcatttgtattgaatttgatcaatccatgagggattgggggaaagactaagaaatggtgcttcaccattgatagtctgaaaagcacgaatttaaagcaaatgtccttctccctaacctcaagaattcccctgctgcaggccacactttgaggaacattgatttaaaagcaatgagtcccatgactaatttattgtacaaggaaggggattctagctttgttttccttagtgatagttatctgtatgttgtgggggtggagatgtctaaaataggggctagcagcttccgaggacaatgctgcagatttggttcattctcatcttccctgaggctcactgtctccactcatgtgcgcagttcagagcagccctctcagcatcactggtgctgactgtgctctgggcggggacccacagagccaagcatccatctcacccgagtagcagaagttcctctgacttgcccattccctgacgaagcagggaagcccatctggttagcagtttggatgccacattggaggctgctgcttgttgggcattcaagcagcaaacagaactgagtaagtccataagtaggcaaggaaataaataaaagcaggagacaaaaagcagatccgaattattcctctaagactgcttctccaaactgaaatcacatcaggatggctgcagtgtagttgttttattgaatgacacaagcctcttttccccctgggaagtctaaaaactgcttttttggcctgcctgagatcgctgaatgagctaatacagaacacattgtctgctgagccggcagagttttcaagcaaaaattttatcattccatagactgattgtgcttgcctgcaataaggaacaaaatgtttgaggcctctcaagggcatttgatgaatctaactctaatttaaagggactaatagattattgatttaagcaggatgacagtgaacagatcaatggctgagcactctgtatctgccttaaataccaaaaatgactggtaaaaggaaagccatgggctgtccccctgcttatttcccactgactttcttggggggtggaggaaggcaaaaaaagaaaaggacctctgataaactttgccaaagtatgtttttgctaccttaccaaaaaggcaagagattgcattaaagtacaaatcttttatattgatgccatatcctggtttcctggttgtaattctagaatttgtcttggcatgttcgcctgaggctagctttggtgatctgacagactataccactgattttttttttttttttttttttttttgccttgcattgttctcagtgttataggccacatagaggaaataaaagaccactgaccatcaattctgagggtgatatttgaatatatatatatatatatagagagagagagagagagagagagagagagagtcaaatacttaattttttactaccagtgggaaaatttttccaaagatgattttttttggggatcgtacataacgtttttccctttctgtttttgtggcatttgtagcattcaaattatgttcatttatggcatttgcaggattcaaattataaaaacagtagaaagaaccaatttatcatttaaaaacatagcccagtcacttcctcttggaaggctcccttgatttctcctgggataaataaggcctatagttcactctgacattatattagtggttcccaaactacttcagtttggattcgcctgggaatactttttattatttttattttttgttttgtttttctgttttaaatcttacagtcagccaaaagggaattttttttaaaatggcaattcctagctccattctcagacattctggcataatagatctgggatacaacttggtcattaggacgttaaaaagctccccagctggttctagtgtgcagccaagtttggaacccactgtattatcattgttggtttattctctattaggccaaatttgtcaaggataagggattatgtactatcattgcccatagcgtataacacaatgcctggcatgttatgtcactcagccaaacaaatgattgaacacatgaacagtctgagaatctattgtactcacatgagaaagttcctagaattattggtgaaatcaccaccacctaaataaaaggccagggctctcactattgattacttacaatagaacattttcgttcatggcaactgttcaggaaaagccttctggattcattcatttgttataaatgactcttatccataggaaaagatccaatctttgtaaaatgctttgggatctttaatgtccagtagacttcccgttttttgtgtgctttgccccaagtttcttgggtattaaattatgcacaattttgtttcctttctttgggaaggtgaaatgctggactcccttcagtgcatgtgtttgaagtggcatatttatggaaattactacccacttttgaaattcagggcatagctctgacagctgattccagccctaccagaattctatttacaactttcctagacaggccagattagctgttctacacgaacgagtaggaccttaaaacacaccgctccccaccttccttctgtgaagaactcaatgcgagattgatcatagtggtgatgacatgactctgtcagttgttgaagcacatggatggaagtagaagcacacaaatcaaaccactccaaaaggtttgagaggcatctggggaaggggtcacttacgttgatatcagggagtgtaaatctacacaacctttctagaagtcagtttatcaacatgcattaaaaacaaaatatttttaaaataacaacctttgaactgataattacacttcagtaatgtatttgaaggaaataaagatgtggtgagattagctacaaagttgttcatcacaatggaatgttttctgtgaaaaatatttatcgacaaggaaataaattgatgacatcataggttaaacaaagtcctcagcagtgtcagtataattccaccttagtagacaaacccaaaacatttatgtgcatagaaaaaaattctggaaggtcgtacacagtgaatttctctgagtgaaaagattgtgggtgagtgattctgtgtgtatttttccttagatttttaatagacagtgatacattgttttctaattttaacaagcagtgttttcttgttaattcgctttcagtgaagctgattagttccgtgtgaagaatgcttttgcatctactgcttgatagctgataagctttagtgacatctcagataccagcccttctataaaacagttgctgccactgtgccaacttattcaaagcaagggcttcctatctgccagaaataatgtactcaagattgatatcttcatcccagataccttggttctaaccagtaaagactataatagatttatctactaggacctgtactactcaaatgaattcattccaagattcttctgaattatgaaaatactataattatagttgattctgttccaaagggctaattaattacttttttaaggaagcaaaggagtataagagctatttggtttctaattttatcatttaacaacttagagggactcttagtgctcaaaatgaggaagaaaaaggaaaaggaaaaagttcatgtgctaattcaacaaatatttattgattatctgccatgtgccaggacctctactagtcctggaacacagatgtatacaatgcaggtgagtttctttcccttatgaaactcaatatttagagtataggggatggcagatgtagaatataaaattatatacaaacatctaaaatttgaacactggttagggttttatggaaataaaatagtgagacagagtgaccaggaatggagaggggcattttaatgagagaaatcatctctgggaaggtagcatttgctttgtgatctaagaaacgaaaaacaaccagatatttgaaggtctgagaatatctagaaaggacaaatagttatcacaatagcctcagttggtatgagagcttggcctattcagaagacagaatagatgccaattatatagaactcaataaattaggggactcactgaaggaaatgatgctgctaaaatgccgtgtgatgaaaagtcttgtagaacatactaaggagtttgactttgatctaattggtgactattggagggctttagataggcgagtgaaacagatggattttaacatttgaacaactatcttgactgcttgtttgaagaatagacactaggtaggaagaaggggcatgaagtgaccaatgaagaagctattgcagcagttgtgagaggcgatggtggattattagcatggtgtggtagcaggatagtgatgtggggatggattaacaataagtttagtgggtagagttgacctgacttgctaaaagcttgcctgcaggataatccagtcaggagaatatctactctgggagattataagcagtagggcaactggaaactttatattctgggaaatacactgtgtattaaaaagcaatttggagactagaagattctggaacattatttaaccacttttaattctccttcccgatttccatcttattttatgagcatatttacctgtgatagaagtacagccagttcttgctttgattctgagtacaatcctggagaattaggggtaggagaacaccccgttcttatattttgtgaactcccatttcccatggaatttgggtggttagataacaggatggaggattattatttttttaatctagaataaagagtaacatgacttaaaagtgaatcgcaccactctgtgtcatcattagttttaacctactgcttctcaaatgttaattgtacatttagtcatctggggatttcatcaaaatgcagattcagattccacaggcctgagctgggacctgatactatttttctaataagatcttaagtgatgccgatgcatgttggcccaaggagccttctttgagtagcaaggatcttacccatattgttattaatgaagatcagttatggctgcatcatgctaaagaccctcccagtacacttgttgaatgaataatttgggcattttcttcatttgtccaaaggaaaattttaaaatttttatttatttatttatttatttatttatttatttttgagacggagtcttgctctgttgcccaggctggagttcagtcgtacgatttcagctcactgcaacctctgcctcctgggttcaagcgattctcctgcctcagcctcctgagtagctgggattacaggcgcacaccaccacaccttgctaatttttgtatttttagtagagatggggtttcaccatgctggccaggctggtctcaaactcctgacctcaggtgatccccctgcctcagcctcccaaagtgctaggattacaggtgtgagctacaaagaaaatttacttttggttaagtgagcaacaaggtcaagtcgtttgagattctacatgaatcagaagctactggggtttgtagtatgattatctgaatttgtgtcttggctctaccactgctctgctggtcttagttagacaagtcacttccttcctttgagtttctgtttctgttgtggctaaaattgtgataaaaaccatggccctcacagttctgtgtgagctgtggactgcaagtgagagatgtatgagactgctttgtaaaccgtagagtaccacatcaatgtcagtgtcaccactgctgggcctacaatgacagctgtttttatgagcccattcttgctagtgttattgctgaatttggggcagaagcatatgaattcactgttgaaaaaagtaatgaactaaaatacattttctcttttttctccctctaccccatctctattatagcaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaaggtgagtattcacacttctgtgcctgatgaactctcattctccatgtactttatggaggtgacctacccagttccaaaaatgggctggatgtgtaacatcacctcccataagtgtggtgaattcagttatattcagtggtttttattacttccttatatatctttggtttaaaattcagaaacttctgcaaatgactgatgagggtcaaaggttctaaggcccttaaattacccccacataataattccttttagataataagaactggctaggccaggtgtgatggctcacgcctgtaatcccagcactttgggaggccaaggtgcgcaatcacttgaggttaggagtttgaggcccgcctgaccaacatggcaaaacctcatctctactaaaaatacaaaaattagccaggcgtgagtggctggtacatctagtcccagctactcaggaggctgagacacgagaatcacttgaaactgggaagcagcggttccagccagccaagatcacaccactgcactccaacctggacaacagcgagactttgtctcaaaaaccaaacaaacaaaaaacaaagaactggttggaagaatcttgaaaagcatcgttctttttctctttagaacatgccgtctggtgtctgtagttttatcttatttttgaatatgactgacagtccactgaatcaacttgcagggaattcaaggttgaaactgggatttgtctgctggctgttttcctcagctctgtggcctttgaattacagtttgattttcagcctgtagggacttgctactgtatgtgtgtcataaattcaggggagctggatttaaaattcctgcctacagaatactggaggctgaacatgtgtcagagagtagtatatggctgctttgaatcaagcaagacaattgttttcaagtccaacagtcttaattgagtgaaagagcttcttcttttttttcaggaaagaaaagaaacatgacttcaaaggcaaatacaactaactcatccataaaaaatttctcaaaggaactatggctgttttgaactagcccttccctagatatataacttctttaagtcctctctggatggttgtttacatctgttgtttatacatctaaattgcatgattcatttgtaattgttaacatgttggaataatgttacaggtactccatggcattttatatttggcttagcagagttagcacttaactgtatatattggtcaggcactgttgtataacaaaccatcctaaaactaaatggcttaagacaacaattctttatttagcctgcaattctgtgggtcagcagtttcagccaaactcatctgcatggttcacctggacttggctaggctccaccatgtatctctgggcagttgtaggttagctagttggctctgcttctaggggtgctgactgtgggctggggagactcagctctcctccatgtgatccctcattcccatcaggctggccctggcttgttcgcagaggcagggttccagaagacagaacaaaagcacataaggtctccagaggcttaggctaagaagcatctcattactacttctgccacactattggccaaagcaagttataaggtcagcctagactcagtaggtaggaacatcaactcaacttttgttcttcttttaaataaaataaaacgaatctgtcaacttgaaaaagcttttttgtagagatgggggtctcacgtatgttgcccaggctgacctcgaattcctgggctcaagtgatcctcccaccttggcctcccaaagtgctgggaatacaggtgtgagccaccacgcccagccccactcaatttcttaatgggcagagcttcaaagtaataagtgatatagatatggaggggccgggggaatgggtgtcatttttgtaattagaccactgtactgcatgtctgattgcctatgaacacaaagtggttggggaccctagctccactgcccagcatgtcatacatagtctggcatatagtgggtgcttaaagattgaacaaatttggccaggtgcagtggctcacacctgtaatcccagcactttgggaggtcaaggcaggcagatcacgaagtcaagagatcgagaccattctggccaaaatggtgaaaccccatctctactaaaagtacaaaaattagctgggtgtggtggcgcttgcctgtagtcccagctacttgggaggctgaggcaggagaattgcttgaacccgggaggcagaggttgcagtaagccgagatcgcgccactggactccagcctgacgacagagtgagactccatctcaaaaaaaaaaaaaagattgtacaaatgcgtaaatgtcactcagcccctcaaagtaattttgtgagtttttcccttcttttcaaaccatttaaataaacatatgtattatggtttatgaatataataaggccagttttgggaaattcattaaaggcttaggaacatctctctgcctctggaattgtgctattttatggcaattctcttttctccagtagattctgacatggtagtcaggaaagttatatgggcaaccagttggcagctgactaaaaaggaagacatttgttcattcaattattgctttattattagtaacccctagctgaacctacttaaatttatcctgagatttggaaaggtttcagtggaatagctagttcattttgtccacttgttgtgcaatatataaataaatgattttctaatgtttatttgaaaagtaaatgaaaagatacttctttatttctgaaaaatgttaagtcatctcatgtccagaaatctgagtgaggtatgctgtaactcagcgtacctgctctcatcattatccaacgtgtctctgtggcacatactaggagctgcatatgaagctgtttcatgatctgtatagcacaaactgctttaatcagctcatagtcagtgagttctctgagcttagtttgggattctgactcttttttaggaaaaaccccaataaaaacaaaacccataccggcacaaacaactttgataagctcagttaagtgatacagagtcatattatggtgtatctttttaacagagctataaacccaataaggtcaggtgagttcggcagccagttgaatttgataatatttttatattgtgggtggattgctcttctccctggtcattgggaaagacttggtctacatttaagcttgctgggaaaatacagtgacaaaattcacagaactgagaaacatgaggaggtaatggtaaaatacaacagccaaagaaaaagaaatataactttaaaaaaattaaatataattttattgtcatttaaaaaaattatcaatacagtatagaatttattgtataaaaatagaaaattaaaacaaccattattctaccctgggagggaacccctgtaaaactcagcttttctgtaagtatatgcatattgttattgtttcagaaaaatggaattttgtgttgtatactggttttaacttaatctttaataatattttatgacccaaatttaagcaactgcatagcttttatggttatacaattaatatagtagtttacggttatgtcataatttatttaactgattaaggtgcttacagtttttttcgattataaataacactttaaattatggcctttaagtatatctctgaaaatttccttaggataaaattttccttaggataaatcagtataagtggaatttttagatcactggctttgtatatttttaaggctttcgaatcagattgccagaataccccgtagaaaagattattgtctagtagtctgtaaaaagtaaatcctttcggaaagtatctattatctcccttgtgatataataaggtaatgaatccagaagcaacttttcttcttgaattctgcctgtatttaatttgatatttactatgggccctgtgtgtggtatcattttaggataccagcagatgcaccataggccccttgttgaccggtagaaactggcccaaccattggctggaaatcaaagtttactactgtaagctgagaacctctgctctaaagtaggactcccaaacagagcctggtatatcttcaagaagtaatgcctacggtggcttctgcctgtcataaccaggatgacctaattgactattatttggggaagagaactttccgtcctcctagggactgggtgacagtctcagcctctgctgcagccatacgatggtggtcagaatttaacaaatgggtgtggtccatctctgggaatgaatggtcagcggctgctgtattgacacagcattaccatggcagtataaccactagacacactgtagggatgccctgtttagggggtttccaggtgagcgatggcagtttttgtgtaggggacaaagagtacacaaaaggaatgtgcagtgtggttagccaagaatgtttaacagtataaaataataaagcaatattaaaaaaataataggacaaaataaaataatgtctttggaaaacagtcttattgctcatagctaaaatttaatgcaaaattttggccttaatcatattttacatttcaacttttgtagcttttgaggaatgtgaagtctagagtgagaatgctgggatgtgaattctagctagactacttataagcttggtgcaactctctcttttctcatctggaaaaatgggggtgatattacctacctcatggtattgttgtgaggataaaatgtttttactatgtataaagcatatagaatagtacctagcacatagtaagtgataagtactaagtggcacatacatgcttagttattgttttgttttgttttgtttttgttgagacggagtttcactcttgttgcccaggctggagtgcagtggcgcgatctaggctcactgcaacctctgcctcccgggttcaagcaattctcctgcctcagcctcccgagtagctgggattacaggctttacaagcatgtgccaccacacccagctaattttgtatttttagtagagacggggttactccatgttggtcaggctggtctcaaacttccaacctcaggtgattcacccacctaggcctcccaaaatgctgggattacaggcgtgagccaccgctcccagcctatcgtttgttttatcattaagttattataatgacttttgcacacagtgatgtaacatcaattataatcttagtactgttcttgtagtgttctttctgcagttctccattcttttctatcaaaataacactgcctctttccttcaaggctcacattaagaccctactactccatggagcctccctggattaccctagtacagaggttgccaaattgcttctgcaaagagccacatagtaaatattttaggctttgagggctatgtggtctttgctgccattattcaactctgtcactgtagcatgaaaggtgctgtagataatatgtacaaaaatgggaatggctatgtttcaataaaactttgtttacaaaagcagtggaccagatttggcccttgatgatgttattcttcttacaacttctaaaactcagaagctggtgccccaaagctctcatgccaaaagtggcaagcccgctggttttgctgggctatgggcctgggtctgctgctccacttccacactgctaaaagaagttcatgtccacctgcccagggctctgtggcttagaagctttaagccatgtctggtcattcctccacccttccaatcacactcaaatcccactttcccatcatccaaaatcagagaaattagaagtatccaggtaattgagctacgtccagaaatacctgacgtcacaccttggagaggtttctggaacatagtctatgctgttgtatcagttagcttcttctgcttaacaaataactcaaatgcttaatgtcttaaaacaatagacatttattattcattataattctggataggtcttcttgtcttggctgacttggcttgggccaggtggtctaggacggtctcactcacatgtctggggccttggcaggatgaccagatcctctccccctgttgttgctcaccattagcctagcctaggcttcttcacgtggtggatgggttcccatcagtaagagaagacaatcaccatacaatcatagcaagccaacgccacttatccagtgaaccagctcaaacaaacacttctcaccctctgcttgtatcacatttgctaatatccccttggccaaacaaattgcgtgactaagcttggattctatggatgaagaaataaacttcacctcctaaggggagaagtgacaaagtcaccttgcaaaagggagagcctaccagaacttgcatttggttacataccgtcttctattattccctagtttgatgggcaagtctcttctgacaaccttattcaccaatcattcatccttaagcatatgtttgttgaacacctactaagtttcaggccctatgccgggtgctagagatacaacagtgaacatgacaaagttcctcatggaatttagtgtctcacacaagggacagatgataatttaaatttggaaaacaataaacagaatggtctaataaagaataatttaggggtattctatttcacaggggtcaagggggcctgatgtgatgggggtcaggtgggatctcatggctgaggaggaaccagcggtgtgagtcatagagagaaagcattttaggtcagaaaccaaacacttggattctcggagcatttctacttcttctggctatgtccattgacttctctgggccttagcctatctgtaaaatgaaagcaaatccacaagtttgaacccagtaccatgtcaaatacagacataaaagcagtgaacctaataatggcactgatttcttgttagggctggcttacgtggagtaagaggtctccagtgtttgtacgtccaagtgtggagtagagggaagaagaaaactacccttgttgggtgccttctgtacactaggcatttgggcttttttttttttttttttttttttaacccatagcgcttttatttctcacaacagctctgcaaggtaggctccgtgacccacattttatagatgaggtaacagagggtccgagtagttaaggaacgtggccaaggacacacagctagcctttgctagagctgggattcaaatccttttcctgttaaaaaaaacaccccactgcttcagccacacttagacagaaggtctgaagcagtggtgtgttatggtctagagtgggggtttcataggccaccaaatttaaaactaacagataggggcatatttttaaaaaacatattgtcttgatcatttcataaaagaaatgacatctctgcgacaaaaaattaaaaaaggaagcgcttacaaggcagtcagtctttcccaagaagggacagttagcaggcagaacccacacatgggcatgttcccagatgcagctttgtccttgctctctacattttgcctttgatgggtggaaacttcctatccctaagccaacctttgggggccacaatccagcctgtcctgcagaaggccccagggcgaggcctggcacagccgtgatggcgtgtcttctccacaagggcgcagaggaaatgcttgctgaaggtcacattggtagccttctatttaaagcagtcttttaagagtttaaactccactagccccctcagtccctcagggctaattttgtccatttttctcatctgcctttgttttgctagcctctgaagagagggaggccctcatctccatgacagcgttcggctgctgggctgggttttcctggcagacagcaagcagaatgttcagtcacaaaaagttttgcaatcaggaagatggatgtctgcacttaattttagaacttctattaaatactttaaatgagcttaatgattttatttgaccaaggccatttaaaaccacattgttgtttttaattggagtggataaacatgaacatgatgctctctttggagaatatttttagctttcctcactctgatagttgcttctgttttaggggtttgctgcagtattgatcccaaagaacaaaataacatatccaaaacaataacaaaaacaggacactctgtgtaccactctgtgatagctgaatgaattatgaaacctgccataaacttcattactatattggatcacacagagtagtttccctcatagacccaaaaagcgtccctctgttccctgttgctataatctgccaaccatggaggatttacatgtttcctcattcattcatcagacatttattaagtgccttccatgagacagctccaggatatagaaatgaaagttttgtgtatattttttccaatgctgaatcccattgcctaaaaaatacagagaaccaggcctgtccaataatagggatgtaactggctcaagcccagctgctggctgcttggaggcagaaaacatgagaagctaggtgtggtaaaaggatttaaattctggcttttggggaatgaccaggctcaagtctttgaaagaccattccaaactttaggctgtggagaggggcttaaaaaggggaacgtggaggaggggtgggagcatgtgggagtggtgctgggtgcaaggtctgcgtgttcagttccggaggccgtgttgagtcacggtccacctgaagcacagcgtgccatcatttcagcaatgcccgggttgtagactaacccttttgaggtaatctctgcaatttcacagctgggtctccatacctggtttgtttaaaaattagctcctggaacttctaagtaagtgcctaattagataagctagtagttcaagagagtgtctggtaggaagggaggaaaacaaaaagtttttaagtacgttttaatgctgagagcaagaaaagaaaaaaaaagttttaaaatgcaattttaaagctaagctcctcgattacaggtaaatggtaaatattcattggatggatgaatgaatgagcaaggaaacagtgtggcatgtgctgtgacaattgtagctaagggtttgatgggcacagagaaggagtctcggatccctctgacacattcatggaaggcttttatagaagatgtgattttatagatgtgtaagcattttccagatgaggaaggggagaggagtgttccaggcaaaagttgaagatggggctggaaggcaagaggactcagaataaaattgcctatatagagttacatggaaaaatggaaatctatccattctgttaacatttattttgcataaccctatataaacaactagggatccataggatattaaagacactcaaaaggactcaataaataccatttcctcagagaagccttcctttggaacccccaggttaggtccccctcttttacatttgctgttgttcgcctttgtagcacttaacacaattgaaattaagtcattattaccaagtcattattaccaagtcattagtttaatgtcagctataaactccaggagggctgggcaggtctctcttgtcacagccttattactagggctttgcatagtgctagggaggcggcacatagtaggacgttaatgtatatatgcttttatcataagttatatctaattatacagtaattagtgtagttataaataacgcataataagatataattgtataataatgcaaatagtatattactttcatacattttatctaattatataatgaattgcatctaattacatagggcttgggatgatacattcatgtaaacattcatggaattatatataaacaggacaaggtctttggtgaccaaagtctagctcatttcttagtaatttctgccttctacctcagttaaccttcattgcaaaacgtatgtcctctctgatactatctttaggcaaactcttaagaactagtgcctggaatgatatactgacgtggaagagtactgagggctgttagtgctttaagaaaaatctcagcttagagaatctacctccatatcgaggaacctcaagacagctgaaatgacaatctaccttttcctagtaataattcctacggaaggagaaaacacttttcttcttctaacaaattgagaactgattttggattgaaaaagcagaaaaatctgtctttttttttttttccttctggtgtatggataaacaggaagttgggggcggggggagtgaattctgaattagcccgcaactctgcgtgttttttttttttccttgagttggcgtggtaaaaatagtttatttaatttggtggttttaagaggcttataaattttttaatggttaaacgttcaggaatgcttgtgtagatgcttactttgcttgttgtttgaaaatatctagaacactttcatttgctgtttttgttataacaaactaaaggtctgctattattgcaattatcctctttgtttctccaccttttactagaaaagttaagagagctttccatatttccttctcctgggtggatgcctgtaaagaggtgatatgaaatgaaattgtctggaaaggctttccttcttcatcagcccccctctaccttctcattgtcagggcagggctcagagcccttggtcttcccactctctacagttgcctctctccccacccgcgtacctatgtaaaaccatggaaataataaaactgtcttatatcttacattcctatagccttagtgtttctaatgcattttcatgtatgaaattaaattaagccaggcttagctgaagtaaaaggaaacccccacaaggtacaatgtttgctacaggacttttttctcacatcagctcttgactggcagccttctcttctccacacagtgattaggactcctgccagtgctgcagcttgtcatcctcttaggttcttagcatcatcttattctagctactggaatgaaaagagagcgtgggggaggcagtacacctgcttcttaaaagccccggccaagaatggcatacctcattggctagaatgggacacgtgaccaaaaccaactgcaaagtcgactcagagatgtagtctagccatgtgctcaggtacagacctacttttagggaaagaaattatggatttggtgaagagctaagtttctaccataggttttttttatttgatcctcatcatatttagagaagtaggtggaatcgattgtttccccctccatttcacagatgaggaaactaagaatttatgagagcagattctaccatctgtggttttgatttataatgtgattctgttactgaaatggttactgtgagaacctccttaaatacatttctgtaaggttccctgaaatttatcaaactatcttttcaaggcctctgattctaaacatccccatattcctagttcattcagctttgacattttgagaaacttggaaagccttacccaatagaggtagacctttatcaggggttagattccagtgtcatcacacaaggcaaagattacacgtagacaaaattaccccagaaaatccctttgaaaagcacactgctggagactgacatatgtctctcattaggacctacaaagccagttcttgccatagctctggaaacagatcactccatggaacaccagatgaaacagttgttttctgttctcttgttgtatcaaatatgtgtccttaagcacaacagtcataccagcacaacgcaatgcttatgtcctgaaaaccacgcatccctctcattgtcttcttgtcactatctcctaccataatagtttctttgggattagaatttctcttgtgccttttaggaactatgtctttttgttgttgttgttgttattgagtatttttccacttcagaaaggaagattaaatgtgtcatatggataagcaacaccagaagggaaaattttgttctatggaccctagaactcatccctgaaaaaaaaaaaatagagggaaataaaactctgtgtgcatctctgcctgtacaaagctagcattgtctggggtgaaggggaaaagctggggttctggcaggccggccccattagagccttgtttcttgttccatattgaaaagatgacattcctttgctagcagcgtcctgcctggatttctggcaccagttctgtggctagcactattgcctggggcatttttgttggggttggttttgttttatttcaaaagcagcaaaatgcaggctttataaatgttcaaggtagaactgtttttataaagcttgtcaccaaacttgtcagtacagtcaaggtggcccgtctgccagggtgtctgcttccttttcactggtgtcaagatgtatgagaaggcatatatatagtgaatttcacttcttaacttgttctcaagtgtttctgaggcagcccttgtgttttcacatgggcttctcctccctctcagggcttcatgtaatgtttcatttataacagagattggtggatttgcaaagtaaatatttcaataagaaaaaagcaagatcttcggtgaccctctcggttctgcttctatggaggtattttctatgtctggcaggaaaaaaaaaaaaaaaaaaaaaacctttatcttggctgcaactctgaactggagcgtgtaaaatgtacttctcaggttctgtgagccttaaaataatgagcagtagaaaactctgaggtaggtcagcgatggggagaataccatagttttataaaggattttcatggttaaacaaatttggagaaactagaatgaccaagcaatgttaattctccactgggcttttgaatctgaaaatagcagcaattctaagtacacaacaccaccattcatacagccctggaaagtcccccacatcaggaaaattatccttattagtcaaacccagtagggatcatctgactattcctcagggaaatgagaatttttgtttggatcttacttctctgtattgtactcaaattgtacatgagctatgccacatctggggactttgcgattatggtcatgttttcaataagaaatacttctgaaagctgctgctctaatttatatgtgtcattcctcattaacataaataaattcagaataatagcatgaggtggtggtatttttttttatttttcagtttccagagtcatcctgctctgttaggtgttccttcagctggctgggaccctaagccagtttacagtcccaacacttgctaagatattgtttgatgacatttattctgtttggctctacagtttgtcaatctcatgatttcatcaaaaacgttatgctgaaatgcttgaatatcttttagtatgtttgttgtgttgagctgtgataaaaagtatgaaagttttcattccaataccaaaacgtagaaagagggtatcagaaattaagtgattctgctaattcttgttatttcactaaaatgaaattaaatgtataatttctaattcagttgtattttgctcttaaattatcattttctgctttaagaattaggtggaaagtatgccctacttaaatgcatgtttggtgctaattcttgcctgttgaccaaaaatttgagtctcatgttgtgtacagtatacatacagatatcatttttttctctaagtatttgtgacaggtaagatctgtgcaaaattatgaattacattacaaatcgtaaatgggtcttactgtcctcactgaatatatttggtttttaaacccaaattcataatgcaggcacttcttttgctatgctcacgtgtatgatgtttgctgttagagagttcacaggattgatatcccagactttggtggtttaagatacctaaaagagtatttttgaattattgagtctacatcaggtattcctttgttatttgattatttttatctgtcttatttcttatgagctctgggcctcagaaagaatatttctgttctccactacgtacactatcagaaatatgagcattggatgagggatggtaagagtgacctccaaggaactaaatgtttacctgtattatatcggggtggataagctattatccaaataacaaagggggggggatcccctgcaaaaaatcactatagataagttatgttgaagtatattactattaagtaattagtattttagtaacttattttaaataataaagctgacattcctataagaatatataaaacagaatttatataggaaagaaaaaataacagaaaaattttggggcttgatattttgtgacacttacttctttttcttcaagccatctggggagcacagtcaatggatgtgggtaaatgtttgtttctgaatccttgctggaacccaagtcacctctcctctcatggaagtcctctgccatatccacgctgaccaataacattctaaagtaggcttcaagatcagtctccttggctctgcagtgctattactcctgcaggaaatgcatctggcatttgttactctcacagtaacatcctttcttccattcacagttgaggccctaactcttcccattttagttatggtaaggccaggttatgctgcaggaacaaactcaaaattacaatggcttcaaatagtagttgtgtatttgtcactcacaccatgtgtccattttggatagatagttctactccatgttaccttcactcaaggaccaagactgatggagtcacctccatttagaaaatcactggcccttgaattaaggggaagaacaatggagaattgcccacttgcactggtatctttctactgaatctcaaacacatcatttccactcacaactcattgactaaagcagtcctcttggcctcacctaatccaaatggagtagatgaaaatgcaaacataccatgtgtctagaagaaggagaatgggcagttgccaatgtttactcctttcttctgctctaagaattacaatgattttttgttttcccataaccatgtggttctcagtgtacttgtcttgcacagctgcatttatatgcactggataaagggtcccctccccagcaatatcaaactctttggggcccttaataagaggtttatgtaaaaccttttgagtagagatactcttatttggctgtgccttctatttttacactccattctctgcagacactttttacaagtttcttaagaatagtttatagggtagatttaggaaaaaaaattgtgtggcaccccaaattgcctccctccaaactgaatatgatcataacgtatctttcattttatctttctacagtctcccctgcctttctgggacctccccaagcagttaaagggcacctgctatccttgtctttatgtgagagacccagtcgtgggcctacaactgtcccattctgtgtaaacaccattttttccacaatggcttgttgagtcttccctggagtagaagtgctggcagccatcctgaggttgcaagtttcctgtagtggaactttcattgtggtactgattactatttgaaactctttcatgaatagtttacttagtcactgtttttctctcccactagtgtgtaagtgctatgagaataggaactttgtaagtcttgttcacttctgtattctcagcacccacagcaaatcttggcatgatgtaggcactcaataaacgtttgttgaatgactcaataataaatagtatgtagaagaggtgggagaaaacacagaattagagcacatttgtactagatccaagttatcacaggacaatagctatggggcaaatggaggagatgtttaggatactgttggccaagtatgtcctaacagatcagaaaggaagaatgaaaatgtcaataggcatcctttattcatttcatttttagttctaggaaagtaaatgctcatctgagattcagaggtatgcagaggtgcctgccccatctgtcttgctgtatcttcctagctgcctattgccatgctgctcttgggcatggggtaggtgactcaagaacaacattggggctcagtatgccacctgatgagatggctttttggtgtctgccaagggtgactgtttcctttacacaatggttgaacttatcaattattcaggttacttcttagccccaagttgaactggttttgggtttcaaatattggtctttccctgtttgtcatatacaacagtgaaataacagatgccttctgttcattttgaagtgataaatcctataattactacaagtacttgcatactgcagtttattgaggatgtacatatgcaacatctcctttttataacagctctattatgtaagtaagacagagagtggaatcccttctcccttagggtttaacttctagaataagcatatgaggtaaatattgtatatggttaaaatgacccttaaatcacccaagacgtgtcccagttaccattgctgtataacaaaccatcgcaaatcttaatagcataaaacttttttatttggctcacagattgtgggtcatgaatttatgtaagcatagtggggatgatttgtctttgcttcctgctatctggggcccagctgatgacagtcaacatctggagtaactcagtgtctggtaggtattggagttgtcttcagttataggtctcgtagttggtgttgcctgctaagtcctcagctagaactgctaactggagcatcaatacaagcagcttcttgatgtggcttgggcctccttacaaaatggtggtctcagagttgtcagacctattacatgggggctcaggggtccaaaaacgaaggttgcagaggacaaggtaggagccacatggccttttattccctagccttgcaagtcccatagtgttcctcctgtcaaattctattggttaaagcagccacagatccatccaggtacaagaggaggggacataaaccctcctttcattgggatagtgccatagtcactttaaaagagcatctgggaaggagctattattgtggccatctttggaaaatccaagctgctgcagactgagtttagttttgaatcacaggctctttcttcagttagatgccagatgaagcaggtggcttgttcttgagagcctgttgtaggaaaaatatgcatctctgtgccctcggaagactagtggctcattctgaaaagcagatgggaactgagacagactgagggagctgtgggttcccaccacccatcttgccctacttcaggggacacactcactcagttaaacggcagatggacatgtggctaccacccacctttaagctgctgtgagtgcgttctggctttcctggtgactgagaaaaatgcagtacccttagtatcgacatgacgtctatggacacagggagaaaaagaagaaatcagaaggcccatgtgacacctggctctgccagctttatggaaacagaccgcaagctgatctctcagggagtggtctcaagttcaggccccctgctttctcctggcttgcatcagatcatatcactattctcatattgattctaggccactgggtgaattttttatttttaccaaatgtgggctctaatgtaagctgctccagtccttgcgttttcagggtgctgcctgccaaaatagttatttattccttttggggagagctattcctgtgcatggtcagggtggtgaactcctgttgactctgaccaaaattctctttggcctccatttggaagtcgtctatgggcctttaattgtaccctctgggaagggagaaagagcacttgaaacaggcatgaattctgtacatatttctaaggctgggctgttttaaaaatgttgtctgtctgtctgtcttcttttttttttgcctttgaacttggatgtgaattttcgtgaagtacagtgtgtcaagggaagggcaatgagaaaatatgcaggggtatttacttaaaaactactcagtgaatctgtcatggtgtgttcattggtttcagtatggtaataccatattatgaaatgaaaggtgtcttactctatgttaaatggctgctttgtaaaatctcagccttgttgtgcatggtattatgcagtccatgcctgtctctgaccatgaattttatttttcttttttacatttcaaattagattaaaaccccaaaagctatttattaatttgttcctatttaaaatttaaacacaaaatgaaatggaatgtgctgaattttgttcgaatccttataagtacatgtgatgacttttgaaagaattgaatttcatggattttaaggagatctaaagaatgatggaagtgtttttgacagctctgaattgttactttgttagtcagagttgaagacttggaagtcttcaaatctcatacttggttcaaacatttcattaccacctaccaaggctttattatctctcataaaggaagtggattatcactgatcacagaaacaacaggtcatgttaattctactgcatctttcaacccctcttctactggatgtttttgaataacagccacatggaagtgaaacagactgataagacttcctccctcctcttgctcccatgcatacattaccagcagtgcaataacgaggaagctggaaaagaacttgaatgacccacaaaatgcccattacccttgaataataataaataaaaaacttggttatatttgtttggaagtgagagatttgcatatttcacaacagactcaattttgatgaggcggaatattgtagaggtgtgtggattctgcttttcctattactggtatgcagccccttagcctaaaccagtaatttccattggattgggaatcacatagcctgggttcaaatcttggctccatcgtttggacaaaccactgaaatccagtttcatcttttgtgtaataacatatgagcactggaataattttgagaagtagacagtgtagtatatacacagtgcttctttagtgccaagagcacgtatctagaatttgctatattccagacccatgtttttaactcatttaatcctcataacagctctataaagtagatgctgttgctgcaacattttccaggtagggtgtagcacctgggccaagtctgtgaacctcccggttacttctctttccctttccctttaggaacatgattttctgcctatgtcatgggccaggttaggttcaaatggtagctaaggtaactaactcccatctttaacattatctgattcactagtccttgaaagtatggcaaggatgcattttggtgatgtttcatataattctaaaggtgagagtcaatccttttagttgtgtttagataaaaagatacctgatcattttcttcagaaatcagcccattgagaagttgttatttattttttcttattagagttaatttttattattggatttgagaaaccaggtgctttattgggagggcagggcaggtaagtaaataatgcaggctgatttgttacagtagagggtggtggggagtgtagcaaagatagtagctgtcttctaattctttgctactgcatgcctcaatggagtacaagcttataatgatgagaatcacctggatggcttgtcaaaggatcgattaattgatcctattcccagagtttcaggttcagggggtctagaaatgtgcatttctaacaagctcccagggaatgctgagtgctagcccaggaaccacattttgagagccactgccctacaggaatgtggaactagcactgccaggtttttcaatatttcaagagaattcctctattacttgaggattatggctttttcaaggtattttttggttctccagacatttcactactaaaaaccactcagatcatacaatgattaggcaagaaatattaggaaagaacattaagtcaatctcttgcatattttaaatctattctttaagtattggcaatgtatttaaaagtttttaaaagactgtgtcggccaccactgagccaaaataaacatgtctgttagctcaattcagtttggaaattagcagtttgcaacctctgccttaaatgccaggaagaaataatggatgaaaataaaagaattatgttttttgaatttttctgcatttaaaaatttttgaaaaacactggccaaatatttttaaagctagcccagaagctagtccagaaatgtgctttccttttataacctaaaaggcagatccataaactgttagaattaacagattgttccctcggttaagcatgcagagcctgtctgttatggtcactgaatcagcctatcagctggtggcaggcatggtttgtgtgaatgatcctagcaggacagtgcttctgtgcatattgtacatattgtccctgtggtacattgcagatatttttcctcttcacctacatccaacttaccttctttcctggtctcaccttactctttgtttttagctttctttgcaccttttaccacttccatttgctttgtgaacacttctgtctgtctttaaaggcagtaaagactagtaatcataataacagcaaatattttttgactgcttatgctctgccaggtactgttttaggctattaacaaatttaatattcataacaatcccacaaggtagaaaatagtactatccccatttaaaagacaaggtaaggcacagagaggttatgtaacttgtctgagatcacacagctaataacaggcagaggccgaacttgaacctagggtatctggcagcaggacccaagcccacaaccactagactacctctgcaataagaagcctctgctttcagctcccttttttttcctacagaacctggctggacatgtggggatgcttagcacatagcagcacataatgctatggaaacagtcatttccactttccttctatattcaagtggtatgtctggcttatcaaacatttgtcgcaataaaaatatgactgtatgcaggctgagacaaagattactgctctttgaaatttctggagttgcctgatgacactcatgtaggatttagttgatcaaaagctttacttgatttggcctttgaaaaataatcattttggtcaatagcagagcatgtactcaacaaaaagtttcaggcatcactgcatttagaacccagtagaccagcactgttcaacagaaatatgctaacaacaaatgcaagttacacatgtaactttaaattttctagcagccaaattttttttttttttttttttttttttttttttttgagacggagtctctctctgtctcccaggccggagtgcagtggcgtgatctcggctcactgcaacctctgcctcccaggttcaggtgattcttctacctcagcctcccgagtagctgggactacaggcgcgtgccaccatgcccggctatttttttgtatttttagtagagacggggtttcaccatgttagccaggatggtctcgatctcctgacctcatgatccgcccagctcggcctcccaaagtgctgggattacaggcgtgagccacccgcctagccctctagctgccacatttttaaaaagaaacaaatgaagttaattttactaatatacattatgtactgcaatatcaaaaattatttcaacaattaatataaaactattgaaatatttttacatagtaatttcatagttagtcttcaaaatttgatgttaactttcacacttccaacacatctcagtttgaatgagccacatttcaagtgctcaatagctacatgtggctagtggctactgtagtggacagaacagccctggatcaaagagatgtgagaattacagccaagcgacacaggcagagaaccccaaaatgtcaagtgcaaacagacatggagcgagaggcagaaatgattcaagaaagcatcgggacacaattgttttaagggaattgactttcaaggaagataatgggaaaacttggggaaattttgctaattggtagaaattttagttgaaaaaatatgtgtacatatatagtcttcactagtttatttagttgaattaacatttatttgaacctagaaaaagaatcacacatactgtggtagaggatgtcagatgataatgagagagaactttggaattatttgaggacaagagtgattccatttgagtgacttaagcttcttgacctctagaccctggttttctagatcagaaagtcataaattttaaaatcatatttcttctttttttttttttttttcactcaaaaaaagagagtgtgtggctttagttcccatagagcttctggttcagatggtgcaaatgaagcactggctttctcagccttgttttggtagcataggaaaacaaaacaaaacccagagataagagcaagggagactggaggatgtgattatgagtaaaacttctgggtgcataatgtcagcagcacaaactgtgttcattctccatgttagttaatggctaatctagagattgtactgccatttgctgatagagcacagtttaaaatattttatcattaatgtgacagggagtcggataaagaaaatgaagcgtgattataaaatgctaattatcgttctcaagtgcatattgggcactcacaaatatttgcagcgtaatttgctttatttattatttcagtttggttataaatgttaattcaattgcagatggtatgttggcaatttacagagctataaagttatttggaaatcctaatattttctaccaaaatgttccgttagtgaaggatgagctaaattaaaaactcctgctctttagagttaaatacattaattggcaagtaggctgtagggatttccagatctgtgctggctatgttaactccttaaaggagggaaagacatgatttctaatttagagtgggaattttctttatgagaaagggcgaggaggaaagaggtgtctttttcctaccacccttgtaacatttcttcaaggctgaggttttcttcatgtcctggttcatagcaaaagagacatgcttgaagccacattttttctgtagtacatcaatagtttctgagaccgtgatgttgataattagggtgtatgtgtacgtgtgtgcatgtgtgagagagtgagaaagagaccgtgttttctccaacctcgctgattactacaaaatatacatatgttttagccaggggttgtcaaattatggcccataggctaaaccgggtctgctgcctgtttttgtatggccaagagctaagaatttttttttacattttaaatgcttgaaaaaaaaattaatataacatatgaaaattatatgaaattcaatttcagtgtttataaagttttcttggtacacagccaatccattcatttctgtattgtctatgattgctttcattctgtgatggtagagttgagtatttgcagctaagtctctggcccacagcttaaagagtttctatttggccctttatagaaatctgccaacccctggatgaggatatttaaggtgtagtttacaaaatggaagctttaacctattttttttttaacctccattgtcatatttatggaaacacacgaattctggagtacaactgggtttaaaacatgacttttcatttttgaaagctgggaaggttataaatatgagtcttagcttccttcatttatagtcatattaataattgaaagaagtgatattatattactaatgtaaataattttgtgtttcacacacacacgatacactcaaaacactctctttgcctccaaaataaggataaaagtaaaaattattttcttttactgtcaaattaaaaacataaactaagctgtgttcctggaatattctatttgtgttaacaattaggaattgtacatagaagcacagtaatatcagaaaatgtggccaccttatataactcgtttggaaaaatgtcattctttactaagaaatactgtgcttaattaattcttgctcctaggaggtcaacttggggcactcattatggccttaattggtgatataaatcctcagaccccagaggaaaaacacattgagtggttagtggtctctggccttttgggtgagtgtgcactggtgccagcctcatctcagagagtgacagcttctggtttcatggcttcaggtctagccccactcatattaggtttaaaggccaatgtgcaacagcaaataaatgcaataacttgtcctggtgttttgcattaaacagtgtgagacaacccactaccttcagacttggaaaaatgtgtttctgtgaactccggttctttgtattaaattatattcattacacggcccatctggagtctcctgccaggccaaaaatcatcttacagacattagcaaaaggaagttaaatgtaattttttttaattgtatacttttcatttccatttattttttcccttttattggagaaagcagatggaaaggaaagcaggatcctctctcactctggttcccttcgggaacagaggcagagcattcctggctgctgctcctctcacacgttggcttgaggtgatgatggggctgtctagattctggggataattgctggaaaggtcaggagttcaatttgaagctcacactggttggggttgtggagtttggagggtaagaacagtgcagtggcttacattgggctttcactgaagtgggttgccacgaattatatttgacagtgtggaaatgaaactcacaaatatcagatatgatgcagttccattttgtgtctggttattgacttgagtattttgctgggagttgtctttttgctggattttgagtcaatgcaaaaagggcccatatttgggagactgggctttctttagctcgttggatcttaccaaaccagccatgtgtcacaaaaggtatagagctaaggcttatgttggagacatgctgagtgtgtgttcctttaataagacacgtggaaatctcaaatatcagtgctagaaggcatgtagagatcatttcagacttgtgaaatggaactacagaaatggttcaactgtttgctcagagtacaaagccagttaaaggaagaaagtagactagcttagagccctttggacttctacttgggtagaggtagaagtcacttcagccatcctacagccctggcagaggatatttggccaacgaagtcactctcccatgcaaccttccacccatccatgtgagcaaatacttactgaatgccaggcaaggtgctggatttggtgctgaggatacaaaaagctagagttatgacaggtcttcaacttaataaactacatcagaacaattctatagtcattatctgtatataccctaccatcatctgccacttcacccaaatgaattgctaagttgctgagtttggaagggtcttttaaattcggataatggtgaggtacttttttggctacattctgatatatccagcacatatatgcatttcctgatgatggtcttcacggacaatgggagaagggctaattttgaatttctaataatgaatccttgtatccctctgtataattttatttcaatcaggttccaatcacagattattgattttattatctaagtatattcttcttactctaaatatttttcttagattaggacaaggtttggattaggtcaagtatacctatgatgacctctgatttacattgctttacaacacacctgagacttggagaggagagagaggagggatgctggactagttcccctgctcagtcacacactttctctccttttgtgctgggatggtgatgtgaggtgtctggtgtccctgacgcagtcagctaacagcttccttaagaagcctggccctgtgctaccctcagtggcgtttgacacagtaatagacacacattacagacgtaaatagcaactccaggttttcgcttccatggaagtgtgttaaagttatgtccactaaatgggttactttggctttaaataatagaccccattgcttctctgttcctcagcgtgcgatgtggtttcacctaccactctctgctttcaacaaagcagataaggtatcaacacaattaaaagtgaaaaataatctgtctgctttgccggtagtgaatgcttacagaacacacactgatacaatagattttaaataatttatgtccggcacttttttttttttttcaatctgtaaatgaggacacctaatgcggaatggtcggcatgatactctatccttcccccattaagataacaagatgagaggcaatgattcagatcagtatatttttggagctttgagcggataaaaattaaaaattaaaagagatgatgttctgaaatactttgggtaagcaagctcataaaagccatttggaaacctgaaattacacattaattcagaatctccttctgaggggctcctaaaacacctttctgttttcttggcaggatgaaagcattacttttgtgtcactgcctggtgttttcacagggtctattctaatgctcactaaggcgtcatgctctgttctaatgtgcctcttgtagccatctttggtttgaaccaactaaacttcaggtgatgttgaaaacaaataggaattaatacatgaagctttatatcttccctctatagatatgttaaatctcaagttaccaggataatgtgattcatggcttattttccagcctggagggagtggttggtccaatctggagggatttattcagctgctataactactgttgacagtatggggaattggccccacaattccccaaagtctagggactgtgctatcccacagaaacaaaactgctaagctgttaacaagaggtggttcagatctttggtggttaaatgtagtttaatcatgatttacgggggcccggctctttttcctacacctgcctgtgaacatctcctaattattcatttgagaaaactctgaataaaaatatcaatcttgaatatgtgtgtgttccgaggaagaaggccagccatgtccaaggaaatgttcagtcctgtttcatctaaggaaaataattcccaaatttcatccacaggctgatgcttaggagagactgaagtgcttttggatgagttcaaaataaacactccctcctaagttatctcttttgtccttctggagaaaatgagaagggtaaatgacgttccatggaatgatcacctgaggaaagcaaaattaggctgaaacacccccaaagctcctagatgaggcttcctggcctgggggcagggtctgacaccccatcttttggagtgggttatagcatcagggaccaccatccgttaacaagcccatcctgggcagcagaaagctttgtgggccagatgggaagtagccactgaggagaaaaatgtaattttgatacaggaaatagaagaagaacagtacagcttttcactcaagatatatgtttcttctgtctaaagccagcaattttggaaaatgaagctaagagtttaaaaataagggctctgtcagggaaaataaaacaggtccccctacatccattaggctgcctttaattgaaaactggagaacaatctaactaattggcaggtacctcttttattacggagactgtttttccccttctctccagtgtaatcaaaaggctgctcctctttttatcaactaaagtcaggtatgaaatggaaaagcagagaggtaacacttaaaaaattaattgtgtgtgttctgttaaatgttctcctacaaaacaacttcagaaagtgcacagcttaaggtctttgaaacagcagcagctccaggagtgtattttcatatagcatggtgcttaggtggaagctataatgtgctaattgcagacaagttcatgttgtttaaaagaactttttcttttgcattggggacctatttaatttcaaatcttggcactgtgctgacataatatagctactttaattttaaggatcaagaaagaggagcctgtgggtgaaatttgagcctattttttgctaatttggaataaatcagtaagttaacattgctgcctgaatttatgatattagagttttaccaatgaaaatataacttccttcttcctttccttgcatataaagtattttggtttaaatttacatttctttgctgatcttccttttcttccttttccttctacatggaatatccatatgatattattctttaattataaaagttgcatatactccatcacaaaaaaagattgttacatccctgcctgcaaaggactccggtttcaaagaagaaagagacacaaagatcaattgttgcactgttgtagagagaatgttccaacagcatatgctggtagtgggggcttggcgggagcctgacccctcttgggggctgtattttggagcatgagcagtcctgaaccaaagaacaaggcagggaaaggactttcaagtcctagggcctgtggaaaggcactgagcagagagaaaacactctaggtttggggggcctgggtaagtatgactggacaaaggcatgagcaactttgaggggcaggtgggctttaaaccatttcattgctgatctcagtgtgtagaggtcgatactcttagcattatcaggcgtcagcctggactcaccacagcttttccatacaaggacagaatccattttgagagctggagcttaagtaatattttctcaataaacttagtgagatttttgcactgtcagagcagtgtctgtggtgaagagaagcagaaggctacatccaataaatccctgttatttttcagttgtcagacttgacttaaatgtaaatgcctgactagctttccttctcccattctcatagactctatgagtttttcctttttactccaggttcaggatggaaccatgtataagcgagaaaaattccagtgagaagattccaacatggccctgaaaattaaatagacttggaaaaaatgcaccaagctctagacaagcatttatttttctgtactaatttaggtccttaacattataaagcaatacaagtacatcataattatttgggtctgtgagaggcctttgaattatgcaatatgcagcatcgccatggtgatgtgccttgccgtcaaccagcatgttatggtagagccatgttctggttttgttaatggccaaatgttgcataccaaacttctaaaagagattttaaaattcatgctctttggtaaagggtttcagtatatttgagcatgttttggctctctctccttctgcttacctttttctcccccgcttctcagtacagatgagaaaatttaatttgggtccagatgagatttagtaattaatgtacaaagcagctggggtccgctaactcctgggctgtagctgagcagctattttgttgcatttttttttcaataaaataattgaaaatttaaaaacttaaaattcattggcttcttgccgtgttatacttagagtaatcctgataatagatcggtaactatggatttcaccaaggaagggcacaaaataactgacctaagtaatttagaaaacagatgtctttagttggttcaaattctcagaaccagatttaaagaaagcatgtggagaagagcgaaatcttgcattttagaggcttcgtttccccttgtcatacagtttttcttcctaccacatcttaattcaaactcttgagaagagacaaagtagtccgcaagatatcatatttatgatatttagcctactgcacagaaattctttgggtaactactcaacctcatactcttcaccttctttttaagtcacctttatttcagtggcttccaagtagtggtcagagacacctaggggatttataatgaactttaagatatcctcttgaaaccgtgcgtagatatgtgtgctgtttcgaaggaaattttatctagtttcaaagaagttctttgtgttcttttggcttctcccactccccctgcacccccacccccaagtcccttttacactacaaaaataaagcccagtagtaaaacataaaacccctcctgtaaggtttttctttctagcttttactcaggtcgtggaatttctcagaggcatcccaaggggatcctgtgggagaatgagtgtgattacagtgaactacttaattctgtctgatctacagtctttaaacataaggtcaaccagaagagaagagagactatccgagactatccaagactgccacgtcctcataaaggaaaaagagattgaacacttttgctgtagatggtattctgtagcctggactgactacataatttgcaggactttatacaaaatgaaaatgcttgtctcttattcaaaaattatttagggctgggcgtgcgtggtacctcatgcctgtaatcccaacactgtgggagaccgaggcaggcaaatcgttcgaggccaggagttcaagtccatcctggccaacatggtgaaaccctgtgtctactaaaattacaaaaattagccaggcgtggtggcaggtgcctgtgatcctagctactcggaaggctgaggcacaagaatcgctggaacccaagaagcggaggttgtagtgagccaagaatgcaccgctgtactccagcctgggcaacaaagtgagactctgtctcaaaaaaaaaaaaaaattataaaattattttgaattttaagacagtgacagcagagcagtaaactaagctctgggcccttctagatgcaaggccctgtgggactgcacagtcacatgccctgcccagaacacagctcttcactttttgaagacagtttagcagtgtttacttgccttatgaaacttgctccctgaaaattttgttttgagataattggtcacaaaacctggtggacttgttgcctaccaattaaagtggggttttgataatcagacctatatgatacctggtcatttaagaagtatggtatccaaggtcatgttttggaaatagaaaaagatatattttcacctaaattaaaggacattttatccaactgagtaatctctccttactattggtttccagtttacgttacctagtaacatttcttccctggctcatgttcctctaaaataaagaacattgtgaactgaatacattggcttcacgcccttcctgggacatcatagactttggaagtttagaccttgatgtctgatgatgtgagttcaggttctgagttaagaacatgggccacctttttgttggtattctcagggagttttaattaattggggattaaaaggattgagagctgtggtctctgggtctaacagaggttcagctctcaaggattcacctgacaaaatccaggaaaatgctgtaatcatattcttctcgaaagattagctttacagtgatgatgttttgctaaacctgtaatctctgccttctttagaaccatttttctacgcatattttcaaaattcaggctttcttttctaatagtaagtgtgccgaggaagcttctagaccaagggaattgaaaggagacttttaggcctaaaacacatggtcagattctcagtgaaagaccagaagataccctccaagttagcaggcaagaggtgctatagactaacagatcttatagaagccatggctacacctttactaagtccccagcactgggaccatgtcctgatggggatttattaccttttttttttttttttaaacaaaaataaacaactctcagcttttgcccttgagacaactcagctttcttgtttggagtatggatttgtggtctttttcttttttgtgtcctggagtttggccccatctaacttgacttgttcaatgttcttttcattacatttatgcccaccctccctgcctagaaggaaactcactgtcatcaaaataatagggtgtttttctactttctccctccctctcacccattgtctttcagtggggtgaaaaggtcttcacttttctctttctccccccaaattttgctatgaataacttctcagacgttgtcacgcatagacttccactctctccagagggtgttttttgtttgtttaaggcaacgtgtttcctggtttaaaaaccatgtttcccagagtagctgtgatgggattattccacactcacctcctactggcagcatttactactggctggaaatgagcattattggcagctctctgctggcctggggtcacactgcacagagctccagccttgctgcatggctgaatgactacctgggctggtcatttggttacttttttattcagatgaggttagagtcttttagtgagtgaggaaaatatgactaagtaatgcttttccttcttttgctctagaaggagaaattatccttttgaactttgcatgggatagaaattaactctgcaacagcccagttcacatagatgtactttccacaccactttttgggtggattcccctgatccaatgctttttacaactaaatatagtgccaaattgcctttaaaaattttttaaaaagccttaattcctttcttcaaacaatcatgacacattccacacatgttaaacctgatatcaatggctctaaggctaaaaaataacttccattcaaaacaccacagtatgaattctcacaagcaaatgtatgattaaatatgagtcagcagattgcactgttactttagaaagcaaggattcttgggctacattcctgcctagacccaagggcaggctcaggggattaggtatttgtattgatacccagagctcaatatctacttcagatagatgcatgacgaagtcaatgaatcacagcttcctggacaatcttggcagaatataattctgactctagccctctactgcacagaagagtacagtgtctctctagtaaacactttgcatggctttaagatcttccccagtttaaacattagcccccttttccagctgtatcttacgcacacacacacacacacacacacacatgccatcatttacatctctgccagcctggaccactggctgttccctgcactttcttactcctgatctctgttgcttacccataatattcttgggggaaagcctgcctttccaattctactttttccactagagctgagatcaagtgccagttttcctcccttctaactcctttgaattcctaaggcctttatttgctcagtaaatattttatgtgtctgcaatatgtggatcaggcactacagtggatactttttcactgtctgcttccataaaagttcttatcgcactgcttggtggcatcttacatagtgttcacttgacttactgtttcttctgtactgagaaaggacaggaaccacctttgtatgctccaagaaagcttaccacatctactctaattggcatcgagtgaatgtatcaaaaagtgagcaattaaatatagagatggcctttggtatcatgaagttgtccatccccaagagcctatattgtttagaggttggacactgtcctatactatttggggatctttattttaaacatagaatgtgtatgggaaattgttcagaaaaaactgaggaaagaagttttgtcaataacagtagctgctattcactggacgcctgctatgtggccagactgtgctaacactttgcatgcattccctctttggatacacaaagttctctcaggaggtactttgtcatcatttttttacaggtgaggaaattgaggtcttagtataactcacttaaggtcatacagatagtaagtggccgagtcacagttcaaatccacatgtgcctgaactagacaattcaccaggccagtatctaaaccaacagaaatcaccccctgtggaagatagtggagattattgtgtgtgataacatctgaaaattagaaggtgaaacggggttcatgtgtgaagaaaaaaaatctaaagcaatagtttgagggtatcagaggagggaagatggcctaacccaattccatatcaaaatatgcaggagggagggagatgaaccacttttttccatgtcctttcttgatttgtgatttaagatatgtccatcaagaaaattataaattttatgtatttgggtagagaaggatatttaggtgtaaaaaagacagttatcttgccttttgatttttgcttctttctgcactgtagataataggaatgattggaaacagtggtacttcataccctcagggagacagaagtaatctgagtcagatgtgggcattccataattactgctaatacatgaaccaaatggctctaatgcatatatagccttctccaccatgtgagtttttctttttcctttttggttgtacctcagttctttggtaacagcagtcaaagagcatgaggtaggaagattgaaaaatccacggttagaaaatgcttgactcagtgtgtaacacagatctgtctttctgatctcagtaattggtgttcattgtgttaccggcttaactatcataaacaacagaagtcatgactaatcaagccatggttaatcaagaaaagtcataattaaccaacaagaattaggattaagcaacagaattcattattaagcaacaaaactcaagtttgaccaacagaattcgtgattagccagcagaagctatgatgtataacaaaagacatagtcaacgtgcacaagtcacagccaacagaggccctgactgagctgattccaactcagatcagtgggtctgctactaacagctgagaaatctgattgtttaattgcgtaaatacaaatgatatcaccctcaaggaatacatttaagaaactaaggtataatccaagacggttactatggctctggttatagctaggacttcatcaacaattacaattacaattgactaacaattgttagtcaacaattattatttgaatatcttctgtgtgttgggttctgtcccagccctgagctattcagctggtgtgtcccagtacaatttattaggtgttgaaaaattgaaacattttcctgccagtttttgcctgaccgttgccttgggtcttcccttcctccatccaactgtactgtcttagttccaggggtgtcatatttggcactgcctggaggccaccttgagtccaccaacttgtcagctcaggttcctaggaaccagcctttatacctatcctactcccctgtcagggaggcatgagtatcggcaaggaaggtggcacacttgatggcactgagacaccttaatggataaatgcacagtgcctattgggctccctgaggctggggccaccagccacaggttggcattcccccatgtcacctatgtaacctctaaagcagacagtgctattgttttagactttaagtatcatccttgaataggtataacatggaaggaaaagcaaaataccatgattgcctaggagaggaagcatccatgtatgcttagatcagtcagagaaggcttcctggccaagtgacctcatagaattttcctgggtttactgagaaaaggaagttcccagaaaatgaaagagtaccattacggtgtcagcagttccagagttggtagcagaaaaccaggtgttgtttttttgtttgtttgtttgctttttgagacggagtttcactcttgttacccaagctggagtgcagtggcacaatctcagctcactgcaacctctgcctcccgggttcaagcgattctcctgcctcagcctcccgagtagctggaattacaggcatgcgccaccatgcctggctaattttgtatttttagtagagacgggctttctccacgttggtcaggctggtctcgaactcccgaccctcaggtgatccgcccaccttggcctcccaaagtgctgggattacaggggtgagccaccgcgcctggccgaaaaccaggtcttaagacttctagccacaatctcttgggatagtattgaaacattccaacttcagtccagcacagatacctgcctgaggccctcacagaggtgttacgatgactcagttctaagatgaatataaaagccctcatgatggtgtcctttaagccacaggctggtttccagaagttgctattcttgcccatgcagatagacagtctctctttccttagtctgcaaataccacctcttctttcgccaaaataccacctcttctttcgccaatttctttgcccgcagaaactccccaagtctcactctctaggtacccaactcatcacttcctggtgtgatgacacacttggaatcccagaaatttgtggctggagaggaccttccaagtaaactgcccaatccctcattcaggggaagagagagcttagtcccagatggttgtgacttgctcaagtcctctcagtgaccatgaggagcttgcagcccaggcgttcaactcctaatccagggctcgacctatgctacctccactctctcctctcaggttgctcctccaaatgggactgaattcatcctctgtacacgctcaacttttgaacctcctcttctccagatgtgtctaaccatcccttggcttcaataactgtcccaaactttgtcctgaagtttgggggttctaattttaggtgggaaagatccatggctttaaatcagtcacatagtaagaagcttattttttttctctgaattcctcaaacagaaaatcttgagtcagtgctgatgtgtgtctcatgctggccaagctcccttttcagcaagaagtgaggagggctggggctcctggcctgcagcagacacagtgtccagtatgagtgaaatgacatctgattattgtattatttgcatttctcttatttcatgagtaccttctaatattgacagttggtctggttttccaagtaagccagagataaatggtttccactttaaatagtgtcaaaaatagaaggaggagtcaacctaaattgaaatattagctaagtaaactttaggtgtatgaggataactgcccccaccccctacccgccacacactctgggtcctcaaagcagtggtctacaagggagtgaggtttgtataaactcataatatcaatgaaggaggaggagaatttttatgatgcaaacctctattcggcttggagggcacgtctgtttactcaacccacgtataaaaatacctcatagcatatattttagccagcaagtattctagcatggtggaaatgatttactgaaacttagaccttctcctgaaatccagccaaaaatctgatttggaaaaccaagaagtcctatttagtttctgccatcattgttactgaatcacactgactgggcaattagtgacataaagttctttaattctctggtcttctttcatttgagcatcgtgagattgttcttctctcctttctggtcactgactaagtgtttgctgaactaaaaatttggtttttaataaaataaatggagggggtcacctttgtccatacctcattttcttcccacgtatataaaagaccatgttttccattgtgttaatgtttctcggcagaagagcgatggaggtttctgtaaactgagtttctacatctggcagcagaaagtggcccacagttatattttttgtagggaaagatatgttttcagatgaccactctgcacagattctgggaggatttcacagtatttgtaacctgttattttagattctaagcacatttgtagttccagtggcacaaaaataaactgtgttttcttggaaaatgtgtgtgtctgggatatgtgacaggacttgcaaccttaaacaagatttccaggcacttatagttgaaccatgccagtaaaaatatgcttatttagacattaaaatcctagggtgcccacgtaagtatcctaagcaatgtgtgttacatgagcattctttgctaatgtgctttagctttgaacgttcttagctctggctcctgcagtgttaatgtactgcagggaaagttgaactcagatggtggggcttagtttctgttcaacacatttgatgatgtgtttcttacattcaagagagtagtttctcgtgtaggtataagtcacatcacaactggtaaagtagacttcctcactcttaatactcatagcaatgtggaagtttttcttgggcattcagaagagagaaaaggcagcaggtatacccttcatctgtgtattcggcaagcatcacttgatcatccattgtctgcaaagctgtatgtagaaacggggaagacaaagaggaagttggggaccctttcttctggagcctgaagtctgctttatttcatcggtgtttcccagaaaatcaggataaattgcttcttttgtcaaaatgtgattttcaaaaagttaaaaagcaaaaaactctttcaagtgtttgtttagtaaacacatgccaaaaatttatttaactcattgatgaagggaatagtaggatgacaaagctggtttaaaggaggatatgagaaagatattcaggtagatagaaaacgagagagaaaggagggaaggaaaagagaataccggaataagattgcaaagctagatacaaaatggttcatttcctacagggcaataaaacaataatatttggggttattgttcatctggtcagaaatgttttgcacctacactagacaaaaattatgtgtaatttaccaattttctacagtctgtatagaatctgggtccaatcaatagtaaaaagtaagtcaaacaaagttatatttcctgtgagtgttagatgacacttcgatgggcttgtcagtcagtgctgtagtacattactacccggtaacgctttctgcaatgatgaaaatattttgtatatgtggtgtttaatatggtagctatgggccagatgtggctcttcagcatttgaaatgtagctaatgtaactaaagaactgaattcttaattttatttacttttcattaattttgatttaagtagcctcatgtgactaatagctaccatgttggacgacatagctctaacatgccattaaatgggcagacactcatttttatttcttgtttccaattttggataatttttttaaattgtattttaaatgttgtgagaggagctatgtaaaagaactcagagaagactcctttgaaaaaactaactcttgcattaggcaaataatttctttttctttcttttcttggttttttttttttttttttttttttttggttgttgttgttgttgagacagagtctcactctgtcacccagactggagtgcggtggcacaatctcagctcactgcaacctctgcctcccaggttcacgcaattctcctgcctcagcctcccaaggctgggattacaggcacgcacaactgtgcctgctaatttttgtattttttagtagagacagggtttcaccatgttagccaggctggtctcaaactccttacctcaaatgatcctcctgcctcagcctcccaaagtgctgggattacaggagtgagccactgcacccagccagtaatttcttttattgggtaaaaatcctcatatattggttttcttggtagtgcgctcatctgaaattgttctcgtcagcaagggagccagttatgaagctaagcctgtttggagggaacccaactctggtgttttccaagtaaatcagcttggaattaactttcctttagcaagataataatggtcatgtctagttttgattaaaaggggcttttgggtttgcaacaaaggaagaaactattgatatctcacgaggattttaaggtttatgtaagttaacttttctgctgccatcacttcgttactcaaaaagagcaattaatgcattgataaggttggctttgatttctgatgaagctcatttgctttactgagttttttcatcttcttgcttgcttgcagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatgtaagtggagtctcaaaaaactttttccctgttttccttatctctgtgatttgctcaccttccacagtcatgtggaattcacacacgacactaacgaaatcttgccaagggtaggtgtgaatagagatgacatgaaaatggggattgatatggagattttgagatgaaacttgagtgacagttggtggaaaggcaggagttaggcgtcgtggatgtcagatttgtattccaaagcagtggctaactcactgtggatcccagagccattagcagtaactcaagcatattacacagtcacacggtgactccatttcccctatcttgacaatgggtataaggatcttcgcctgtatcggtgaggataagataaaatgataggcatgaatgttaacagtagtcataatttgcccttttttaggagggaaggattgtataacttgtggaagaaacatttcaaaatctgggacactggcatttttccaaacttgatttcgtttttcttctccaagccatcttttccaaacaataatgcactttattagtgcaaaagatattttaaaaatacattaaaaattggctactggtccataaatatctgatgatggggatttgaaatataccggctttagtataaaaagagtatgtgtacactgcaacaaatttcgctctttctctatttgatgtgtacaaatgtagggaataagaaagtattaggtggatggcttggctcaagcaggcatagggaggtcatggggctatgtgcccagtgatgctcttgtggggctgctgctctttctgtcactccatcatggggggattttggtgatggcgtgctgtgcacatgtgagcagtgggctgggtgctgcgtggggaccctagagatacctgagacatggctgctgccctccaggagcataggataaagagccaggcaccccaatcatgatcctctaatggagttggaggaattacattatgaatcaagggctcttagatgttggaactgggaaacgtgacccttgggtgaaaactgattgaagaggtaaagcccctgtagccaaccagaggcattactctgagggtgctcagctgggaatcttgccctctgctgggagctattgctcagggattgtagcagatgtttgttggtagcccacccagatatctttcctaactgtactcctgccccttcacctttcctaactgtactcagattttagttttcttttataccccttaggtttcaatgtttcagagaaagcttcacagctgggatccactcagtcaattaaagccaatcagtgtattttatgttccagccgcatgcgtgaacatgtaacctaggctggttcaatgagagggaattcaagactcgtgcgtagaatatcaggacaggagtacccttccctccatccatgtgaacaaggaaacaggtagccacaagtacccctggtggccatcctccaatccccagggaagtcagctgtaggacaaagcatgcactgtagatggaaaagtggaaagacagaaatcaagcccttaatagcaccattgaattactgaaccagccaaccctatgaaaccactgcctccaggtcgttttgttatatctgccaagaagaacccattacagcttttggaatgagtgtcttgttaatatttagagtcctcatgaatgagaatggactgggtcatcagacaggaaagcatcctgcatgtgccattccttctgggaagctctttttcctctggacaattccatctgcagatcatgggtcacttggccacatttcatccagttcctttccctctctccaaattttagagccattgagttactcaaaatccatacatttgaagataggaagctaacattcaattggctcaggctctaaatccttccactgaagagaaaagcaggataacctgaaatagccagattattcctatgtgtgagattcacgggatgatcaccttctgctctagttttggtctgatgttctgtagacatggatggcacacagcatttctgtgggagaatttcagttcaggctgaaattataaatgagtaagccagatgtggactcagggaaaatcagtacttttgcattattttgtgtgggctggagacccatttcctgcttacattacttaaaacccatatcctgctgctctgtaaaaactggcagcttggttggcaattaaaaaaaataatgtttacacccacaggaaaactccagcatcagccctcaaggagcttatcaccttaattagatttaaaaatatagaaatgggaagaaaatgggatcattatgtccaagtacacaaaaataaatgtatttttgttagaaggaaattgaagggaaagaaataaacacttggaatgtagagattgagagtctaattggatatttttaaagttgaaacagaaggaagcaggcaaatatgagaatcagtaaccaattataccacagtatacgcaactgaaatgaaaccaagaataatagatactcatagaatgttagaagtgaaaagggatcttagagattgattttcactcacctctctcatttgacgtacaagtacactaggactcagaaagatgacacggttctcccagcagtcccaactggctgaagacataaccaagactacagtgaaatcggccacctctcctccccatgccttctctgcagtagcgagattagcaagattcacattccattctagccataggacatgtcagttcatctgtatgtgtcagaatcctttagatgagagtgacagaaaacccagctcaaactggcttaagctacacaactctacgcatgtcactgaacagtccagagtaatatgctggatccaaaggcacatgtttgtttttggggcattgtttctctttgtctctcacagctgatttttgctgtgctggcttcattcccaggaagattttccccatgtctaacaaagaagggcaccaacagctccagactgttaatctattgacccagcaaaaagagagactattagatcccgattgttccatcaaagcctagggacagattctcattggcctaacttgggtcatgtgcccttctgtgaacgcattgctttgagcagggcattgctttgggcaggggatagaatattgtgattagccaggtctggatcatgtgtcaatatctacagcccaggattgaggttgacttcacccaaaccatgtgggtggggagtgtggaagaaaatgttcctcagaggggaatcagaaagacaggaggcaaaaatgacctcatgtccaccatgatttgtcaggtcccacagtgctgttcccaaggcactcttctttatgctgtgggagaaaaaaagaaggataaaactgagaaaatttaagaatcattatagtaatagctaactggacagggtattttctatgtgccaagtattacattaaccactttttttttttttttttttgtgtcacccaggctggagtgcagtggcgtgatctcagctccctgcaacctccacctcctgggttcaagcgatactcctgcctaagcctcccaagtagctggcattataggcgcctgccaccacgcccggctaatttttgtatctttagtagagatggcgtttcatcaagttggccaggctattcatcatgttggccaggctggtcttgaactcctgacctcaggtgacccacccacttcagcctcccagagtgctgggattacaggcgtgagccaccgcgcctggcctgcattaaccacttttaatgctttatcccattgatcttcataacaaccctatgagatagattagttacaattcctccttcccaggtcccaccatttttttggcagatgtggaagctgagacacagagacattaatttactcaaggtaacacagttagtaaggggcagtgctgagatttggaaccaggcagtttgatgagaaagtctatattcaaactgaaatatatactgcgtgccataggaagcagcgtttaaaactccgagttcctttttccactctattttattgccagtggttaataaaacaataaccatgctccttgctctatattagagatgtatcccctagaaaatcatgtgcaaatttaatttttatagatcaaatttgattttacatgtgtaaggggatttacaagtaaaagaaatcctttaacgtggcctatcagaacagtatgcttatttcttcattttttttttttttctgttttgtaaatgctgctgggtataccttgtattttccaagggcttataggactagggaagcctttttgcagagaaacagctgtctgtcaaagcatagaataatggcaagtgaaaaaaaaactcgatttttagcagcattctaaagaggtggtacaatagtttatgaagaattggagaaggaggcaaaggaagcaaactgactcgaatgatgaacttctgctggtggcgtgggaggtttgtaatgatgtcagaagaggaaagcatgtggcaaagccctgaaataaaaacaattaatgaaaaagagaaacaataaatgaaggcataacatttggattatgaaagaaatgtccagacaagcttacggtatagataatagctaatggtccatgatgggaaagaagatttaagatgatactgtttagaaaccatgggagtaaagccctagaaagcctgatcatatgcatttaagtcagttacagaaattcaaatgaatagttcagatctttaagccaaaggtcagcaaaccattttttaaaagaaccagctcttcaggcatggtagcgcgctcctataatcccagctactcaggaggccaaggcaggagaatcgcttgaacttgggaggcggaggttgcaatgagccgagatcgcaccattgcactccagcctgggcgacagggtgagactccatctcaaaaaaaaaaaaaaaaaaaaaacccagctcttttttaaaagatgttagaaattttagaaaatatttttgaggccctgtgcagtagctcacacttgcaatcccagcaatttgtgagaaggagatgggaggatctcttgagcccagtagtttgagaccagcctgggcaacgtggcaagaccccaactctacaaaatttttttaaaaattagctgagagtgatggtgtggacctgtggtcccagctactcagctaatcgggaggctgaggaaggaggatcacttgagcctgggaggttgaggctgcaatgagccattttcatgccacttcactccagcctgggcaacagagcaagaccctgtctcacaaaaaaagaaaatatttgtccctgtcttcattacttaactctgccattatagcgcaaaagtagccatggaaaatataaacaaacaagtgtggttatgttccagtaaatctttatttacaaaagcagatgaagggctaggtttggcccacaggccatggtttgccaatgtctgctttaagtggctcatccggtggccaaggatgccacttagggctgctctgtgatcccatcccatgcttctcccctaccagtagacacacccagcttccagccacactacaccatgctgacttatgagccgtatgtctccatttttctgaggatttacctccttctccatcagttgaaccccaggagcctgatgaaatgtcatttcctctttgaagcctcccctaagcctcattccacactctaggcagaattattcattcttccctccccaaccctgttttctcacagtgcttcgcacaaagctccatgaaccgcaaacttattatattatacagatagtatgattcttcacacaccagtgagtctccctggctggattataaactcttaaaaggcatgcatcatgtctttctcaccttgtagcccctgaatatagcatgaagctttgctcggtgaagttagattgatcaaggggttaaatgtgaccagttttaaaggcaaacccatcttctccctggctttactttctgaaaagttgtcagaggcaaaacaattctaggtgtgtattcaaatcgcagtcattcgtttatctgctaggggcccagaacaagttactcaacttcttggaggctgtgttttctacctggatgagagaaacattggtattgactaacagcccaggcgtgacatgagaattgatgcttttaatcctgtttagacagcagtgtttccataagctgcttcctcttcccagttccctcccccagaagacattagatcttctagggcttttgccagtgaaaaaggctgagctgagcaggtgtcttggggagttgtgcatgacagaagcccagttaagagggagaagcaaagatggacatgtattggggtttggaccttacttttgccaaaccttagctatcaaagaagggggtccagggataggggagacactggggtcaggaggtcagaaggaaaatggaagacaagaagtaggccagaattatgactcgggtgctgtgaggaagggagagtagtataccctggatgcccctgaggttaggctaggttcccatgggtcattggcctcctccaagactgggtgcccctaccctgtgtctgtaacagaaacaccatggaaggtactgttgctgccaccccctcattccagctcctttctttctgaaaaccactggccgtgaattcacacagggagcctctttgtattgctctttgaggttatgtttatgtgcccatgcccttgagtgatgggcaaaacatgtctttgattttgtttgagaatgctttttaatgtttatttcacagcatttttttcctatgacagtttcataagtgtatttgtagaatagagcaattgaataatctctgaatttaaaagtccctaagcactcattgacaccttctcatttggggcatattgagcttaaaaacagcttttcataaagtctctaaattccaatttatactttagacatgaacgtccccatgggtcgattggatggaatgaatgtgctttgtatggacacttagatacttctgtgggaggattttgttgctctgtgtttctctcatttcccctttactgttaaacttagattaaaacaaaccttttggactaaaggcacttaacctcagttagaatcacctttgcttgtgcacaaattatattgatgtgctcattggttctactgctggattttactggcttaataacagggaaattcatattgtaggttgcactgtgtagttgggaaattacataaaaatcatcatcagggcacttaatgtctttctaattttagtttatttcttcatttgttcccgtgttagatcccagcctgttactttgcttccagggttcactgtgatcattttgttctgttcaccagaaactaccattaacccccaccttctcttcttgctctgtggcacacaaatccctgaagagccccccaaaagtaagtgaaaggctggaaacttcctacttttatacctaaaaatgtcctagaagctggaaaataaaaatctgctgcccctttctacttgccaaatatgaatatttgcctgcatctgtttaggagatttaaaaaaaaaaaaaattatgtttgggtaccagcagcccggtgatgtcagtgccactgtgggactcaaagcccattaacactcagactgaaaaggaagtattaaaattccttcagctttactaatatatttctccccactgcctgtctcctggagaggggacactcagtacattctcaccttagaaaaatgagaaatttccattacacaatagaacagcacaggggaaagaacaaagggctttgaagttagcctgagctgaggtcaaatgcagccctcgcctctagctatctcaacttgggcacatggcaaaattttgcttcacgtgaaatgaactaacccattgcgtggagattatcacagaaatgttgcaggattgttttgtggattggactcatggggtaatgcatttagcaccgtgcttggcacatagtaagtgccgaatgagagtggttgtctgctactgcttcttttggtgacacagtttggttgccgctgttgctgctgccacagctgtgttttattatagctacagccttgattatacttcaggagaaaagttaaaagtagagactctattcattttgaattgtttagaacaccacagcttagaagtgcagctccaaatattatgtcacagccttaaaaataaagtttgcaagcatggtttctaaaataaatatccacctttcttggctacttaaaccgggagccaggtggctcatttgcccagagatgccgagacatgtgtaatcagagaatgggagagtatcctggtatcctggaacccaactccatggagaaaactgaactggggtgttagaaaggacgcctggcccccttccttcctcagtcagctcaaggtgaggccatcagggtcttccagcagtgctgagcccaagctaaatcgccacagagacaaagttgcccttccccttccccgtcctcccagcagctgcctttctttgctcatctggcaccttccatctctcctctgccttatttgggactctgtggcctgccttcctccagatccgtcatgtcccttctcccaaccaactcctgtccaccctgtggcctcctcagcaagactgcttttgctgttagccacctgagaggaaagctggggaggatatcagtggtgctgtggtagttcatggtcatgaggggctttactaatggcaacagccccaagacttcaggttatcccatgcagcagataggacaggaatcatattctgattcagtttcctgagattgagagagggtaagagacctgcctgaggtcacacagctggtatacacccatgggtcttaattctaattcccagcatcctttcaactaccctttgcttctctaaacaatgaagttcttgcacatatttaaagctacacggttttcagtatcttcacctgtattcgctcccacatcaaatattctataattacaggccgggcacagtggcccacacctgtaatcccagcactttgggaggctgaggtgggtagatcacttgaggtcaggagtttgagaccagcctgggcaacacagtgaaaccctgtctctactaaaaatacaaaaaaattagccgggcatggtggtgagcctctgtaatcccagctactctggaggctgaggcacaagaattacatgaacccaggaggcagaggctgcattgggccaagatcgagccactgcactccagcctgggcaacacagcaagaccctgtctcaaaaaaaaaatctataattatgtggtttgatttaacgtgtatactagtttaatgcagtatttccctaagtgtaaactgcacactgtgatatgaaatataattttagggaatattgaacttggcataagacagtatgaactcatttaatgataaagattttcctttccaatatttattgtctttttattaccaatgagaaaaatctcagtttgatgccaatacagccttaattaatatttcttgaatctctgctaatctgtctttttaacagatggcaacaatccctaggtaggactgaaatgtatttatttcagatgtctgcaaattttcttaaaaggccaggcagtaaatattttagcatctgcagtccatttggtgtttttttgcaactactcaactctactattgcagcttcagagcttcacaattgagcatggctttgttccaataaaactttacaaacacagtcacttgacctgaaaaccctgtttattttttgttttttgttttggtttgtttttttttgagatggcgtcttgctctgttgcccaggctggagtgcagtggcacgatctcggctcactgcaagctccgcctcctgggttcacgccattctcctgcctcagcctcccaagtagctgggactacaggcgcccgccaccacgctcggctaattttttgtatttttagtagggacaggtttcaccgtgttagccaggatggtctcaatctcctgacctcgtgatctgcccacctcagcctcccaaagtgctgggattacaagtgtgagccacagtgcccagccaaccctgtttattttttaccctacctttctatttatggcaaatgacacccctttcccctttatagtagtaatacaaacatttcctctaaattttatttaagaaaaaaaatcaattgagacagaaatcgttaagtgtgtagcagcctgtgaatatgtgcaaaattgtgaaggcagtacttcaaaggactgaagtttgagaaacactggttttatatgttcttgtatcttaggaatagaagcagagtctgcagctgtggcctgagccctctcagagtctctgtagtgcctcagttgctggtcagatcccactgacatgcccctgccttactgcctgccgctaacccttcctcacatgctgaactctgtgcaccacttgaggatgggaaggggggtcttgcttttttgcatcctcaaggtttagacctttcctgataaaacaaggggtcaatgaatgggtggatctgtcacagtggattttaagcatccgggggaactgatggagggatgcagtatgctgcttaaagcctggacttaagggggagtcagattcataccccagcccaccacttacttagctctgtgtgatcttgggcaggtcacttaacatctgtgtacaccaagttgcttgtctgtaacatgaagagagtaatagtacctacttcatgtggctattgtgagaaggaaatgaattaatacatggcaggggctaaaaacagtacttagctaagcgttagctcctgttactgttccggtatctgttatgatactgagccatcctggtctctaaagattggtgtattcattcatcagcggtccttagtgattgtacaggacagctaatgctccttccgacccagtggtccctttactcaaaacaagaagtacatgtccttgggactcaaatctacccccacaaagcaaggtgatgggtagatggggccagaagcagtttcagctctgagccaggtgatctgatgttggaattcatggcacttcatcgcttacacaatcaactccaaatgtccaaatgtgttagcatgggcagagagccctgcacagctgccccagcctgtccaacactgatctcttgtcatgtgcccccaaatgtgccacacactagccatcactgaccactcggtgtcctctcatgtgacacagcatccttaggcggtgcctgctgttctctctgcctgcaatgcctttccctccctactcctccttgaagccaccttcttcctaaatgagcaggcatgcgcacatacacgcgacacacttttctaacagcaaggagtgtgtgtgggtcactcttgcctctccatgctatgaagtgttagtggcacctctattgagatgactttcagagtcaaactgttttttgggtggtccaggagcttttggtgtctgtgtgtgtgtataggtgttgagagagggaaaactcatcgcacagaaggtccctcactggctgggggtgcttcaagaacaagtatggagtttggtttttatttatatctttaattgtgagcctagtgccttgtacttaatagatatttctggaatgaattgaaagcaaagggtacggctgggtgcgatggctcatgcctgtaatcccagcactttgggaggtggatcacgaggtcaggagattgagaccatcccagctaacacggtaaaaccctgtctttactaaaaaaaaaaaaaaaaaaaaaaagtagccagatgtggtggcatgcacctgtaatcccagctactcaggaggctaaggcaggagaatcgcttggacctgggaggcggaggttgcagtgagctgagatcgcgccaccgcactccagcctggacaacagacggagactccatctcaaagaagaaagaaagagacagagagggagagagaaagaaggaaagaaaggaaagaaatgaagaaaagaaagaaaagggtacctaaggactggggattctgaatcaggaacttctgtctgatcttccaagagttaagagatttgaacacgtgaacttaaagtgaaatacaagcccaagaaaacattaggtcttattgatatcatgagcccatttttacctttcccattctgcctcctctcccactttgcaccatatgagtgatagcatgttacccctttcatgacatgacatcccaatgctgttttttccatggtggatgtaaacagatgaagcttgtaaataggtcctaacagagatttactttctctcaaaactacacacacacacacacacacacacacacacacacacacacacacatttcatcaaatcgatcatttcttaaggtgcactattattttgtataccactaaaagggaaaacggtgcctattaaaccaagacacactcagattgtaagacaggtggcaatttcagaaagggggagaggaagggagagagggagaaaccagatatctggtttcaaccctgtaagaaaaaaggaagtgccttacattctaaactggaaatattgtatgttttcatcttgagctattttttattctgctttaaatagacattgataaaaccttagtgcccaaagacaatccccagcaaagagagttggctgaataaatatgcaagtgcttctaaaatagctggcagagagccctttgtttggaaacaaatgtctccctaaaaatagcaacctgaaattctcctgcagtccctgtgttctggagcaatgaacatggccctttaagtaccttctcccagtgacagcaattctcaggagagtggctacctaaatcgctcagtaaatccttgcatagagtacagtctggaatttgctcctcctggagtggtatcaaggacttaaactctatctcttctccctctgctatcacaaaatattaactgtcatggttaggttatttctttcatccttctccctttacagctggaaaacaaagagttgagcaattatctgatgaattagattaatgaagacaggcatcttttagtactgggaccaagcaaagcaaacaccctgttttctcaggagaaggaaagtttttgtccaaaatacacacttgattgttccgacacttcattttaccaagcgtaaaatacctccatgattaaaaaaaaaaaatctgctcctttcattttcaaaatgattttaggacacaaatattttattgatattggaaaatgcaactcctccatttttctttgcttgtttttttgggggaaggggattataacgtcagttggtctgacttctaaacaatattttggtttagcaacattgtttaaatcttaaaataaaactgaggaacttaactagtgtttgaaaatggacccatttaggagccagtcatgatatggcccttccaaagggaaagataaaagttgcttctagtaaactctgtggactcaagagatttaaggaggacaggaagagaatcaagtgaaaggtaataagtgaaggagtcccactttatgtcctgaaagtgtccagacacaatgtttgagtagttttaaactgaatggaaacttggatattgtgtccttggactttcagctctcagaaatctgcaaatatgcagtctcagaatgtactcccaccctactctaatggatgcagtgagtgagttatttcaggaagaaaggcatcagggcttcctcctgtctcttggggctgaggaaactcttggagatggccttccccacattcttaaggataataacggtgtccaggtctatggagtgcaaagccccattttgtttttacaaatagtgccttctgtgtggcattgtattccttaaaaatagaattgcatccatcagattgaagtgtggtgctttactccaccagaatggctgacactaaaaggactgacaatagcaaatgtttgtgaaatgtgaagcaactggaactctcatgtgtggcttgtggaagtataaatcaagccaaagtttggaaaactctttggcagtatctcctaaagctaaacataccaatatgactgagtggttatattcctgggaacatactcaatagaaatgagaatatggacccacccaaagacacatacaagaatgttcacagcagatttattgataatagtccaatcctgggggggagggggaacaaacccatatgtctgtcaacagtagaatgtgtaaataaattgtgacatattcaaatcatggaatatgcttagtaataaagaactaacagcatggatgaactcaaatgacattgagtgaaagaacttagaacaagagacaagaaacagtctatattattccatttgtttaaagatttaaaatgagcaaaacttgtctatatgataatgagaagaatggtggttaccctcagaaaggaggtattgactcaaaagagccacatggaatccctgtggggtgctggacattctaaactttaatctgatatgtacatgcaaaactatgtgtgtattttatacctcggtgaaaaggaaaaagattaaaatatggagtagtggaacggccatttcttcctgtgcatagagaaattgtgttatcatcaagaagagtaatacctctcattagaagaatcttccttcctgttaataccttaacatttcttcaggcagtgttttaacatcttggcattttgccttttcctctggtttgagacccttttcacttcagctttgaatgtgtaaggagcaccagaaatgcactatgggccatgatctactcctagttccctgactatggttatctaataccccaaattgcatcaacccacctaactagctttttcttttagggctatgcactccaaattaacaggccagggatttctttacaacttgttatatttgaaaaattattttacccatcagataataaacagctaaaaaaagataatgtaagaattgttattgctaagtgttaaattatcagtagtggcagtatgttccttttagaaatatagtgttcaagatgtgatttatgaacttatgtggattccagtttaataattagctaattattcttttttccataattaaaaaaagcaaggtgctttatattttgattcattcattaaagggaactgggacttcaaatgaataatcaaattgagactggcttagggaagttaacaaaaagttttggctggtacaataggcaacctagttaaaaaaagccatcagagtaatttatttgtgagttctagatttatcaaaggttcatctttatttccttgtctttttttttttttgagacagggtcacactctgtcgtccaggctggagtgcagtgatgcaatcttggctcactgcaatctctgcctcctgggttcaagtgattctcgtgcctcacccacccaagtagctgggattataagcatacacctccacacccaactaatttttgtatttttagcagaaatagggttttgccatgttggccaggctgatctcaaacacctggcctcaagtgatccacacacctcgccctcccaaagtgttgagattacaggtgtgagccactgtgtccagcttccttgtcccttttatttttattttttaaaagtgtttaatatatactgacggcagaaaagaaagcagtaaaaatgacaaattcttccctaatgccagtttgcagagtacgagcaattaatccagcattcgaaatttagacataaagacatacaacttgtggtttcatgagatggtattttaacaagttgattgaaaatatgtaatgtcacttctaaaatatcaaaactaatggggttggttatctctgcaagagcaaatattaggaaaccctcaccctctttatagaaatatatttatctcttgttgctgtcttcaatgaatacaatgaggcttacaaaagtaatgtgaaaaaaatgacaactcaacagtaaaaagataaatagctcaattttaaaatgggcaatggatttgagtagacattccaccaaagaaaatatacaaataactaataaatacatgaaaagatgttcaacatctttagtcatcatggaaatgcaggtcaaaaccatgatgagatgctgcttcacacccattaagagggctgtaataagaaagacgagcaataacaaatgttaggaagatgtacagaaatttggacactcgcacactgctagtgggatcataaatggtacattgccactatgggaaacagtttggcagttcctcaagaacttaaacagagagttattatgggacccattcattttactcctaagtatatactcaagagaaataaaaacatgtatctacacagaaagttgacagaaatgctcatagaagcattattcataatagcaaaaagctgaaacacccaaatatgcattaattgatgaatagacaagtaaaatatgatatatccttacaacagaatatttttcatccataaaaaggaatgaaatattgatatatggtacgacatggatgacctttgaaaatattacgctaagtgaaagaagccagacacaaaaggccccatattctatgagatcatccatacaaaatgtccagaaagggcaaatccatagaaacacaaagtaacttcagagttgctagaagttgtcaagcagtggtgaatggggagggctgctaatggaaatattctggacttagatggtggtgactgtttcacaatttgtgaaatttgtgaatatattaaaaaccactgaataacacattttaaaagggcaaatttatagcatttgaattgtatcttaattttaaaaaaccgatgattttaaaatgttaggttaattgatgtaagggaaaatataaaagtaaaccttggagtcagattcgtatactaagttgtgtatgtgctagatgagggctcttatttggtaaaaattgtttctggtagtcagagctaaaaggggacaagttcagtgacaagactctcggtgtccacaagaggaaaatagccttgttgttcagaagaatcacagattttctagatactgatgtttgagatgaatgtttcccacaggtctttataaagtgagtactgggagacgtcatttaggatgtccttgacatttttcgttgctcttcctcaggacatccctccaggtagttagttattcaatctcatctgttttccaaattgaaataaaaaggcatgcaaaagcaaggcaatccttatgaccttagacccaaaagaaataacgatgggcatgaaattgagagagtacaataaagatggcttcctcaaaacaagagttgactctcctcttcattccatttcaaattctatactttaaaatagttctccttcaaataatgcatttatgggtattgtctatttctgtttgatttgcccttttaaagtagaaatcaactttttattttagaacatttttctctttattaaggtataacttacatatcttaatggcacagacttttaagtgtactgtttagtaagttttgataaatatatgcatccttcaaactacctcctaagatcttagaaggaagcatgggggagctttctggggttggaacattttgtatcttgatttgggtggtggttataattaaggtaaactcttccaatatctgtcaccataggttagctttgcttgttgaacttcacctacacagagtcacagtgtatgctcttttgtgtctagcttctttcattcatcattacctctgtaggattttcccatgttgctgcatatattggttgtttgctccttctgttactgagtagcattctattttatagataggcttttctcatgttgatggacatttgggttgtttctggttagaagctattatgaataacattgccttgaatatcctgtacatgctttgtgggaggcatggccacttatttctcccgggtatagacctaagagtgaaattactcagtcacagggacacgtgtttaattttattaaaagcagttcgttttccaagtggttattctacctgccattttaccctccatcagcagtgtatgggaattccacttgttccacatccttgccataccttgatatttcagtcttttaatttcagagatcctcctgggtctgaagtggtagctcattgtggttttaatgtgcattttcctgatgactaatgatgttccatttctttttaatttaataaaaaatttattaagttagaaagtataaaacaaaattatgcacagtttgatctcatatttgtaacaacacataagatttgaaagataaaacccaaaatgtcaaaagttattgccacgttttttaagcttacctgtatttttatcacttatcattttagtgcacatttgtttgtgtgattaaaaaaaagaaaagctacttttaaaaagcgaattaactcagattattctgagataaaacttcagttttcctgattttctaacactaagtaatgttgggcattgacaatgctttagatagaaatggttgagaaaaattgaggccaatactgtttttgcatttacttctttgtttcccccaagaggatcaaatccattcctaaacatttagaaatcttgatatctgaagataacatccatattcacctcagtgtaaaagaccataatcaggggtcagcctatgagccaaatctggcctgctgcctgtttttatcaataaaattttactggaacagccacatgcattcacttatgtattgtctgctgctgcctccttgctaaacaacagagttgagtagttgtcacagaggccatactgcccacaaaacctaaaatatctactatctggccctttaaggaaaaagttttgccaacccttgccatattcactcttaaaattttctattctaattcaaacactggttataagagtttagttccacgccaaatatatgtgcaatttgtaactgcagccttcatttctatccagttcatagaagctactcagtagttacatgccttaccatcctatctcaacagttcagtagggaccttctgatttcagctctggactgaaaattcttaaactattcctctcccagtctccaaaatctggtcattttaggtacagggaacataaaaagagttggttcctaatacaaatgcaactaactatgaagttatatccttttaaaagcacatatagatgagaatttaaacatccaactgataactctttttttagataaaataagtagcgactgtgaataaatgagcttgcttttcttatctagaaattgcctcagaaggcagttccagaagaggagagagaaaaatgtaagtggtgacactagcgttggaacaggtaaactcaggatgacttttctttgaacagtcatgtatcatataaaacctcactcatttatagccacacatgatatatagtgaaatgctctaacacttaagtccagctcatgacaaacttattacccttcactgaagcctttaataaactaccaaaaaggtatgtaaagcaaattcccttaagccagcatgatgcactggcccattttaaagatggacttcaagcaagaacagtaactgcctctgttttgtcagctgtagcacaaaagtcctcattcctaccctttatacacctaagggagtttgtgacaataaaatatcaagagtatcaaaaagctgtcaaagtgctttgagaaatcaaaatgctttagaaacagaggatataaatgtggttaattttattaactcagagccttcagagcaacctatgtctgggtctcccccatcaggcaaggaaagggcgttacctttctcctgaagtccacatcacccaagacttcctatctacagagcgtgtctccagtgaagagatctttgctatacatgctcttgtcacggtagaacttccccggcctacttagctttcaaactttgcgcatctaaaagatacaaccatctttcttagagttccttcctagatctaattatacaaaaccgggggtgccgcaagcatcacctcccatccaaactcatcacacacgttcctgtttcaagggtgaatcaacatgtgaactttgctgctgcagagagctgacagctgcttctgagttattcctggtgcctctgacagcttctaggatattctgggggaaaaaataagatatgagaatccactggagctttggttctgctggcctgtaattcattaataaatgtggaagagagctgtgcagtaggaaggaatgaatatacagtatccaccttagtctaatgtagaagctgtctattaaaaagcactaggctgagaacccagaatgtgacacctaggggccagccatgcccaactagctgggtggccatgggcaagtcacttaacctctctgggtagtgcacgtctataaaacaagggcattgaggcaataattggtaagatcccttccagacatcacacaatctgagacaatagattgtaacatccctttaattagagtcagtaaaacctcttcattgaaaatcatatttgcttccaggacataattacagtgaaacctaattcgtactgtgctctgctccaaatacagtagagagagagctgttaagtggtttttgaacataatgtgccaagattgacttctcttgctgcttttttctcatatgtcacctttttatatggggatctctgaacatttttgtcatggcgtgctataaaagagtatcatcattttagagatgaaatacctgagacacaaagaggttaattacctcactcaagaaaatatatgaaaacaaaatacttcaagcagaagtggtggagaaaaagaccggtatttgtgatatggaagataattgaagttgtaattatccactttacattttctaagggatctaccatggacatgtagacttaaaaatccatcaaaattgtactttctatgtcccttgccagtaaactgcggttgggaagagagaaactaagagaatggtctaaacaacctttcggtaggcgcagggggcggggcacgttttacgagtaggtggcaatatacacccatcaccctcctctgtataccaaacacagaccgcttgtctctggcttttcaccctcaacattgaagttttctttatttagcagtaaggtttctttattatcccctgaaaatagaagttgcccagggaaaggtggcaggttacatcacttcatggtgcctgagaggaagtaaagtgttgcctgcttgtttgagagcaaatttggaggtgggaggtaaagagaaggaagacatgagggcagtttgcaggaggagcaaagacagagaacactggaaaggcttggcccagactcaattaaggcacagaatttcattctggaagcacagccccgggtaagggggaggtctgcgggtcctcttagagccgtcgggcatctccattcctgtcttgccctcttcaaccacacctgaggtatattttgaaactgtatgttatggccctaggtgcttggcttaaggttctgtccgcagagaaggagacccaggctggttggtctccagtagacactgggtgagggacaaatggacacctgattagaatataatttaaatgttctccagtttgatggtgctgtctagaaagttctgttggtcacaagggctcgtatttgacacaaagaaatgtttgatttggtgacaactatgtgtttattgtaatcccactatgcgttgaaaactggattcggtttttcaacacacagtggaatcacagccaatatgtgcccaaatgtattgagaatatcactggtttccagtaagtttccccaatgttgtcagaagcattatttctttgcatatatggaattgagggatgtcctcccaggggaatggttctctgcccttgtttgtacttgatttctcatctaatgggggtaagaatcacattcttataaatagaaagactttttcaaacacagggtgtgatcattgtctcaaggaagtgtgggtaagttttttggcaaagcgaatgatatgaattatcacctccaggtagtttgattttggcagctgtcatacgaggaaaacaagggagatacggaaattcctttttaaagactcacgaattcaagatttatagaagtaaaatgatttggcaacatcaatggctaattaggggttgtgctggaaatagaacctggctgtactgtttctaaggggagtgcccttattaccatagcatgctattctttggagaggggtttttcaccagctgaactgaataaactacaaattaggattgtctgaaagtgagggacaatgtttaccccacatactttatgtggttccctcaaaaaaggcttaacgaatgttttttgaaaatggtaagcaaatagctttcttcttattttcctatttgaataaagaatcagccctcactcacactttcggagctaaagggggaaaaaataaccataaaacttctgcagcaatttttacaaactttttctcttgttcacaggacctattagtaacattgcattatttttttaaatggaccatttttagcgatagtagaagggagaaatctctcattcccattcctatataaagtacaatttaaaaactgcctctttaaaaagttgtagcattacatcctatgggcaatgcctaaggctgaagcacaatgaattttctgtggggtttcactgctgtgacctcgatatactataggttgttcactgcagctaggaaggaatttgtttaaaaagcgcaagaaattcttgaagtatccaagaagcatttgaaatcagaactgctacctttccctccacacaatgtgtggctgataacaaacatgcactttctgaggaatttgagcttaggtagttaaccgacagttctaatggactccagaagacgtacaaccaaataataatgacctacttttgttaccacggcacccagcataaatgatcattttaaactgcttggaaaatcaaactgttcagaaagtacttttacagtcaaggtcaaggtgtaggccagaaaaataagatgtaaaggataatttaatcagaacctttctccaacagacattagggttagatttgcaaagtaccagcagccccactggaaccaccatcttctccatcttggtagaataaagatgaagctcctaagtaattgagtacaaatcttttttatctcataaaagttaaggactgaaaccagactgacaagctccttcaaaagttttccctttacccttctcttcccccctcccttcctccctccctgcctccctccttcctccctccctccttccttccttctttcttcctcttcctatcctcttctttctgtccctttttcctcccatgtttttatttttcttttttatcattattttttttcatgagatacagtctcgctttgtcacccaggctggagtgcagaggcacaatcttggttcactgcaacctctgcctcctgggttcaagtgagtctcctgcctcagcctcctgagtagctgagattacaggtgctcaccatcacacccagctaatttttgtatatttatagagacagggtttcatcatgttggcccgactggtctcaaactcctgacctcaggtgatccacccccctcagcctcccaaagtgctgggattataggcttgagccaccacgtccagccctttgtatatttttaaaaggtcttcttttctagctcttggaaataaaatcagaaattatactttatgtggaaaatttcagtgtacctcataacattataaagtgttctgacaaagctcttcaaaagtccatatgttcatggtgttaaatagatgaggggaaaatagaacactcaaagatctagctcagaaagaaaattctcagaatgctaggttatcctgttcattttggaggcaacacaagacaggcagaatgaaagtgtggtgtcattttgaggggagaggcagaggacagaaggggcagagagagccggtgtggaaagagtggagataggatgaaggtaggaggtatttatgtgacaccaaatcacccctgcctcccatactcaaaaacaagctccttgaggtcagaaatttcaccttcattgtcttcatagacccccctcagcaaacatagcttcgggctcatgccttcatgaattgactcattcatttattcacatattttctgagcacttactatgtagactttcaacaaccagtatttattgtgtgctgttttagatgaaagtcagcatagactaaagggttcctgatgtcctgaagtttatgttcagggttgggagagggtagacacaggcagataataagcaattttacataaatagaaggtggtcatcactgcttagaactgtgctgtataatgtggtagccatgtaaatataaatatgaagctgagcatcatggaggtaaaggggtctattttatgaaaagtggtcacggatggtctgtctggcaaggtaacatttgggcagggacctaaaggaagtgagcaagtgagcaggcagatatcaaaggaaaagtgttccaggcagagaacagcagttgcaaagctctgagctgtaggctagggggtgagtggtaaacaaaacagacacagtcatggttcatcctcttggcgttttcatttatatggaaggtagacattaatctaggcaacaaagaaatgcataattaacaatcaagctgtgatagagaataagtaggggaagggacttaggactggctgatgagggaagcctcatggaggaggtgtgaagcctgagcacaagtatggagagaagagggcattccaggtaggagagcaaaggggagaagtttcctgggctggaataagtcttctgggaacccaaatgaaagaagactgctggggctggaatatagtaagtgaggaaggaagtggtccaatatgtcattgaagaggaagccaaagggtggtgttcttgtagcccacctgaaggagtttgatttttattctcagtgcagtgtagcccattgataagtgataaacattgagtgacatgatcacatttgcagtttgaatatactgattgtgtattctactgtgtggagaatagattgggcaaggggctgggaatggaagtggggtggttagttaagttgtccaggcaaagcataatgatggcttggactaatggagttaaaagagaaatgaaaaattaagttaaatttaaaaataaagagaagtgaatggattttgataaataaattagagatagaaccaacattaaatagcacataaaaggtacatggagaatgttagatggactggatggacggatggatggctggatggatggatgagtgggtgaatgaatggctggttactagttctctggcttccaatgcaattctggcaggccactctcaaactttaaagagaacagggtgatatctaagctggtacttagcggtgttccccttcttcaggtagatctttagtttcccatgattccttactcatgattttaataatggagttctgctggtgaaggtatcatattatttgccaatgaatgttcttgccagaaaaccttactgataattaagcatgcaactggaagcagggtgtgtgtgggaggtggggatgaggggcaggtgtatgtttatgtgtttgtgtgtaattactactttattcagtgtcagcagtgggaaagattgagttacttagagcagtgcttctcaaatggactatgtacaccagtcatctggggatcttgataaaatgcacattctgaattggcaggtctggaaggggacctgacattctggattccaacagtctcctacatcgtgctgatccttctggtcctcaggtccttctttgagcagcatgggcttagagcagtgatcagcaagtggctagatggcaaatatttgcagctctgcaggcaacagctccagaaatgccctgtgagctgccttctcatgtaaacccagcagtgggcctttgtctgtgactcgatttcctccttagggagacctagctggcgaggcctgcaactgagaaacaccaaaaatggtagtgaaagagcattgtatttttcaactaaaccaatttcctttaggatagaggtcaaaaaagctgtgctttgaaattagtcagctgtgggttcaattccatctccaaattgtctgtgaactggagtttccttaagtacaaaatggggctgagctgaccttggtagtgtgttatgttcatacatgcttgtacatgaagcatttagtcccaaaccatccaagcacagggtaaatgaaacaaaggacaactagtatacccttatgttttaaggtaaaaagggttttttgaggttttcgagggtagatagatgctcttggcattcctctaacaaacctaaatgtgattatttctcctgagtgactaaaactgtaaaactaactgtgattatctttgcttctatggatttaagagaaaacaaaacaactcactctgtaaacctccaaagaaaagccctccccttcgccccccacagattttcttgctgtttgtttctttacctcagtgtctcctactcaaagcataatgagtgctgtttttgctccagcaacaaggccctgcacaaagccaggcgggaggcctgtggatgaggtgctctgcaagctgagccagaagccttaggaaaatgcttgccaaacactgatgtttgactaattggtaatgtctgcggagttggcaccaggagaaaagaaagtaaagaggctggtggatgttgaggaaggaagacagacagacttgaagccaagcctcgagtgtttggagaaagagcctgcccaccatggagttcaaggaagcttgtcaaactgttttgaaatggtcggttaaacccctgaaggacagtgtgcccagatggccagcatttgatttagctgttcaggacagcaagagactgagacaggaagatgagcaaagtctcagatgtgccctcctgagtccagacagcttggtgtaaaattgtcctgtgaaaccctgttataacattttagtggcaccaaaaaagggtgctgggacaggggaaattccagcatgggccccatgctgtgtttggaaccagccatcctctgattgttgaactgaggtaactcacccagatgtttccctctttcaggcttagtgtcctctggaggaggagtagaaggaagggaggactcccctcctgccatgtgattcagcactggccagtccagtggataggatccaatcaggtgggatctcaaagcagtctccttccccttacctcctccctgagggatggaagggcccattcctctcaaggggcttccatgttccccatggtagggagggtagagatggctgccttaggagaaaaaagattcttatttctcctctatttgcatctgtccagaggactactccacacagagtagtctgatgtgtccactttcagaagcagcaacttttaaaacgcagccaaacatgaagactcgcctccctaggaacccttctctggatccgttctcatctttgcaagttagcattgattgggcctcacctccttcagccatgctactctcttaggttatctcttggtcagagtggtctttctgaagctaaatcaataaataataatcaatgtgtggctctctcctgctcaaaattgttcaattgttcaattttgagcaggagagagctcaaacgtgacaatgagatgaggagtaattagaatattacagctggttggaggataagtggatacaacagttttgaaaaacaatttagcattagttagtaaagtgaaagaggcatatacctagtgacccagaaaaaaatatagctattgcctaggtatgtgtatgtgtacatgtgatgtgtgtatatatacacatctagtatatacatatacatcctagaaaaatgtgtacaagaatgttcctagcaacactattcaaatcagcaatagaatgcataaattcaaacaatgaaatactatacaacaatgaaattgtatagtagaaaaacatggatgaggcttaggattcatcctaacatagggtcagcaacagaagcatctgtctctgacaactaaaaacacatatgttttatataaatctcaaaacatgcaaaacaaccttttccttaatggatagaaatgtgataaaattcagaaggaaactgaggaaatgatgaaatggacgatggagttacttctgaaggaggaggaaatgggaaaggaaacttcaaaggaaaacatgatatgctttgtcttaaaagtatgtgagggaacttcgggggtgttggaactattccatatcttgatcatagtggttttcccatgactgtatacatttgttaaaactcatagaactgtatgccaaaaagggtgaattttgtaggaggtaaagtatagctcagttgaaaatacccatgttaaagaaaagtatatggcggacacacagataatatttattatatatttttatataccttatgtataacttatattcttttacagctacgcaaggtactcaaaaaagtgatttttaaaacccctcagtggctcgctattttctcgggttagggtcagattgtttatgtggcctgtgttgcccttcatgtcctggcccctgctcgcctcccctccctgagcaacccacggacccgtggctgcctctccccttcatactatgattactgtctcagcgctgaccttgctggattgcagctgtctgtggacttctctatgtcccactagactgaaggctgcctgagtgttatctaccccttatatcccctgggtctggcacatcataggagttcagaaggacttgtgaagttttgttgagatatgcaggaatcccctttgattccgtagggggaaaaacaatgggaagaaatgggtaagaggtggagagtctacatggtgataattacttcagacttggccagttctacaggccaagggtttgatatcctattactgtggtaacaaattaccgcacatttagcggcttgaactaacacaagtttactatcttgtagttctggaggtctgacgtccacaatgggtctcactgaactaagatcaagaatttggcagcgctgcattcctttttggaggctctaggggagaaaccactttcttgtcatttccagctcctagaagctgcctgcattctttgacttgtggccacttccatcttcaaagccagccatggccagagtctttctcacattacattgctctgattgtaactcttcaggcttcctcttccactttaaaggagtcttgtaattacagcaggcccacctggattttccaggataatcttattttaggatcagctgattagtaatctcaattccatctgcaacttaaatttccccttgccacataacatattcacagcttctggagattatgatgtggacatctttgagtgggatgggggaggcattactctgcctactgcctacggtgaagaactaaaaaaattatccattgaaatttaagagagtgacagcatgtagcaaatgccacttcctggtttcaggatcatatggacttacgttttaacttttataccctaggagcaaaccctaagacaaggatttgaatgcatatagtttttgtttagtttgtgtgtttgttttacataattgccggaaacacaggtggagaaatagaaagagataaggaagtaaagatagccaatgaagagtgtgttttaagttagttattctgtgtgcaagtagaacttaacctggggaactatgagaagcaatgaaaaatacaagcctcagagttatctcaatcccaataagcaccagttaagggctgagggctgctcttaggagaacttcattccgaagacctgtgaaccacatgggttccagggccaaagaaagcccacaagcaaagagatacaagtgtgggtagttggaagtcagggcaggacactctgagaaagtcaaggccaagggggagatcgatatacagatagataggtagatagatagataggtagatagatagatagatagatagatagatagatagaagatagatagatacagatagatttatatatgtgtgtttgtgtgtgtgcgtgcgtgtgtatatctcaaattattaaagtcttctggtagtttctctggtgataatgtatttaatctttgtagcactttgcctcccaagagcaatgtatgtttgaaatctgccataaataatgtgaaaatgcttgaccaactgatttggttagcaaacgctctctggctaacatccagaagtgctacagttttctgtattttttattttgataaattttgttgtagaacaagaaaaagatatagacactttaaaaaaaaaaaaaaaaaagcagataccactttcatggcctgcaaattataaaaattttgtgtcagaattcttttctgccaggtaggaatttgagaggggcaaagaagagctcgatttaatttccctcagggtctttgctgaagggagaagaacagaaatctggattcagttttgttagtaaaaataatctttccaccagaaaatgtaaaaagctacattgttcaggatatttggacctattcatttcaatacagtctgataggtgggggtggggaggggagattttgagctgtgcagttttaatgaaatgtttaaggctgaaataatggttctatacagctcttgacatgatttattttattttgtgtcaatttgcctaaaatgtgtaatgttgtggcattccactgagggagggctgcaaagggctctcactgagtcatggattataatttacatctagaaagtctacacattccataattatggtgtgctatgaattagtagagtaatattgaatatccctaaaccccttattatggcttctcacttgaaatatgttttcaatatacatttattcagcagtgcttaaacatggcaagtcataaacacatgctttttaaatcatgtggctacattttcttcctgcttaaatgtaagatcagatgttattaacagcagaggggcaggagacgaaaggagagtgaagctgttaaaaaacaaatagcacttttcattttaaaagatatgtctcctatttatgatactgtttccccaaagcaaaagacggaagagtattttagagtgtcgtggtagtttctctagtgataatttattttatctttgtagcactttgcctcccaagagtgtttgaaatctgccatatataatgtggaaatgcttgaccaactgatttggttagcaaatggcctctggctaacatccaggaagaggagctaaatatttaactctcaaattattatgaacatggtccaaatgtctggagccctaaagaggcttcctataactgcttctaatgtgagaatttaacttcattctttgttgagagtggctcagacaccgagccacaagatgagagaattcctcccagggaatacaactgggcattttggaaagaaaggcattgcttttcaggacatttaaagttcacttcagaggctggcctcagtactcttgaaccaacttgagtcctatgcttgcaattcagcatgctgacactaggtggcaggcaaaactgaggtcatgccaaacttgtatagctaatgagccagaaggtattatattaaaaactcaaagagaattctttgtgaaagaataatatttgccaaaaatactctagaggctgcctccacttttaaatctaatgcattcattgtaaaggccatgttaatgcacactaacaaaaagctctatttttataaataaagtgaaaatatgcagttttatgggaaggggacacattactttgtttatataacaataatattatactttataccactattcaataaggtataataagttctgtaaatgtggttatgttttgctagccctgaaaaaatatgaaatcccatagataaatatattggtatcaggaaatactggaatgtgagaggactgtaatagcaccaaagtcaatcgaaaacactaatgagccaaacttaatgtgtcattagttgcctggatagtggtgtattatttcacaaaaggatagcattgtttattattttgcatcttgggcttttagttctccatgggtagtatagcacatggaatgcaagataaagtttggatatgtttgattagtgagaagtgagggaggagattgtatcttatgtgccagccagtagagtaagtacttactttgcaaacgatatatctaggtttctactttgttgctttcattctgcccagtcattggcagaaatcataaaacgatcccatagagggagcaaaaagaacccacatgattctattagacaatgctaaatgaaaaagaaaaccaattaacaaagtttaagtttaaagcagggactatctgtataaataagttttaaattatgtaattgaaagcatgatttaaagtaatgtaaactcttgggcaagagtaaatgccttacttcctaacacttcaatgctttgaataaatctttaaatcctggttttctcacttgtgatggtgagactcattcctgttgaaactttcagtgctcttagggggcttctcagagttcttcctcagaagcagcaataagtccttgctcatgtctagcaatttaagaaatgcttttactatgtgccagttgaagaaatgcctgactttatttggctcaatgcagctccaacttcctagagaattaaaggttcagtttattcttttataatcaatcatcagaaaatgagattattaacagtatagactttggaatcagtccatgttagttgaaaacccagcttcaccatttgttgacctaagactttgagcaaataaccaagagcatttgtaaaatgtgagtaatcatagtacctaccttaacagtagagaagtttggatgggtacctatgtaccgtgcttgggtactttgtacctggtatatagtaagtactacattcaataaatattaattattattactattattaatgggtcctcagttaccttactgagtctgagaagtactcagggtttttatactttttttccttaatagcataagtagagaaaggtcactgctcacaagccctgtgggaatgtcatgtgtgcttctcccgctcttcctgcttttccttcttccgtcaagtatctgggtgtaacaggttcccttatcagtggctttcctgggccccccggcacagtgtttgctgaacatacctgtttggatacacttttgtgacacaggtcatagtttttgtttatttctttttctttttttttcagaagaaactttgtgaaacacatctaatcacatttcaggtttgtattttgttttatccaaagagtccttacctgttggctttgggactagcacctaagccatcatctttaactaaaagatgggacaggctaatgctgggctgctagtgccctgaacactggaagaagttccagcttctgctgaggaggtggaggccatcactcctccagagacccttccttcaggtgcacccagatgtgtcattctgaagcccagaccatattctgtatgcttgccagtaaagtgaatgaaaatgatcaaaatagccatgtggctgtaggagaagcaaaatggagcaaactggatgtattgcattaatgatatgcaatggaaggaggagaaagtagtcaggtttgagttgcccagtgaaggaaaagcagcaaggacaggggcttggttttcactccactattagccaggcaagctgagtgttctgttggttacttaatttacgagggctttggatcagtcattctaaaacttgttcctcttttctttttcttaattaatgaatgttgatgaattctgaaatggaaatcttttggttggggtcagtggtcacttgcttggagtgatgtcagggcagtattgtctggtgtttagggacacaacctagctttatatcttggctctaccacctgctggccatgggacatcgggcaaataacctcttcatgtctctgtgtccttatctctttttttttttttttatgctttaggttctggaatacatgtgcagaatgtgcaggtttgttacataggtatacacgtgccatggtggtttgctgcacccatcagcccctcatcttcattaggtatttctcctaatgctatccatcctctagccccccagcccccgacaggccctggtgtgtgatgttcccttccctgtgtccatgtgttctcattgttcaactcccacttatgagtgagaacatgcggtgtttggctttctgttcctgtgttagtttgctgagaatgatggtttatgagttcatgtccttagcagggacatggttgaagctggaaaccatccttgtctcttaaatgggaaataatatgaatccctgcttcattaagttgctgggcaaatggaatgaatacagatggttcctgacttaggaggttggacttggaattttttttattttacagtgttatcagggtcttaaatgcatttcaacttagaatattctcaacttgcaatgggcttattgagatgtagccccaccttccatcgtaggtcaaggaaaaagaagtggcttacaagagttccagatacagagaaagctattagcgaaggtgaggaggacataaagatgacaacagtgataccaagtttccccatccactctcacctacccactatactaaacaatgtttttcctcttacctgctattaatatctcaccattcaaaacatattcagtagaacccaactcttagagttgatagggaaacaaaaaaataactaaatctcattttaagaacaagagataaagccaagagtaggttaagtgacttttctaaagtcacacagctagttagagacaaagccaggcctagataccatagtctgcagaattccagtctaatgctaataatatttgtcatgctaaagacacgacactggaataaagaatattaaagtgtgcatgcctcagaagacttagcagggtctgttccttgaaggctgaaatggaagttagattatgccaattcattacaacctcataagctagcttacagtaaaaacccaccatgggggaaaaacgacaaaatggaattgagacacttgaaggagggtaaaatgttttaaatcaaaccattcgttagaaagtagagtacaaacctagataagatttgtggtttcaaaaaacaaacaaacaatcaacaatttttatctctgggctctggtggatatggggggattcgtttgttacagctaaagttaaactgcagggaaaaataaaatgcagatgtgttgctgtgttgagcaaatgcagctgggcgtttctggaagaaatgttctctcagaaacttatcactgggagcagaaatggtgaaaagtttgtggggtaagtggcagagggttcttcatgggagttttatgaaagtcactgtgacataggatttttagaagccctaggaaaagaaagttggggagttttccagtgaaatttggattgagaaagaaaagaaacccacattgtgctaaacaagatggtggatccagttcagagaaattgagtaacagacgaaattcccagaatcatgagaaaaactagtcaaagacttcccctggggagcacccggatcaaaaagctgactccggggcctctctctacaggttgctgaggaggggcctgctgcagtaggaggctggaaggggtggtttggaactgagtcaagaaaagaccccaaacccacagggacagaggaagttgaaagaggggtttggcttagtggaagggaagggaggttggtcaagagaggcctgctgacaggaaagcggctgacaacaagaagcatctggaaagggccatttgatgctttaagctcatgccaagctaattgagtaatgtgagcttatgttcttgtaaattacttcaactgtatatagttcttcccctgagactgtcttactctgcttttcaaaattggttgtgtgtttgaataggccccgaatgtgctgcactctgtttgcgtgcacacacaaacgtcacttatcgatatagtctacattcgcaatactatgcactgactcattcagttttcacaaaattcccatattgcagatgtagtcactgaggctcttgtggggctgttttactgtggtgcccttgattcctaaccccacattgccgtatcatgaaaatgcctgtggaatgaggggactgtgggttttagtgtgtatttctgcagctcccttttataaggaggctctcttctatgggcccaactctgaatcatgatgccgtttgatttacgactctcttcttgaatgcctggagcagaatccctcagttcataaagctgaggacagaagttttaactataatcaaaatgaagactcttgctcttctttacccagggccttctcccaacctgtatctcctacctcttttctctcctcacagacagaccccaaaatcttagcctgcctattttgttgttgcatggaagtcaggatatctaggtcagtttatccaagtagaaagtgctactttactgagttaactctgtgaaaactgctgcctctttactttatagaaacaaaatcccttgtgtgcaggatattatctctggaagttttcaggggcttccaagtaatcagttagatttaaaatcaacaatgaaacttttttttttaagcaatggtgtttcccagtaacaagtgtctttttcattgttttatcagacactaagtcaattcaacctttttaattgtgaaaggactttaaaatgcccaatgctactacgtcagtgtccagaaagattggaatccacctgccaggatgggaggtttacacccatttcataattatatagaactttcttgttattcccataattcgactcagttatatcattaaacccatctggttatcaaaaggaaagggattgacttggtaatgcgggctccttttttttgctaagcatcattttgaattctatctttacatccgggttttagatgtcttatagttgtgatttttaaaatgtattaagatatagaattacgttcataataatattcttcaacagtttagagtagtgctattcaaagtatggtccatggaccagagatgtttggtgtgctatttgttactaggccccacaagttagggcctgacgtggagagtaggcatttagaaacttcagcaacttgatactgctgcaacattcaagcagcatttcatttttctagtagttcatctttactgtattttataaaagtatttgtccatgataaattagaaatggagggaaaacactagaatcatggtccttcatcacaatagtttgaggaaatctattgtataatatacatcatttcatttggtgcaacaccgaatgagatgctgtacaacaggttttgtgaaggagatagggattgcattttaagccttatttttcaggtaaatatacttgggttcaaagaggtaaaagcagttgatgtcacattttagttcctcttacccacagccagcattttccaagatactactctgctaatcacagacaagttgaagcaagcttaattacaaatagtcttgcctaagctttttaaaaggtttctttgtgtataattaaccttgaatgatctatgaacagacaaccgttaatgacatttgagttctctcaattcgtacaaccatttagataccaacaagctggccagttgcctgtgctttccaaaacagttgaaagatggtaactgcatagaactttaaggtttgaaagagacctaagggaaaccgcacagctacctggcaatgatcctctggcagacacatcagttaccatgggaagaatgtctcatggttgacagcattctatttgagggaagcagggacaattagaaagtccccacctctacctatttaactcctacctgttggccctatatctaccttctcaaggtactgagaataattctcaatatttggtcataggcattgtgtcccttctgaaacgtcttcctctacttcaaaccaaacatctctaactgtttcagtggtcgcttttgtggtatgcttcaggaatgcccctcacccacagactcaccacctggccacactctctctctctcttttttttttttttttcttttttttggcctattttttcccctttatttcttttttttttttctcttgttttgtatttcttttttcccccccacactctctacattctctttagtcaatgtccatcctaaaataagagagtcccattaatggatcctggtattccagaggtggtctgtccagagtacaggaaaatgatcatcttcctcgatccatacactggatttcttatagtgcaatctaagactgcattacttattttgtatccccatcacattgatgtcttatacaattgactcttaaacaatattagtttgaactgtgggtccatttatatataaattagagtgaactgtgtgggtccctttatatatgaatttttttcaaccaagtgtggatcaaaaatacggtatttatgggatgcaaaccccacatatacaaagggccaacttctcgtacacacaggttctgcagggccgactgctggactttagtatgcccagctttggttctacacaggggtcctgaaatcccctgcatataccgagtgacaactgtaaaaggataataatgctaagtccttttcatatgtatttccttagttgattggttattttatttattgacccagtgatttagtaattgatcaattccttccttcactcaccatccagtgaagcatccagccagcgagaccatggaattctgtaatatctgcttcgtgattttaatcctgtaagatatttcgagaagaaatcatgcttagtggaaggaaagcggtttaggctttttaatcttcctagttaatttgatctggagcctcagtgtctgggcaggccccaactctttggtccacacctcggggtatggttacccaattaactaattcccaactagctaaactctctagaatctggtttatcagtgagctccctggatagacactttgttatttttaacttccgccctcatcctcctccccttttagaatcactaattaaggaggtctctctactgtgagttttgtgacctctgtttccctggtaaccagattgcatatctgattgtacccagcatcccagcttctgatgacatggtcacagcgtcctataaccactaaggtgagacataggcaccaagaaatagttaccagacattttatatgggttgccccagggtgctgtggatggaggaggagtgagagagagatcataacattatttcacatgttataatgagcatgtatgatttttgtaattaagaaaagtaataatagaaaagattaaagagaaggaagaaatcactcctactagcttgttggctagggctcattcaggtcatggtgggggcttcctccttaatggctgtcatgacccactcatttcttaactccttgcattctggcttctaccccaaccactctgcagaggaaaaaaaaaatgccttttttaagttctctaatgacctaaatcaggggtcagtaaactgtggcctgtgggccaaatctagctggtcacctgcttttgtaaataaagtttttttggaacacaaccatgcctattcatttatactcattgtctaaagctgctttcccaggacaaccacaaaattgagtagttgtgacagagatggtatgacccgcagagatcattttgctgacccttgctctctattgataaatccattgatttagccactctagtggccctgaatccctcctcatcctcttcagcctctcagctgcctttggctctctccaccaattcttgaaaatactttccctcacccactgtgactgaattttatttttctctccttctctctctcagtcttttttctgtctttcgttctgacctttactctcctgtaatcatgcatgaggacacagatttttgtcttttgtgttcctatctacctctccagtgcttgcaacagtccctggcatgtacgtttgttgaatggatgaatgagtctagctctgtatggaggagagttgaatcaggattcttttgcatcatcttgcagaaaagaccagttcaaactttacaagtgaaaaagtggatgcccctgacagtcaaaaagggagagtttagcttagaatcatgaacatttccccttacacagccgaaagcctggatattttagggaacttctttctagtccattggccccaacacctcactccttattgtgacatactgtgaatatgtgcatgatgtaagcagacagtgtaaatatcctcctctttaccttcgaatttggtctagtctccaactgctttacagaacaaccctccggccccttcctccacagactcctgagcccctctgtggtcaccaccatggtactagctgagaactctgctattcgtttcgtgggaggtagctgtatttccaccatctttgcatagctgacctcaatcatgtttgttaaataaattgtcaactgaagaaggaagaaaggatgtaagagagaaaaggaaagaagaagaaaggaaagctaggcatagcttaagccttttattaagattagggctggcaaagaagaggtttcactttgtgtgctaatgctgaccaattagtagtgatcagctaatgctatcagctaatgctgatcaattgtatcatcggattctgaggctatatttgtgacaagagctatgatcaattagtatgtctgctatgggtgttgaaagaaggagagctgtggcttacaggccatgtttttccattctacttgcaggccaataaagtatacaaaaaatcttttaaaaaatgattatgtgagtagaatactaggtgcctgcctttggggacctcctcatcccctgtaataagtgactggatttttcatcctatcacaattaaacccaatggggtagaggtaatttttccaaaggaaattagggtggtggtaaggtagagaaatagatgctaagtactgctcctcccaatcaaccaaactgtctagggtccaccacagggagcaatcaagagtctaggattcctactgtagtattaataaaagctgttcatttgtcttaactcatctaagaatggactaagacagctggaatttagccaaaatacaaaattttatgtaacgaagctttgcagctgtgtgtgcagatatttctgaaaaagtcatcatccctttgccctcctctgttcccttgtgcaataagcatttccatgtggctgtgaacttgcctaacagcattagtaactgccatggagcaggtaattagtaaatttatggagcacttactaagggccctcccaagtccttacatccattttcttacataatccttacaataactctgtgaagtgtttagtattgtttctgtttgcagatagggaatcagaatcaagtggtgtgttcacatagttagtggtggtggtggtaatctgattcccaagcctgtgctcttaagcactcacaaattcaagattataacatttgtgtatacccatggacacaactgcaggtgattttgccacttaggaaacactggtaatgtctgttgacatttataacacctggaagagatactagtagagccaggaatgccactaaacctcctgccaagggccttgtgacaaagaatatttggccgaaaatgtcagtcatgccaagacactcatgtgtacatacacatgtacacgtggtttgggaccacctaaagtatccatagagctttggggtctgaacagataaaagacttggcttttaaaagacaaagctcactgtgagtaggagctggctgctaatattttcttaattaactaggagttgccagaaagaattttttcctaaaggcacctcgctccccccaaccagttcctactctccttgacatacatcctccaaataagacagaaaattcagtctgttcaggcagtgaaaataattaaaccgtgtacttcaagatggcccttccatgagtgcctcaataactctgcagcttggaggggcaatgtggcaaatccactcattctgggtggttggccaagggggtcacagttgtcctataatcagattatgttgctatatctgcccattggccatctgtggccatttggggaactattaagcaagcagcgctgacctaagtgagatggacgatggcaatgttccttggagtgatagattgaccagagggatggtgtaatagcctgccagtgggggctagcagatgggcaactttgacgagaagagcagtcagctccccacagggaggagcaagattggaaatgcaaaagtaaccttccatagatgcacccccatgatcttcaatgaagagcaagaaccaagcctgtgacagacgcaagcttaacattagaaactgcatatggcttggccatgtattgaaaaatcctttataatccctttcttgaagctattttaaagagtaatgaaaaatgtgtgtaatcatgatgtataaagatgttcattgcagcattatttatgctagcatagagtgggtaataaaggactgacgggaaaagaatggctatacaaaattaattcacactcatagaagggaacactatactggcattgaaagtaattttcttccaaaggccatttaataacatgaagaaatatttacaaagttaagtttaaatgaaaaacaagatcagaaaaattggatatattatttttgttgaaaaaaatacataaatgcatagaaaaacaataaaatgaatcaaaatgttaatagggcttattttgaggacatagataattaagatttatgtattcttcttagcaagtttcagcaatttctaaattgtctacagtgagcccatgttgttttttaaatgatacttttgtaaaatttcaaaacaaagaagcttttccctggtactaataaggttctcatgctatatggagactatgggaaattagttacccaagacctagtttagcagctatcttcaccaaaaaccaattactacctggaaggttacttcagttagttcatctcatgccctgtgttgcttgtcagacactgatgtttagctgaacacaccaaaaaatcctcctcctcttccttctcctggtagattgtagaactgctcatctggaatttgggaaacaggcagacttgtctggctcatttgacatggtcattcccccgccccctcctcaaaatgccacttcagtaatctacacattacaggcaatatctccaaggggctgctaccttccctgagcactttcaacggcctttctttttgccttccctctttctggagtgtgtagatttttgtcctaaactgaagtcagtttttcaagcagttgctatgacagaatctacagttgtcgtagttgcactaagttcacttgagctattggtttcaagaaataggatgtaagaaatcagggattttattctgttgtctgtacattttgttgttgttgttgttgttgttgtttttcttgagacggagtctcgttctgtcgcccaggctggagggcagtggcatgatctcagctcacagcaacctctgccgtccaggttcaggtgatccgcctgcctcagcctccaaagtagccaccacacccagctaatgtttgtatttttttagtagagatggggttttaccattttggccaggctggtctcgaacttctgacctcaagtgatccaccctcctcagccccacaaagctgtgggattacaggcatgagccaccattcctggcctggtggctaggcattttctatctggcatacctttgtacttttcccttaagaaagatggcagtgatgggctctactgaaccacaaggaagctctctgctttgtctccttgcctctcaaaggtgctcagtgtggcttagatatctgcctgggtcagtcctcctagcctactgtcattcacttgtgtcctgccctcccaagccagaagctgcaggagaacctagactttgagtccaggtgtgttacttgcagtgaacagttctcctcagacccagctggccatccaacgttcacccgctctccactctcattccctccgtgcccctgtgtgtgcggttggcattgctctgagtagcgggtaaagccttggggccagggctgtaaaggtcagacagaacacctctctgcattgttcctgtcctgcagctcctccctgggtagctacaagcccacagaccaagggctgcacccctctctcctccctgcccagcacacagcctcccttccagatccttcatcgacaacaatttatgaaaggctgaggatgtaccaggcactcttccgggtgctggtgataacatgtgaagaattcttgaaaatcctgccctcctggggcttatatcttttgggtgggtttggggagaaaataataaagaagacaaaacaagaagtgaaataaaaccaggaaggggaatcaggttgtaatttttgatgaattagttaaggaaggccttatgagaaggtgacacatcacatcagtaaagactcaaaggaggtgagggagacagcagacatctgggaggggagaaggggagagagggcacccaggcagagggaacagccagtgcagaagcgcttagctagagtatgccctggcatgtgtagggaccatcgagaaggccattgtgtctacaggggaatacatgatggggcccacagcaggagaaggaatcagaggccacaggaagagatcctgttcacatgggctttgtaaggctgtgtgcgaattccagcttttctctcttacttcaatggcatcagctgttttgcgcagaagagtgccacactggggtgaatagcatccaggtgtctgctccgtcgagcacagactggaggggagggcagggcagaggcagagagagtgtgaggaggctacagaagctaacccgatgagaggtgctggggccctggagagcagggagcgatgagtggtggggaggagtccagtattcacaggcctctccacccctcacacattcaggcccagttgcaaggtagctgtggaaattgaatggggatcagaatgtcagcaactcgtttctgataatcactgtctagtctgagaaacttattagtgccagagaaaagctattttcttttgaatggaaaaaaaaagagtacccttttaacaataatcaaagcaacatagggtcactgcagacaatttggaaagtacggaaatttgcaaagaagaagactcgaaggaggtgagggagacagcgagggatataaatcataattctatgttgtagaaatgtcttactaatatttttatttattttattctgagttttttctcggcatacacacacatatttaaattttccttacctcatgttttagtttaacattgcgaatatttcctctgtgtcatcaaatagtctttgaaaagattgttttaatggcaacataatgttccttcctactagtgtgagttaacttatatagcaatttgcttagtggaggatggggcttacaggtgcagccttgatgggcttcctaaaatttcacccccaaatcagataagcttagctacctggtaacagcagagttgatacccgaaggcctcctccaagggcagagcctgctcctgggagcttccgtgtcatggagaacaggcccatgttctgtttcctgcaggcagacacacatggagaaggcctgggagagtttgaacccagaattctaagagcctttactaagactcaccaatataagcctctcttcctccctgggaaaatgagaaagagaggtagagaaagaggccaggagtgtcaccctggtgaaaggcctgtctgtacatgaaaacccaaggccagaaaaacagaggtctcctcccaccattggaatttcagcagactaatggatgtcaagtacttggccctggtaaatgctcaataattgccatcttcccccttccactactgttcccaggaacataccaaaatttcataaaatgaatagtcccatgtgccaatttaatgggccaagctgaattattgggcggtcattgcttttctgccaacctagtgaaccccctgcagaaagcaggatgagttcagtgggttaccctttgatgtcataagtcatccttctcaccctgtgtaagctgaatatactcaaaaggaaaaagatcaatgaacccccaagttggcagtgtcttggtaacctgtgttggagtttaataattgtttatggatggatgtatggatgagtagatggatggacgaatggacatagagaaggcagagagggaagaaaggaggatagacggtgggtggatggaaaaaagggtaaattaagacaaagtcattgtatccttttttttctctgaagagatatgggggaaataatgattttacataagtcattgtagtcttttttctcaggtgaaatacaaacccaatataaaaacccctcatttctgttggaagtaagtaaagagacacattgtgatcttagtagcatattttatctgtttgagccccagaaaggaagatgggtgattttctagcttgagtgacataaatctgtgccctccccctgtaaaatatattgtcatttctgtgattcatttggcttttttttttttttttttgaagtggactgtggtttgtgtgcagtggatgaagtaattggagtgagtgcttctccctagagacagaatcaatcactgtggtagaagatggtgacattttagaaagaaactctgaggaaaatgtcatgcttaaaaaattagatttaaacacactggctccagattgatttttattacactcaaatggataccctgattgattatcagtcttacaaatgtttagcacatttctcacttctctaataatcagaataatctaattttcaatgtcatttaatgtactctattcaaggttataatagatcatatttctaataaaacacagcaattatgtaatgaataatacaggaggaccagcattcagattcccttgattttaaggcagtgccaagggaaggtcttagacaaacccatttctttaaatgtgatgcacattccaagtctttgcctgcattatagaggatgtttttttcctgctgatgatctgaatggaactttgccagaaaacttgacctcccccgacaaaaaaaaaaaaaaaaaaaaccttttgagaggcagcaagttttgaatccttttttaatatgtgttatcagtgcacctgaagaaaagtgacaggttgctaagttatttattgagtttctctagtaattgctgctttcttcccattttttatatacattcccaggagaaatactatattttagttctaaaaattttttccaatatccattatagcagcagctgacattatagatgttttagggtgagccacaaggtatctagtttggaggaagcttggctctatattttgagcccaatacctgattatgtttggttttttcaagagacctgactcacgttaggaagtaacttgtactttttctatttgtggcttctagccaattccagtcatgtccaaatctaggttagtaattatgaattcctttgttatggcttacagctccatttgatctggtatgcgtatgaaatggtatcaaaacctggtggcctaacaagcaatagcacttaaaaggtttattgttttgtcccatgttcttggtgaggggcatttaggggcagcagatagaacaatgaaggctgaagaggtagcaggcctgataagcatttagagactgaaaagaagggggccaaagcagaaggcccacttctaagatcaatcctagatgaacctggcagagtgagaaattcagaagctctgaaggctccagaagatctaagcagaagtaattgatgggccagtactaacaagatgccatttaacagaggtgaacattacgttctgattcagactcggccaaattggtagaggaaatacaggttgggaaggatcaagctgaggatctgatgaccagaagcttgccatgaaccaactcggggtagtcacatgtcctcccttttaaggtgtttggttaatcagatcatgaaagaccataaccctctgtactgggggctgatcagagcacaccttgaaacattagtgctttttattctgagcacctcattttaagagggaagttacctagaactggacattatccaaagaatgttgaccaagatggcatgagatcataaagctgtgtgctatgagatgagaaaaaggaaagtcatagtttgctgccatttattgagtgctgggccttttcaacacctttatgagacattaccattctttcatggtcatggcaactgacaccgagattggccagataatttgccaaaatttacacaactactaaagctacacagtcaagatgtaagcccagctgtctctctctctctcagcttttgtgatctcaccatatctgagattttctatagactgatgattctagatgatctccaaggtcccttccagctgtagaattctgatggtctctattcaggatatgagttcaaatatcattgcctgatacttggaaacattccaagcataaagagagaatactgtcttatggtactcaaaataagatgagattaacctgggaacacttgctgcttaagtaaattgaggttgagaaaatgaggacccctttgcagttaagatacttggcagtaaaatctgtctacatttttgaaaatattagttcttgagacattatgcagtttcctaaagccttgaggaaaaggagtatgtgtgtctgcatcggcctgccttagtctgtttgggctgctgtaacaaaaataccatagactaggtggcttataaataacagaaatttatttctcccagttctgaaggctgggaagtccaagatcaaggcaccaggagatgcctagtgaggtcctactttctggttcatagataggtgtcttcttgctgtaacctcacatggcagaagggggaagcaagctccctcaggactcatttaagatactaatcccatccatgagggctccaccctcatgactacgtcacctcccaaaggcctcgcctttgaataccatcacatcggggattaggtttcactttatttaaaatttaatttcattttaagttctgggatacatctgcaggatgtgcaggtttgttacacctagcaacccatcacttaggtattaagcctcatatgcattagctatttatcccgatgttctccctccccaccgccacctgacaggccccagtgtgtgatgttcccccttctgtgtccatgtgttctcattgttcagctcccacttataagtgaggacatgtggtgtttggttttctgaacctgcattagtttgctgaagataatggctttcagctctatccatgtccctgcaaaggacatgatctcgttcctttttacgactgcatagtattccagggtatatatgtaccaagttttctttaggggattaagttttaacttgcgaatttggagaggacacaaacatttagtctatagaactgactgttttaaggggttaagaaggagatgacctacaaaattaatgacaaaaatcatctttgaaggcttgaagggcagggtcttagcagagtagttaggatgggaaggagaggttttaaatgctgtcctcatagtggggacctatggttacctgagcagttcacaaggtattatagggggcccagcaagagggaatgagtaaggagtcatctgtggaacccggcagcccatttgagctctaacagtactgtttttactttttactgttcattgtcatatatggtattttcccacctttggaagatgagctattgtctgcaaagcatcattcaaagagggagtgagtttgagaaacagtagatagactcatcagaccctggtagatatactggataaggaagagaggaggataggtctgcctcttccatttgactcatgggccctcagatggattatggtgccagtcactgaggtggcaacatggaaggagaaagagttatgtggagcagctaaagagtccattttagggagaagatcaatgtgaggtgccagtgatatctaatgggcaatgggatggtcacatctgacgcttaggagaaaggtctgggctagagattgagattcgagtctcctggatatatgtccttaatagtggagggcttgggcatggatctcattacacatagaataagaagagggctagggacactcccagagatacagaattctttagatgggctgccagataggtcttgtggggatcccaggatgcagatgtctcaagttgagtgtttcttagctttctcaatcaagccttcaatctgttttccataaatctggaagttagcaatagttctgagagaggggaatcccagtccatgcctacctgcattcctctttttgaagttagttagctcaaggcattttttttataaccatgtttcatagttcttgctactttttaaagtcaagaggcatcctaaaaagttcccatagcccactgagctggccctttttttaaataaacctggttatgaacaagagccctgggatgagacagcaaagccaataatcatagttgaccacgggcccctctgtagtcaaggtacatggtagcaaaaacagtctgtgtgattaaaaatggcagttcctggagctgaccaaccattgtgcaatttcctgaatttggtcaaaagattatagggtaagtgggcaaacaggctgggcaagggaaagtcagcctggtgaaattaatgagaaaaatattattttagagtccagtgttcctttccagcttaagatctagacaaccttaaatgcatgcacagttaaaccatatgttctcaggataatgaaaatggctggggttgggggagggcggccaattcttgctgactgtgctttggttgttaattggaagggacttggtaaggggcggggggaacattctcgtgccagtggcttgttagggcaacttgacctctctgcctgcattccagatatttccaagatagctggccctgctttgcatatatctagatcaagtgggcaccccaaatctcttagtctggtttcctctctcaagttcttagaaggtcagttctcactcttcacctttctgcctactaaaatctacctggaggagataatactgcacccgtctaaaatgaaccaagggtatgataaaggtaatgaaagaaagaattttgaaatgggtgtaaatattcaatgtctagggtttactacaaaataatcttgggaggtgtgggagtaggaagaaaataagtttggccatgagttgaccattgaagcagagtgttgagtgaatgggggctgttacatcatggtctctactttaagtatgtctagattttatgtagcagatctgtttaaatataaatacgtattccagttgtcaggactggaggaattaatgacataccttttaaggtatgattttgtgttttaaagcttgaaaatgaaaaacagatatcctacgaaggaagacgggcaaactataattcacttggtgaatactatgaaatgcatgaggagttaaagtacttacatattcaaaattttagttctatagagatgatttttttcctgccatcttttgctttttttttttttgaaagatttgagtaaataaaacacaactatattgattgctacctacagacttttctggctacctagtctctcgttgccctttcactggatgggagcctccttgagggagggtggcctctgccactggcgcccaggcatactcttcaccacccctcaaggaatgattgacaggggagcagagaacttttctttagagaactctaggaatctttaagcccatcctcttcatctctgtgtgatttagacccagctatttgtgaggatccctttctgaccacgttattttccaaaggagcaacaggtaatgcaatggccttggaaagtctttggatgcttataaaggaagaattgtggaagaactctctttcacatcaccaaaaaaaccagtcatctgaagtgttgcttcctaagaatgtggagcaatcaataaacccccttggagtatcttacatgtcgacactcccttggccttgataacatctgccctccaaaggcatttggcgtgcatctgttgaacacatttgtatggattgtcactgggtcttcgctgcaacctggcaggattggacgccatccttcgttcccaggcctcatgagaatcgaaacatccaacatctctcaggcacctctcaaataccagaggtccccgactctctttatgttcccaagatctttactcatgctttcccctcagcctagaatattcttcacctagttaaacagtactcggcccagacattctgatgcagaatgttctgtgcagattttctctggctgacttcccactccccctccccaactagaaagaagcccatgtcacctgtgtttgccacactgtttccccatgtgttttcagggtgtaatgtcatgttaatctgtgtttggttaggtgaggaatgtgtgtgtctacctctggagcaggggtctacaaatactgcaggccatggttagggtgggggaggggatttcccgagagaaagtatctgtgcgtggaggtgtagggcaggggaactcactgctgtgcagaaaataacaactgacatctagtatgttgcctgatagctgaaataaaacaaaaaaacatgagggggtgagtattaattgttttattttttgttaaatttattttcttccctaagtttgatttattgcacaagcaacttcttaacaatcaaggacgttttttagtgtacaggtcagccaactctgcagtccataggttaaacccggcccactgcttattttggtaaagaaagttttactgggacacagccctgtgcgtttgttgacgtgtagtcctggctctttttgcgctacaagggcagagttgagtagtgtgacaaaaactgggaaggcccaaaagcctacaacatttctatctggcctattaggagaaaaatttgccactcctgggctagactgtgactcagtgaggaaccacgtctgcctcttcaccatcaacacctccagtaaccctcacagtgccgggcacagagttgcataggttcggccttagtctgttttctgttggttataccagaatacttgaaactggataattcataaagaaaaggaatttctttcttactttgagggctgagaagtccaaagtcaaggcactgcatctagtctttttgctgatagggaatctctgtggtgtcccaagatggcacagggcctcatatggcaagaggattgggtgtgttaacatgccagcccacgtctctcttccacttcttataaagccatcagttcctctcatgacccattaatccattaacccattaattcataaataagttaatctactcctgatggcagagcactctcggtccaatcacttcttaaaggcttctcatctcaaaactgccacattgcggattaagtttcaacatgagttttagaggggaaaaatattcaaaccatagcaggttccctgtaaatatttgaataaaattagtgaatgaatgaatgaatgagtaaattgacaaatagctactctagcttgtttatttaatttatgggaaaacttttccctcaatacatgcaatagtttctgctccctgatatctaaaacacttgctccttcacctctttcagctctcttctcagatggcccctcatcagagaggctttccctgccacacttcacagtacaatgtcccctgtcgatctttctctcttccctgcgttgtttttcttcataacacttattacctgtcattatattggatatgcatttgtttatcatctgcctcccccaagaagaaaataaacaccaagaagctggaaacatcttttatcaccgccacatcctcagtgcctagaacagtacctggaacatagtggatccccagttaatttttttttctagctctgtcaggattaagttttagtcatgtgtgtatcatttagtcagcaaatatttgaaaatgaatgatcacattaagaattgactgcacgcagcctaggatttctttgtatgtactctagttatttcttggatgttaactgccttccccctagatcccaaacactgtcttactggtactgatcttacacccacaaggtatgggttggtaagaaatagatggccccggggatgttggagttctctactgcttgctgatctaccattgcctttcctctctccaccaagggctggaggctgcctctaccttagaaggcattagcagatgtcttttttattaaaagggaaagaaagcccattctgggcatgggtgtgggtgttaaaggaagggaaaaggaagggcaaagggaagtggattgtgaagctctggcaggaacgttttgtatgttgtttcttggacatcttgtatttttttttttgaccccttagcagaagcattcccaggaatagaaactggattttctgttcatattagacatccaagactgtggctgtaagctatgcagagaatggtggagatggctttctttcttttccaaatgactctccagagaaataaatacctgagaattaaagttctgtaggccacaaagaagatttttgtgaactaaataggattcagcaatcctttacagacagtgcaatttgggatgatctatttatattgagaaactgataagttcactcaggggaaggctaagttggctacaattctagccaacacttcatatgctgagactgacctgggagctttggcttatttctgctgtttcattttttaagattttcttttagtaacacatgtggactgagagtgacccctcaatggcattcaggacaaccaaggccaagtagaaaaattttctagttatagtcctcattacattcttgttaccaacactaatcttttgaaaaagcaaaaagttttaagaattattgtatgagccatatatagctttggaattagatagaaatgggttcaaattctggtcctataaattactggcttaaatgtgacctttaaagtctcttggccaaagtttcctcatgtgcaacttgggaagtaaatcatgccattgaccacatggggctgctgtaagaattaaatgagaatgtatgtcatgcacttagcacagccagcaccccgaagggctggggttgatgacagcagtgatgttgcctgttcatggcaaactgtccttacagctgagggagatgcaagagaagtctgggtcacacaccacagccctaatttgagaaactggtctgtgacagttggcaattatgagtttgaatttccataatggattggaatttctctcatctttgcatttcaaagccaagggcaaggaatagttattattttctcatagtaattcttgtaaacaattcctgatgtgcaaggtaggtcaacaaattacatggaaccattcttgcataaggcattttctcacaatgacgtgctgtttgggtgtctttagagtaaacttgaaagaagttctccttctttgtgttttgcttccacatggcattgcattcacacacacacacacacacacacacacacacacacacacacacaattgccatgaaagtagagacttctgctttgagttcctctataggttatgtctacatcagcatctgttgcacagtagtagctcaataactattagtggaatgaataactgagtctatttcacattaagtcaatttctagaagtcaagagctagaagaaacaaaacccggagggactaaggaattcctcttcattttccatggataccattccaatcataaatgggcttttcccaaggctctctccacagcctatcacttctctggagcctgaaacccagatagccaattacataaagcacacactggataactccacttgggtggcacatgggcacttggaattctaagtggagaaggaggaggccctttttcctcctcctttgttccctcaccatcattgtgcaagctggaaacccttgacccttcctgctgcctggcaccttgcatctgctatcctggcacttccctacagtccctccctggtttagacatccctcttctctcactcggaacttctagcaactacttcagtggtccctatacccctaatcatttcttcaccatgaacagtgactcgtctaaacagcaacccctaataaacttaaaagccaagtctccttggccaagttcacacaatcacatgagctgtggtccagccacagcccagaactgcaagcctcaccctattccctgcagagctccaaagctgccctgttgcttctctctaggtctgcaaactggctctcttttctgcctggaaagcactcggttctcccagcctttggttagctcaagtctcctgctttggatatttacatagaatttaagtgaatgcatatttcaagatctcattccatattgaccctccagtgagcctctctctgcaaatgagcaattttggattctccgggaagttcaaacagcctttttgtgtttgtaaacatgggtagtttcactgacttctcctacaggttggattacacaaaaaacatgttttcaagcgcttggcctcaagtttattttctaggctgatttttgaaggactttatctggcctcctcttaaccttccccacccccaagtctggcttccatccttattgctctgctacaaatgttctctcgaaagtcacaactttctccattgccaaaaccaatgaactttgctccttcttcattctttctgactggcggctacttgaacacttggccaggctgctgctgcttcaaattcttttctccattggtttctgcggttttttattccaatttctcccacagttcatctgctttcatccccgtatccttttccctttcccatcaactactagcaattcccaaggattagttcctggcccttttttttttttttttatctttcctctctctcaccttagattgttcatcctcgcttacgacttcaacagtcatctctaaggtttgactcctaaataatctaactttggaggtgctctcttgccaaatccacaatgccattgctctgacagcctctggattcctaattcatgccccctcaaaccaaattcatcatattcctgccagaaactggcttccctactccccaccagctaccctacatttcttctctgttttgataccatcagtagcccaatacggggttaaaaccttattgttacctctaagtcgtcttcttcatccccattttcattctgttgccaagtctagcatatttttccttgcggtgattcactatatctccccacttctctttgtcctcattatttctccccatcaatccctgtctccacatttttcttcagtgacaccagccactccactccccttcaaacatgatgtagtcattcttggaagtattttctcatatctcccccatccagaatgttttttcctccccttttggcctcctgaatgagaccccatcctttaaaggccaccgcaaacctaaattccatcatgtagccacgtttttccaaccctcaggcctttgcgcacattggtcccttcatccagaatgtctcctagcctctctaagccccattcatttaagaaatatatgttgaacattccttatggagaagatactggactgtgcactgaggatttctgagtgaataagacctagcatattcttataagggtattcagctcaagattcctctcttctgagatgttttttccctatggccccacaggctaaactatcagcttcctcatctgtgagtctcagtaccatcttacaacctgtcccttaggttttgaattcatattgcttgagtctaagaatgaatatctcccttctgacatctagctcagtgcatgatagttatttctttagatgactgtgtcttttactagaatgtgaatctcttgaaatgataccttcttactcttgtgtctttaacatgcataatggcaaacaaagtgtaagtgctcaataactatttgagcagaagaagaaataaatagatggatatatggttggatgggtggatggttaattggttggatcgatggatggataggaagatagatggattgatgaatggacagagatagatagacagacagacaagtagatggacagatgaatagatgaaaggatggacagatggacaaatggatggataggtggatcaatggatggaaaatgggacagatgaatgggcagctgcattggatagttggaaggatggacagatggatgcatggatgaatgagtagacagaaggactggataaacaggcaattctttcttggatgtctatttggatggatagacagatggatggatggatgaaaaacactcccagttataagacactgttcagatctataatgattaggaaagaaggttatagttaattgactaatcatatccaacagtgggctagcatatatctcatacatagactgccaattttctaaaaattaatagaatgcatttagaacaaaagctatactgaacaagatttatatgtggtgattctgaagatccttagaaactttagcatttccaggacctcattaagaatcacttaggggtatatagactggcgtaaaccatttgaaatgctgtaaagtgaggtttttcatttaaactaactatgtgatataaacacctatatctacatgtagaccatttctctaatgatttggatttctaaaactgacaacatgaaagagcttctctacattaatatcttaacggtatttggcaaacatctggcaaaattataagccatttgtctatctctctcagatgtcttattgacatgtggatggctcaggcagaaatccatcacgtatattaagcaatctcagaaaacgttgaatcccaaggacatgagcgtggccataaatgttcactaagccaagttcagacagacagtcctaacattagaggtgaacccactggaagcttaataactgacagtttccatactctgtcttccctttaatctctagttatagagcaccaggctggaatgctggtctcatcttggataaaaattctttcctccctccctcattttttccttccttggtttctttctaccttccttcctccactgctgccttagcatttcacatctcaaagcttttgtgtatattaaatccttatattctatattatatatcatgtgcatttcatttattgaagggagaacccctcatgctttatttgactctgtttctttagtggctacaggactcaataaatgtttggtgaataaacaaattggtatagggctcccactatttttgttcatgttacattgtgttgcaatcatgtatatatctaaatatatatgagatcctgtgtgcaatgaacaaaaactgatgtcctcatttttcagataaggaaactgaggctcagagacattaagagactatcctgagcttacatagttagtacaataaatgacgagctaaaatgcaggcctttgaaattttatcccagggtccttccatttgtccattgtttctttcatattatttaagacctatggggaacagtgccataatttctgtgtgttgtaacagatgtgggtgggatctttgagtggtaggaatgaccaattgttttctttcttgcctcaaatgctgaatagagggaaccatgtattcaaatatcctgtagcataaaaggcatttgggcacgtgttactgttgcataaaaacactctttacacagactgtattacacagattattgctgtgtaacaaactacccccaagctcagtggcttaaaactataagcttttgttactgttcacagcaccatggatcagtcgggttgtacttctgggttcactgggctctctactgggtaggcaactctgctgatcttacctgtgctctttccgaggttcaagctggctccagattgatctagtgtggtcttggctggaacaactgggctgtcctctttatggtctcttgggacttctgcttctcttttcctaagctgagaaaaacttcatttctattttacataacattttaagaggaaatgtatgatgaaaatgtcaagcagaacttcagttcatttgctaaaaatgtattggcttttaaaagacagtagaaatgaaagatccggccattatattttatcatgatagagactgttatttaatatttgaaagcccataacttgttataaagaatatacatgacacagagcaagatacaagcttatctggaacagtctgttgctgggaaatttcttttttgccctcctgcccttcatcagattctgtttttgaaaggcagtctatgcctattccatgaaagaaatataaaggagtgtgcttgtatccctgctcaacttttttaccctgctcaacttttttaccctagatatatgggacccctatttgaagactattgattcctgaaccttagactgtcagccttttttcaaaaaagttaaaagacccactcacagtgtttcagatacacgagggcagcttgggcttcagcagaagtgaacttgagtttggcacagcgaagaatttcctgcctatgaaaattgattatggaagagatactaagccttttttttttttctagatcagaggttttttaaaaacaaggtgaattgatcatacagtaagtgtgtgagtttattcctggttaaaaagcagagggccagccacagtgtctttaatttcctttttttaacattcagttttatgccataaataaaaggcttcatctcagctcttattcatattgggtagctctgtcacaaacacgaagccacagacacgtgtgcctctttggacaggatttaggcaaagtaatcattgagaatagcccattgctgccagaggaaatgtacaaagaagcaccgccgggtatgaaggaaagcatctcaggggttcatgtcatccctcaactactcactgttgagttcctacttttatacattaagccagaacattttcttttttctcatttctggaattgaacttaggatatttcttatagctcatatgtccaaagaaaaggatttttcatctaaaactaaatctcttgccttgcaaggacgcgcaccacaccgtgcttgtctgaaaatgaatgcgaccacagtagggctgcccttaccagcccagacagaggagggaaaaagtatttgaaagactgtccacacaagaagaggtaaaatctgcatatcaaaaagtaaccagtgagggaaatatgattaaatttgttttgaaagtttcattagcataacataccactttaaccacaaagaagtatttgacgtctgtatattctgatatttcagagattttctataacttctttgaataattttaagaagctgagctaagctggaagatcatattaaactctcagaatgctgtgtccagactaatttcccccaagacttcaatattctgtaaaaattctaagcatgctccttgctcaattgctggcacaatggacaccaggtcatctcttagacttcgaggttgtaggggcctcctgtcaccttttgaagtacttgcacatatgctacatgttgcagactcagagcagtcctcttaggattccattttgacctccattttacaaaccctgaaatcaaagtccctggaaatggaataacttgattcattcaacacatactcttcggcaccctaccctcagcctggtccaaaaggcacatgtctcatgagtggcaagaaaacttagctgcagcctcattcactgaccttttttctctgtatatttgttccaatttcaactggaattcacatggcaggcactttattaggaaaaagacacagtccccaccttcaggcagattctgatgtagaagaaatgtttactcaccccaactctccccagtttacagtgggacgtgctatgttaaatgcttgaattaaatccttaggttgtgggaaaagtaagtctctaacaattagtaatagatccacctgccttcagatccatggtagctcgtttacatgatgagattagaaaatgattttttaactaaaattaaagcatgttttaatgtttttcttttaaatatatcagtgtgttagttacaggtcatccccaactcatgacaaccccatagttctaatcaccaactgtaactcattattcttgcagttagcaaggagctgaagagtcaagatgaacaaattccagactttaattttcaagcaagaataaatagaccatcatgcttcctttgctaagctgaatatagagaactttatggacaaaaataccatcaattgtattttcctttttttttttttttttgatgtgaaaggatttttagtgaagcattgttttcatctcttcctgaatccaagtgaatctacatcttttgcatgtttcctgcattaaatttttattgtgtgcctgaaaatcaatattccagatacatgcacaagtgcacacattaaaatgaacatgacttcatttatttccatgattagacattcaaataaaagtgcttgggtgtctgttttcatattcataggtcgagatccgtacatcagaggtatttgtataagtgacacttttattacattcatttcatttgcaatatgatagtggatcataaatatgttacttttatgccaccaaatctgatttgtagcacttagcccctcacaaggagaatacttgatattttatggagcacctttcatccaagaagcgctttgcaaacatcaggccgggttctatcaggtgtataaatcacatctgtgaccccctgaatgccccacctgcttcatcaaccttctggctactactgtaggggtggagagcagttagtgattcccccgcagaccccaacatgatagtgagacctttaagttctggaagaaagaggctcaggtgaactctgtattgccacatataggccctgacagtggacagaacaccacatttagttatatgtctaccttatcatttgcaaaacagttttgaggcccccatctgtgggtcggatcttgtattaagccctggggacatagagacaagtaacatgtggcccttgcctttcagatattcacagacttggaggggagggctttgatgcaggcttgacagtgtttgctcctctctttgcctctccattccctcccagaggtgcaccgtacctgaaagcagcttgtcaaactcccaggtctggcataggtatatgagtgcatataccagtcagtcgcaatcagagtgaaagaagaggtccaccatcaaacatcccaggcagccttggagctgagcatcagatgcacaccccacgctcccagagaagagagtcatctccccacccaccatcccatagcatccctcaatttaccctcccaattccccagcgttagcttcctaatctaggaccagtaggatccccctgccacacccagtaatacacaggcacagctccctgtagcatccttcattgtactcactacgctgtggactgtgtgtacatggggtagactcagacgcagcggagcacagtgggtttcctaagttctgatcctgactgtatcactcacaggatgcatggcctcaggcagggtactcaccttcctgtgcctccactttctcatctgcaaaatgggtataatagtgatatctactctattaggttgttgtaaggattgaatggcctaccatgaatagaaggctttatgatagttgtaatgaacactttcagtattgtggtaaataatactctcgtatattaattgcagtacatgtaataatagtgatgccaatattctattattattattattactgtcactgttttattgtatgatgaatgtctgtctgctaccataagtttttgctccatggtagcaacaaccatcctgttttgcgatggcacatagtagatactcaataaatattcattgaatgaatgaatgaacaaaacaatgaaggaacaaatgaatccacccactcatttggtgccactgcgatggcttctccaagcaccatttttcatatcagtctcctctgccactgacagccacaggccccacagtaatccccacaagtccttggtgtttaggtcatccatttcccccacggaagggccttacattcttcctgcataactaacccacataggcctttacagtagtctacctccttcccaccaagcccaccatctgtgtgtctccatgcaggtgctactgccatctcgggggaggctctgaaaggagctgtctcctctggagttgaccccaggtggtaagtggtggagctagcactagttccagatctcctgacttcccctgcagtacttgtatcgcccttgcctcccactgctggcctccaggggaacgagtccctgccctgccccaggagccactgaccacgaggcctcaaagggaccaatagtcccaagaacttggacaaagctaccatccctaggcccccgtggcttcttgtgcactgtgtcacctccatgattctggtggttcttggcagcccttctcaaacactgcgtctgcgttcttctagagtttaaaaccattgagggaagcagctgctgaagccacgtgtttagaaaatttgtccgtcaacttatgaagctgtatgtaattggggcatcatcaccagaggggttgtccctgcattttgtgggtgtggaagaatttgtgataatcccaggagtcctttattcacatagacagtggtggtgggacttcacgtaggggacaaaaggagtgtggaaagtagcctgaggttacacactgctccccttcgagtgagctgcaaaggctgctccaaattgggcccaaagcacagaaaatggtgctctggcttcacagttgtgattttgcaaacggcgtgtgtgatcactgcacaacccaacagagatgcccaacttggtgcccagctgcagctcacccagggccccttcccacaggacctcacccctccctttcttgcttggttcagttacttcatggtgacagctcacagtgtctcctctctcctggtaaccctctagagctgggtttgctcgtctgagttttccaggcccctggtggtggatggggacagtgaagcagaatgcttaggagcagacacaggtcctgcagacttccctgtggatgggattatggggactccttctgtgggttgttagtttgttttgtggtttctctttctgcacattgggttgactattttcaaacatggtattgttgggcctcaagttccttgagtgtagaaatggggtcataaggcccacctcacctggcttactgtggggatttcgcgagctaggattcttcacctgctgatgcccagtggcccttgccacacaatcactaaagggtagtgaggctgctgctgtgttttaatgtagctgtaggtgtcatctcagcttcagaatcgactcaaacagttcctggtatttagcgatgtgtcacctcccacagggctctgggttttttgttggtgttgttttgtgatataattcacgtagcataacattcatcattttaaactgtaccattcagcggtgcgtagtggatccactaagttgtgcagccttcaccagtaagtccagaacattttcatctcctaaaaaacaaaaccctgaacccgttagcactcccgatcctccctccccaccaacttgcccccgtacctgacagccacgagtctactttttgtctttggattggcctgttctggacatccatataatttagaatcacacaatgtgtggccttttgcgactggcttctttaaggcgtatgtgtgaaagcttcatctgtgttgtagtatgcatccataattcattcctttctatgacaaataatattccaccataaggacgtcctagattccacttccccgtcatcgggtgatgaacatttgggttctttccacttttcaactgccgtgagtcacactgtcatgaacattcatggacaagttttgcatagacacatattttcagttctcttgggtgtacacctaggagaggaattgctgcgtcacatggtacctctgcgtataactttgagaaaaactgccgagtactcttcctcggggctctgtttcagaaggaccctccctgcttagatttgactttttcactagctaaggaaggccattggcagaggccgaggaaaagaggggggtctgatcacctgagatcctgcgcactcacacacaagccttcaggcattccctcccctcagcagcccagactccatcctcacggagagccaccatgccgcctctgccaccctgcatgacccctttccccctcattgtgtctcctttgcccgccggcttctttgcattctctctgctttgaaccatgatacccactctcacccagcgtcctgcgccggctgggagggatcgggtcacagaggtctcgaggggccagtctgcactgggaaagaatacagctgaggctgcacttcccactcatttcaccagtgatctagaaattttctgagccaatgagcagtgtcatttcagagtcctgggggaaggaaactgtctagaagggtgttctcttcagacctgttggtttccttaggaataagtaagtgagtccaagtgaggaaggaacttctcaaccacgtgaacttgagcatatttcttagcttctccaagactcagtttcttcatctgtaaaatgggtttaaacttgcctacctgataaaaggatcaagtgagataccgtgataccatgttcaagggactcaaaaaaatgttcctggtctccccagctgccctccctcctggttaggtaggagtggctcgtacagacactgactttgtagtaggactcacctcccttttttcctttcttcccccttctcaccccttgctctttcctttcaccacttcctctctcctcctgctattgtcttactctgccctcagctcctaccccaaatatgggtattctcatggtgtggacccagggaactgccagttctcaaatcacccgtgtgctcttagggaggcaactcaggccagatcctcttagggcagatcagattatgccctgggtcattttgcagtgcagattcccaggtcacagtggtggcatgcacagccaggcagcatccagcctggcacccgctgggccccagagaacatggactccctggagggggtggcatggtctgtttcgcctgtctgcctccctgggtttcagtttctttcctcgcgagatcctagccaggggctagagctttgagttacactcggatttgaagtcatcccagaggtctgtgctgcaggaggaagcacgggcttccatagcactgtgtcctgggccctgactttgtgcctggcaccgtgcttggctcggagcatgcagagggaaaggacacacacctgctgtgggtccagtgttccagacacaacgtggagtcaagtggctaccagcgaataagggaatgaatggttttccaggctgaagatttcatactgtatcaattattatttttaagtaattttatattccaaaacagataatatggttcatacagaaagtttagaaagcagaaaaacacgaagggacaaaaaccatcatccttatctcctctcagatgagtttcttcaaaagtgcctgtcacttaattcagaaaactaaaaagcaaagacaccaaaatgtgtagctaggaaatactaattatgaagtaacggggctttgttcagagacctgacccttcccttacaatgtcactcagggcatcccatttgagggtaaagctcttggaaaaatccttctctcttcaagagatccagtccacagaaaaagttctctcacaacaagccaagactctgagcctcctgggtgagcccaagctctccaaacaactgacgggcacatgcatatacagaaagacaaacctagctctctgccggggtcccgcggctgccaaatcccttttccagggaggtgtgttattaccacctcttcccactgtttctgtcccaaatatcaaatgagcttaaggcagccttgggaggtggaacctcccagctcaggagcacaggcccagccttcagcgacccctgatgtgccttctctctcgtttccagctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacggtaagagatactcctgccccaggctgctgggagtgtggaaaccttgtacgtgcatgtgtgcagacacacacacacacacacacacacacacacacacacacatttgcactgggcctggcaggggcttgcatgctagccagctggggctatgtagtagccacttctttctgtgaggtagcctttgggcgtgggcaatcagtgagtaggctgagtgccgcctcactgcagtcatgcacacatgcattcactctagatgcattaactgagtatttgctatacgacaggctgtgttctaagccctggcaacatgaactattcagtgctgctctcagagactttgatctggtgaaggaaacaagtaaagccagtgaagcgttacatgggtcatgacggacctctgtacggagggacccagggggacggggcctgatcttttaaaaaccccaatccatctgtgaaatccaaccaagataaagaggccatcccctgggccaaggtttgccttctgtgagaggacatgtacaaaacccccaagccagggcctagaaaagtttggggtaggcatgccccatgcccagttgagtgaatgttccccctctgcttcccagcgttccactaggaatggcctttcactgagattggaaataaagagaggcaggaaaaagagaagtgagataaaaaggtaggaggtgtatgttggctggtctaggttgtgccagtggaggggtcatgaggtgctttaatttttccaagtggtttttgcatgtattatgttcactgatgtatatttctaacttgtggcatgtaatagacactcagtagatatttgatgaattaatacaactagaatgttgttctggcctctttaaaaagcttaggttgctcacctacaatgctatggtaaacatactttaaaaacaaaatccaaatattgtagcacttgctggcttggtgaatggtgttctagaaaaatgatagcatgggaggtcctgaagatcaaaagacaaaatagtgataccagaaagaaaaaaaaaaaacagtgagcggcggggctttggagcagttcttggtgagcatggggtgtagtgcgctaggatgttggtggtatctgtaacacaataatggtgaccaggagcaggcccagaggggcgcccatggaatctggggccagcacaaacctaggtggcttctcagatgaaaatgagactacacagttgggtggcaccagcttctgaagggctggcacccaccttaaacagacaagtctcctggctgagctcagagactttggctcacctggaagcagaggtagaaccttgagcagtacttttcaaaactcagcgtgcatctgaagcacctggtgaactcgttacagtgcaggttctggtgcagcaggcatggcctaggggcatttctaacaagctgccaggctgcttatgctgctggtctgcagaccagactctgaagagcaaatgagccgggctttgagaagcaacacccagggtggcactctggggtccacctcgcccattggtgtcagccaggagaaacactggcatgtctgccaggccgagggagagtctcggcttaacctcaaccagtcttcactgagtttggggaacactgtcccatcccagagcagggacacaggccaggacaagactggacactgtaagggagctttcattttcacctgggagagaaagtggaatgtgaccccatgtatccagaacagaggcctggaaccacacgaatgtacttcaagtcctactcagccaccatcagccccatgacggtgaacaaattacctaacgtctctcagcctcagttttcccatctctaaatgggaataatgtgaaatagttgggaggatgaaatgagacaatttatgaaaagctgctgtgatggaacccaaaaatatctacccagcagtggagtggcagaaacatcatccagacacgtaccttctactggatactaactgaccctccagagacctggcccccatgctgggtgcatctgacaatacagaaaagtaacatgatgaataaccaatacctgaaagtatgccatttatttcttttagaaatacttactaattgccaaccattcagtggcatttcaggccctgtattgagctgtgtatcaaggtgagggcgtcttgacctaagaaatgagggaactcaggctggcacagtgggaaggggcgaaaagagaagatgagagaaaacaggtgctgtgcaatggtggactgtgttgagttgagagcaagtgggaagtgagaatgggaaaagcctggcggagtcttgagtgccacttgaggagtctgtaaataatgaacagtaattgatggttgtggtcaaaaatctttattattatcattgtaatcattattacatctcatatttattgagcatttactatgtactagggaccatgctaagtactataagtatactaattcttttattccttatgaggactctgtgatttgggtttcgttgccctcatattacagatgcaaaagccaggtacagaaaggctcgataactttccccttgtctcttagtcaacaagtggtcagaggtgagacttgaacctaaacagtctgactccagggcagctcttttaaccactatactatacacagaatcccttgagagggttgccaaaaagggagaatggaagctggggccattggcggcatctagctaggaggagagagctgtgacccaggaataaatcaatcttgtagctccaagaaagtcagaggaaaagagatgagagtggggaggtcttcctgaaagaggagacttttgatccaggtcatgaggtgagcgactttatatggcaatacctagggccagtaactgctacatcagggtccccctccgcctcctccaggtggtatcttagcatagccaagtcaatccccagaccctgactcacctagtaatcaggtgaaacagctcccactctaacctggaggagggcaggacaaacacaacgtacagcatttgccgctcctggaacatgcgccctggtgtgaccgggattcctacaggatggctcacatgtgaggcattgccactcctgcgagcggtccctcaccactgatgagcagaacgtggagagataaacccccccagcttccttattcgttgggcaggatactcttaggtatcctctaaaccacgtcccagagtttcccaactagatcgagctctgactgcccacagtgatgatctccgctggccgccttccttccctgcccactctgttcttccagtgcttcctgggatctcctcccacataaactatcgtgcattccaattctagtctcagcctcggcttctggcctaagagagagaggcttccctgcaggcctccagggccctttcctatccaccccaatatgggggtgagtcacccccagtcctcaactggggcccaccctcctaaacacattgtggagacttcttgtacctcccagtcaggcagaaaaacagaaacacgattttatctctagagcgtggcccttcactactgggcatccttccggaggcctgctgcccaccgcggggtggagggcgctctgagccagtctcgcagctgaccgtgctcttcatttgtactatctctccccagatctagctgtgtttttattgtgagccacttaaaatcctttctggaagtcggtggtataaataaataacagcagccataacacattctctgcaagctcttagttccgagttgagcatttttaaaaagagctttttttagacaggcagttgcttccacggcaggaaacttcctgtcatcttcaccagagtggcatccctgtcagatgcctttggaattagtgggcagagaggaataagaaaggcagccaactgcgcatctacagatctttgaaagagtagttcctttttcttccctaattagggtggatttgggacaaatggttgggtccccggagaccgcaggaatggctggaagaggcagaaacatatccccaccacccccacctcaggccagggcagggcactcacccacaatcttcagagctagtatccctgggaaggtttctacccaatgaccctccgccgccataaaaggagagagggtggattccctgtggaaaggtggaaagcaggagagaagctatttatagatgagctttccaaaatagaatcaggactgaaccagaggtaacatcctcgctctgaggacgtgttctccgcttccttagggtgaaccctagtgagtatcatttgggctttagggcctcataaattcaagctcaactcttatccctgctacttaggagtcatgtgactttggaaagttacatcatcatttgcacctcagctccttcatctgtataatgggagttttaaaaacatccacctcctgcctggagggttccatgagaaaaatatatggagcgccttgcacagtttccggcacagaggagtcgtgccgaatgtgcagctctcctcctctccaccccatcataaatgtcttgtcattttttcgagccacatgcccaggttctgtaaactagcgtgggtgtgacagtgggacagatttccaggtggtgtagcccccacccccagctcgtgctgtctgctccgggccgcctctgctcccggcctcccactgctctgccgtgtgcgggccgctcatcaccaggtggggcctggcgggaggtaagctgtcctccgaggggcttgtgaatatgaactatgaagatttaagaagcccttaacctgctcagaaaaatgaccacaaacagaattattaaccacgaaagactttccaggagacataccatagaaaaggaaggctgttttgagcacttgtcatgggtggactcggtgcgctttttggaaactaacatttgccatcaaccagaggagcagaacctggaactcggggagctcgggctgccaggagagatgcatcaggagggatagaaggtcagtgggggccacgaaacccgagttccagtccccactgtcacctcacagctgtctgactttgagccagttgttaacttagtgagcctcagtttcttgctagtaaacacacctgtgctgccagtatcacccagcagcggtccccaaccttcttggcaccagggaccagtttcatggaagagaatttttccatagatgctgggcttggggatagtttcaggatgaaactcatgaaggacaacttagatccctcgcatgcgcactttgcagtagggttcatgttcctatgagaatgtaatgccgccgctgatctgaaggaggtggagttctggcgataacgctcgctcctggccactcacctcctgccgtgcggcccagttcctagcaggacaccgaccagtacccatccacgacccagggcttggggacccctgacctagaccattctttcatgttgcaacaaacaatgactgcatacctactgtgttagtttcctagggctgctggaacaaaataatacaaactgggtggcttgagacaacattatttgatcgcatttctggaagctagaagtccaaaatcaaggtgtgtgcatggccacgctgtctctgacagctctgggagagagccctttcttgcctcttgtagcttctggcgtggaaggcagtgcttgtagttgcatgacaccaatcctccgtcttctcatggtcatcttctccctgtgtttcttcacatcgtcttctctctatgcatgtcaacctctgtccagatttccacatttttttttataagggcaccaagtcatactggattagggcccaccctaattacctcattttaacttgattacccctataaagacactattttcaaatagcgtcacattctgacatactcgggctaggatttcaacacatctttttgaggaacacagtttaacccgtaacaaacagtaacacctagtgagtgcagaactggagtgcatggatgttacctttccatgcttgccgctctctgcaaagtctagctggagatcaaattttgtcacaagtgttgtgagtatttagaaacctctggcagcacacataagtcctgatcttttgaagaaaaatgttctgtaggcactgtgctaagtacccacattcttcctcagtgatggaataagggaaagacgttcccagcaaaagcaatagcatgaacacggcacagggtttcacagggatggggctgggtgggagggaggcagagctaagtttgaggaggtaggtcagggctagcttcctaggggctttgggtgctgggataaggtgtgtgaacattagccctagggagccaagggaagtttctagtcatgagaaaaagcagttcgaagaaggtggtgcctagctgctgtgtctggctggaaggcttcggcagggacacagggcagggcttttgatctttctcagatatgccctgcagctccagaaggcattcgtggccccttccagcagctgggaccactccagaattctagcatttcttggacatcctctagggccttggactatacccaccaccccacccctgcactcgaccaaggccccagatctctgaaccccaggagtgaaggggctgcagatggatagatggtcctttccaaggtcatgtcccagctcaggaatcttagacgatggtggtccaggagcacgcctgaaacgtgacctccaggggaatcctgcggcatcactcttgctttttagccaggctgctaggaaatactcgaaagattctagagaccctccctacctgccctctcccattgccctttgctcgaagccctctctagccacaggctgcaccatgcctttaagatcacgccctcctgtctacccagagctacagggtggctgccaagctgccttctccccacctgttggaggcatctggtcctaaggaaaatgctgcaggcgtgttgggggccttctcctctcttctcttctgttgggggcagacgttcccgaagccatgctctcatagtgcctagataatgtgtgtattgaccacaaagagatgttggccggcacataacattctcttcatagctgtgctggagctcttgtagccacctgatggaagcatccagagattccaataaggagggagatcacagatgcaaccacaggctttaggagtcaggaagttctaaccagaaagtagaaatatgtgaggaaccagtagggagggggtgacgtggtgcactggtgggaagcctaaacaccccaacccaactgtgtgggtgaatcccacaccctccggttcgcccgcgggatcttgcacaaatgattgcacttctgtgggccttcgcttcctcatcagccaaatggggaccataatggtgcctaccgcatgggggcgctgtgaaaagtaaagagagtcggtgatcgttaagcatgtagaacagtgcctggcacgaggcaagccctagaaaaaggggtggttacatgcaaaaacatacaaaatgcaggaattgaatgtgggtgacagggatggtctgcaaattgaacttgaaaggacatcagtctccaggatggtggaaggatttcaggcctaaggaagaaggaggcacttccatggatatacccaacattgccacagaattttaattctttatttctttaatgaaaatttacatttccttcttaactttgaaaaaaaagccagaacgcttgaacaaaccactgtaatacccaggagctgcctccagtgggatttaaagatgctggtgattccactttcctttatgggtcttgttctgaaagtcctgccagtccaggaaggcagcccgttgcagcagagaaccaaaccagcagaagaaagggatccatttgcgtggcaaaacttgccatttaattggatttcatagtagggttgggcttttctgctgcttaagatggccctggggggccatgggcgcgaccctccatatatgggccaccacgcggcatcctggggaggcgctgcagctcctgtagcccctgccgaagaggggacctcctctggaagccctggccagactctcagtcggcagcagatggaggagagccccttgcccttctggcttggctgttttcctcatcagcctgcctcatactcacagcaagggtcactcctcaccaccccactttctgcttctccttctctgttggttttcctccctgcacactcagaaatgctgctgaaaatccacgcttcgctggtgctccccacagccgccttcattaccaacccaagcaggccagggctctccatttgccgcagctggaagataatatataagccatttgaagcctcatgcctatgaatccagcagccagtataataaaacaccaggttattttgtgttttattaactgcctcttcccttcagtttgcataatagtgagttagatttacatgccgttaagacggctgtgcattatttttaatagaaggtacgacaggctcctctctctcagccctggcgcgtgataaagttacctcatgcaatgttgatgaaggtttcgttcacacttgctgggtcggggcaatgtctttttttccagatggatactctattgtaaaatgatttccctccataagcttgactctccgtccctctcttccgtgtcatcttcctacgaaccggataaactgcctattaaatttaattacggcccaaatggccacacatcttgatctcatgttccctcaagtgtactgtataccaccaaggtccttgaggaaggaataaaataaatctggaggatgcatgtctactctccacaaggaacgtcgtggaaggcaaagttgaccaccttcgtttttacagtgtctgtggcacctcgtgcaaactcttctttctggctttccatgcagacgttcaaagcaagagctagttttattcacttcctgtagactgattttaactgaggtggggaactaaagatatcagtttgagaaacacagtacctctcctgagctgtttacatttgtcagagaaccaaacgtcagccttttgttggatagtaaattacaaatatctcatcattttatctgtaaatatcttaatatgtattctaaatgaaagaagctcctgcaaacgaaagtaaagcatcagtgccattattaccatcctaaaataaaatgatctctaacacctaatagctcatatttctggttttctcatatatatcaccacctctttacagtttattttttgaattaaaatttagataaggtttacaccatgcaattggttgtcagttttctcagtatcttaagtcaggtttattgcagtatattttacataatgtaatttttatcttttttaaaggtatagtttgatgagtgtgataaaagtatacagtcacataacctgactccagtcaagatgtagaatatttccattgctccagagagtttccttgtgcacctgtggtcagtccccacctgccttcccgctcctggaaaaccactgaactgttctcaatcactatagttttgccttttccagaacgtcatataaatggaatcgttttgagtatgggcgttttatgtctgccttctttggtttagcatgcttccaaggtttatccatgttgtagcatgtattacagtttccttccttattaacgctacctagcattttcattgcaaagttgtaatcacaatttatttatccacccatcagttaatgagcatttgggttgagttgctttcaatctatagatttctctctccacttgtttttctctcttgcaatgttcttattgaagaaaccagttcattggttttgtggattttctggcattctggatgttgatagctgtacccactttgtgtagtttaccgtgtccctggatttcctgaggttatctagagtctcagtcagattcaagtttgatttctggccagaatatttcatgggtggtggtgtgtttttccatcaggacatcagcatgacaggtggcgtgtttttaagagattaacaagtactgatggtcaatgcttagagccattcattcatcagagttagaaaatggtgactcctcattcctttcttgtttgttagctggataactgcatacagagatacttcctctcctctgttacttgattatccagtggtacaggcataagattttaagtgttttaaaaggatgaatccgaccggacacagtggctcacgcctgtaatcccagcactttgggaggccgaggcgggtgaatcatgaggtcaggagatcgagaccatcctggctaacacggtgaaaccctggctctgctaaaaatacaaaaggttagctgggcatggtggcacacgcctgtaatcccagctacttgggaagctgaggcaggagaatcgtttgaacccgggaggtggaggttgcagtgagctgagatcgtgctactgcactccagcctgggtgacagagcgagactccgtctcacacacacaaaaaaaggatgaatccaggctaaaaaaaatgtagctgtcccaccaacaacctgcctgctcaaggctgacatgtcaccccctctaattggaaacacattgaatttctcccctcctatagagcttcccggaaactgtatctgatgacattttctctctctcctagaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctggtatgtgcctttttgagctctcaatgggtctggggagggagagagggcaccgtggaggggagggaggggaccaagagacattgaagatctccagaggaggttttgagtttcgactctagcactcacctgacttagtaggtggactcacctagcctctggctccttatctgtgaaatgggctgaattcccatccctcaggctcactgaggtctgcgaggctcaaatgggctgaggttggcaaactctacaggtgaatgctggtctgtttctaagtttaccccagaccccctgattttacaagaaacaaaatcatcacatatgctctcaggacccctggcacctgtaagttactgagtaatcattgccactcttcctcaggtctgtttagcaaacaggacacataaacattcaagcttcctgtgcgaccaccacacacggggacctctctcctcctaagtgggagtgcgttcgtgtgcttaattatagtaactgtatttgctttgcagaatggtttatacccaaagctatgagagacctaataaaaaagcaatgtttttatagcacttcaaaagctgattttactttccctatgttctgatgcatccctggaggccagtcccccatcccactttctccatgggcctccctgcgtacatacgtctaatgggagctgctcccatccaaggaaacagtcccagcctgaagcccccaccagggaaagagagggtggacttccagcctgtggaagacaaagtgtgctgacccccttaccctctttaaggctctagaagcagtagcgtgagcagggcagggagcgaaggggcatcagggatcccctttttacaggtgaggaaactgaggcccacagacgtgctatgactgaatatttgcatcctcccaaaatgtatatgttgaagccttaattcccaatgtgatggtattaggaggtggggtctttgggcgggggcgattaggtttaggtgaggttacagggtggagccccaagatggaatcagtgcccttatgaggagatgaagccaccagagctccctttctctttcttgtgaggatatagcaggaaggcagctgtgacctaagatgagagccctcaccaagaacccagccatgccagctccctgacctcagacttccagcctctagacctaggagaagcaaatgttgttgtttaaggggccaggtctctgttacagtagcctgaactaagacaggagggcagggatcttcccaaggtcacagatgggggtggtgcaagatcggggtggagtggggtatacggccagagtggtactgggctacctccaggcctaacaggatgtaaaagaggatatgaagcataaacaggagcccttagggatagcagagatgagagagttgtgggccacagtgagctagaccaccagagagtaacagagacaatgtgggcgaatcaataatgatgttaacaatgagctattagaataatgaatgaaaattactgggccttttaatgctttcctgacaagaacttaaaatgtaacactcagtagaatttcccctaaacctcataacacttccaagatattagcagagactggagttaccaccacagtgtctgagtggtctgtgaggtgactcacagcaaatcaagtccacagcaagcaatgctgtgtcattctgacagccctgcatcacgcagccacccagcagggcctggagccttcccaggcctcaggctctgaccttgaccttctgcttgtttcttaatccttcttttgtctagttgccagatgatgacagtttgtgatactcagccccaacatatggagtgagaggtatgctttgagatcctccgggaaagtgtcttatttctgcacagccacacacttagtgatcagggtgcagtctccacaagatttaaatccccttcctcaatttagaaatccccttcctgcctccagcacctctcttcccacatctcagcttacactgaatcctgcagcactcttccagccccatggatccaagcattagccattagccccttggtagagtcagtagaacagaaaccaatttttgtgaccttggtgaagttatttaacttctctaagcctctgtttacctatgtacaaaatagaaatgcaaatcaacaaggcattaaataaggtaattacttaaatgggattaaatacattaacagctgtaatacctagcacgtagtaggtacttagccaatgatgttgatgacaaggccaaagctgggttaacgtgggcaatttcagccctgtggtgggaatcaggaaactttcaaccactccttcctgggccatgggggtgaggagtctgggttggggtgcaataggccagggaggaaaatgtcccgatagttaaagggcaaagacctccaatcataccagacaaagttcgaaggaatacccatttggccctaggcaagagcttgtttccaagaatttgtagcaaaggcaattaatcacaagatcctgaaagtacgcaagttcaaagagcatattttgaatgagaatattaactggcagagctgtttagaagaatcttcttatctaagtcattgatatatggatagagtgggacagagtaaccaggcggatggacagacagacagacccaggctgaggttattctcagaccctagaaaggaaacccaggctgtctcaagggtcaccagccctgattgagtaccgcctgttcagagccacgtgtctcgtgttgtgtgtggtctctcaacaagacaaggtaatgcttccaactgcacgcctgccagggctggcactttcacaggaagatgcggtcagctgcgggacacgcagccgaggctctccaggaagggttgattcagaatcatgaggtgagagccctcataatacaggcagatggggatggaaggcctcacctgtcctgcccttgctcaccttccaggggaatttcccatcctagcctttgctcggtggggaccatttagtgggcagcccacagccgggcttccttcacgaggttgggtccagaagattctgaggccacactttgagtttcatgttttcccacaggagccaagtagccaaaaatgtctctattaagacaggcagcctcttcataaccactgcagatgggttttttatgtttctttcttcactcaagagttggtagcatcctagggctgtgttcaggcaagtgagggagccccggagcaggagtgaccccttcacctggctctgcccccatgtttccttctcgttcaatctcctttatgccttttcttccactctctctcacctgcctcttctcctctgcacgtaattaggatcaagtctctctcaacttaaaataaaaatcgtaaaaacaaaccttgaggtggtcagacttcggtttctctgcctcttctctccctccacccctcttccctccctcccatccttctcttcttccttccgcaaatatctgttgatgacctactgtgtgccgcgcactattctaggctctgaggaggcagcagagggaaccaagctaaaaccccagccctcatggagccgaccttctcctggtggggggacacagacagtaagcaagcagatacgtggattagacagcgtcttacatgcaacagaggagaacagaagcagaatcagggatggagcacaacaaaggagggctggggcttgtttctgtagctcagacacaggtggcatttgaagaaacctgaatgaagaaacaatttcccagtgtttcccagaaagagccaggcccaagaaaagacactgatgggaggggtgtgtgagtcgtggggagcctagagagagtggagttcaaaggccctggggcagaggaagccccggcaggttggaggaagtgagtgtgcctggaagggagtgagccagcgggggcgagaccttagatcctggagtggggcctgtgatcgtgcacagattctccttcttggtatcctatagagtcactgggttttgagcagaggtgtaccacggtctgacttttggtttaaacgtttgctctgtcttgtcatgtagcactgcgtcaatattggttgaagtcatgattctcacatgtatttactgagcacttacctcgtggatgtgagatggcagagtggagggtccctgccctgttggactctacagtcaactccaaccccgcctggcctgcccctacttttgccacagtatttatctcctcccctcaccctccgcccccaccccactgcacgcaatcctggctccacatagatcctgctttccttcagcttgccccagctgttgaatgtgggctctgaaactagcttgcctgggttcaaaatctggctctgctgcttactagctgtgtgaccttgggaaagttacttccctctctgagcctcagttgcctcgtatttacaatgaagatggcaatagaagcttcctttcaggctctagaaagcatgaaatgaagtagcacgtagagcttggaacagtgtgtggcaccctacaggcctcagttatgttcggtattattgttaagtcgcactatgccctcaggggtcctgttattgtccacattttgcaggtgaggcagctgaggcccaaggggaaggcaaagacccatagagctccctggaagagtttccagcctctggataaaggagggcaaaattgcttttgcaaaatagaaaaccttgaacaaattttcggatgagaaaatgacttgctttgccagggtttgtttaaagactgtggtggagaattcattaagtgctgtattttttacaatgaaattaaaccatgtgggaacacagcaagggataatgattcacttgtgattctgaagacagggttttcatatcagccccgtgggcaaatgatggggaaagctggtatgccacagtgatgcgtgggtggtgcaaccaggccactcagcagaagcagcgagagggtccttccttcctggacaggggctcatgccatcttgcctctgccggggttgcccttgtaaaagagccactgcctatgtttctcaaagctggaacttcagaagcgggactgattgtatttgtcaacacaggaggaagctcagagaggggaagtgactttccccaggtcgcgcagctagtaaacagtggagccagatgttgaacccaggcaagctgccttcagagcccacattcaacaggttgggcaagctgaaggggagcagggtcagtgtggagccaggactgggtgggcaggatgggtgaaggaggtaaatactgttgtaaaactgggggcaggccaggcggggttgaagagcttgactggaaattctagccgcccatctggcccaactcacaagggcgcctctctctgctatatcacctcgtggcactgcctcgagcctcagtcaagctctttcctgactcagagcctttttacatcccattccgtctgtctaggttacccaccctcttctcctcatgttcttcctggcctattcctcatctcagctgaaatgccatctcttcagaaaagccttctccgaccagccacccgattcctccctcacactgcaggtctgtcccaagctcttaaggcatagcgtaatgacaggtgcatttcccaaaagcttctcccccagtctgttgtctcagtgagagtaggaaccatcttagggttggtcgccgtggcagggttccaggctcgaaagggggatttagtgaatatttgtgaatggatgaatgagcaaatgaattaaaagtcaaaattcaaatcccagcatatatgctgcttttggaatatcacgcctgttaaggcttcaagatttaatgtctttccctacaagacacacggcttcctgagtcctgccacccactgcccttactgcccccaaggaaaatattcccatgccagtcacagcagcaccctccttctggtgacgcaaaagtgacggcctgtgtgacttcaaaatgtgatttgtggctccttgacgccctggagactgtgcagctgtatagccatggagggccgttcccatgtgaacctgtccctccctctccccttcctggggactcagtagagacaagagcccaggctggtggggagcgagctctgggcttaaagacccacagcctgagctcaggcttcagcgttgcgcctgggcgtctgtgccatcacgaggaggccctgggtctctcctagcctcagcttacccacctgtagatgtggcacgattaccccatgaggcaccaggaattgctgtggggtagccagtgtagcggttaagagggtgggctttgcagtccaactccctggattcaaatcccagctctgccatttaggagctgagtgaacttagggaagctaactgacctctctaagcctcagtttcctcaccaattgaataagtagaatagtagctcctccccattcaggttgctggaataaagaattgagttaattagttcctggcacatagtaagtgttcctttaaataagctgtaatcatcagtcttgagtaagcctaggctgcctttatgaagtgtggtgtctgagctgctaggcaatagcacctggggctgtgctgtctagttcagcagctgcgaggcagctgtggctcatgagcaccttgaaatgtgcctggtgtgaagtgtgtattgcaaaataaacagtcttttaaagacttagtatttaaacatgtataatatctccttaatgatttttttgtattgattacatgttgaaacaaaaataatttggatatcttaagttaaaatagattattaaaataattccatctatttctcttaacattgcaaaacaatggctgctagagtactggtctgcaaaacagagacagtaacggtaacaaggaactcctgctgcttctaacatctgtattttctcctcggttaaggcaggctggctacaggtcccattggggaaaacattttgttcccatgagctcatcacaacaggcactatatgcgctgcgtgtgtctttgttattagtatcaccacttaaacattgttactagtatcactacctaaacattcccacaggcatatggggataaattgtcgaatcagatcaggatctgcccacatgttgccaaacacaatcagtgtagagtgaccaagatggttgagcaacctgagctttctcctttgcctgaaaactgggcaaccccttgatgcctccctctgaggtttacaagatagaagagagtctgatgaaggaattcagtttattcattcaataaatattcattaaccacctgctgtatggaggacattgttctagatattaaagacacaacagagagcaagacaggtaaagagcggtctcattctcagagctcatattctagaagggagataggccaggaaactcagatggtgacaactgctatgaagaaaagaaaacagggtggtggtttgcattgtgaaatactacacagcagtgaaaaagaatgaactattgctgtgtacactcatatgggtgaatcacacagagaatattgagtgaataaaagcggacacaaaagagaatattctgtatgattccattgatctgaagttcaagaacttgcaaaactaacttgtaggaatataggtcaaataatggttacttctgaggaagaggtttgattaggagaagtcaaaggagccggtaggtgctggaaatattcatatcttgatctaggtagtagttgcacagatacatggttagggagaatgccttaagctgtactcgagatttgtgtgcagctccaggcatgtgtgctatattcattatctattgcagtgtaacaaaataccacaaaacttagcagcttaaaacataagcattattatctcccgtagtcacagtgggtcaggaatctggtactgacttcattgggtggttctggctcggtatctgtcatgaaatagcaatcaagaccccggccagagctgcagtcatctaaagaattccagaggctggaagctctccgcctccacaatcgctcatcacatttgtctaggaatttagtgctggttattgatgggaggactcagtttcttcctctgtggacctgtccgtggggctggttaactgtcctcttgaaatgtcagctagcttccccagagcaagagattcaagagacagcaagcaagaaggaagtgacaatgctttttgtgacctagtttcagaagtcacacaccatcactttcaccatattctatttgttaaaagcaaatcattaagtccaggccacactcaaggggagaggaattaagctccaccccttaaagggagtaggatcaaagaatttgcacacatatttttaaaccaccacacgttatacctcagttttaaaacaatgttatttcttattccaaaaaccaaaagggtggtgggatagaaaataatgggttttaggaagcattttcactgaggctttagaggaggtgacatttaagctgaactctgagaaaagagccatgtgaagatcagggaaaagcactgaagccagagggaaaagcaagtgcaaacactttgcctcagcagtgagtcatcgaagcttcacaaagaagaccaagatggccagaagttcatgagcaaaggaaaggaggagtagttaaagttggcaaggtagggagaggccactgaggccacagaaagaagtttggattttattctgaaggtgactagaagccatttgaggagttttctcctctgatgaacattttggacaacatgctctggctgctgtggattgaccgcatagtactcgagcaggaatagaaatgaaggatcacttcagaggccctcaccgtaagagaggtgatggcagcttggtggacaagtccctggctctgcctctggggtcccacatcatcagattcttccagggttccattaacaagtgggcctcccccaggacacacactgaacacacactcccatcaaaagcaatagagagatgcacagttgtctttgctgatggcaagaagagaaggctctttttgccctgaggaggatcaactttgaccatcaactggagctttgtgttgtccaacagggccctgctttggttggtgagacagcctggcctaggctatttttacccatctcgtggggcctgcatgccggtctttccagataagatgccttcctttcaaacaaagagtgttttaatcctggagaagtacttggtggttgccactggcatttgattttagtgtgacaaaatgaaacgacttgggttctctccagagacagaaccagccggaagcagtgagaaggatgcctgtttcacatgggggccatcctgtttcaggctggggccggggcagggaagggaggctcctcagataaaagaagacattgagcagtcttccttctcaggccatgtgcgttccctctctggatgtaccagttgtacttggtttcggctttgaactttctaggaagagaggcaacagaacatagtttaaatgactcatcagaatccaaatacattctaacttttgaggaagaaaaccttttcgaatagaatagttagaaacatttgagggctgcagtttggatatggatttctaagtgagttattggcaatttgcaatgtcctaaatcctggtcttttgttcctttccgacaaatctctggattctttcattttttgcaggggacagatctcatgcattcatttcttggcggcatgttaaagctgcaaagatttatttagtacccatttgattccagactagaaacgtatcccaggatttggggcccataaatattgagcatactaactttgttgttgtggtggtggttgttgagacagggtctcactctgtcacccaggctgaagtgcagtggcgtgatcccagctcactgcaacctccccctcccagttcaagagattctccaacctcagcctgcccagcagatgggactacaggtgcgcttcaccaggcctggctaatttttgtactttttggtagggacagatttcaccgtgtgggccaggctggtctcgagttcctgactgcagatgatctatccgccttgccctcccaaagtgctaactttgactgtcacttgataactccctgcacagacagtatttcctaatgtttctccaggtagttgaaggaacatcaggctggggattggaaggcctgtattctaggctctagcaccattgcttgtgtgaccttgggcaccacactttacttcccactttcaggggaaatgtgaggctttatgcccaatgacctctgggttttcttactgctgtgacattgggaatggcttcataccccatcagttaccaagatgaagtgaaacaggtcaaccagttgggaaaccagtggaaatggctgggctagctcagaaaggcccctgggcaagtatctgggaggtgaaaataacgacccatcaaatgaagagagatcatggtagtgttttgagaactactcacattaatgatcaattgctaattcactatgccacttgatcatatagtaggaacattaagaagtttgaggacatgtcctgatttagatatctctctaccacccctcccaatataaaacgaagtttctgtttccaggccacaagctctgcacccctctacagcaggcaggccaacgtgaatagttatgcagttatgtgctgcacaaaagtgcccagtaaggccgatatcgaaatcagtactgggctaaagattatctaaccttagagaggtgtctaggtttgactattggcgtggagagaaaatgaggcagctgtggagcaatggttaaaaccatgggttctagaaaaagctgaaatcaaatcattctactagcttatgtgacctagcataagctattcagatttgtttccccagctaatagtaacaattcatgggttgataggagaaataatatactagtgtttagtatggtacctggtaggtgatcaataaaacattagctattactgtatgttagggatgaagagggcttactcattcagttttcctctcggagttttaaccaataagacactgaagtcagacttttaaaaatatatacaacagaggcgctgctgcaccctcactctataggatgtcctggtgccttcctccttatccacgctggagtcctttgtgtagggagaaggctggctcctaggtcactgccttcttggagatttagagaacccaaaagcatgtgaccattgcagtacaactgtcccatcatggttcatgtggtccagtgggtttgaggctcttgtggatccaccaccagtcagataggactgtcttccccatgggaagtgtcctggtcccaaacccccagtgtttccctgacaagatgagagatttgacagaagtttttcttttaggagacctgatgggaatatgggcaggatggagagggctttactactcctcctaggtagaggtcctgtgtcttcctcagaggccactcctctctgcacatggctgtgtaacaggaataatgcaggcctttctgatcacatctgccctcctgtaggttgacactgaggtggacattcacaggactatacccagtcaaattgaatgccattatctgggaaaaactttcaacttcttcaacctcctgagttattcacttttgtccaggtgggatttacttctctctgtgcttcaagcagctctgaaactttttcagagagaaaagtcaagtatggaaacctggtcagcagagaccctttattgtcggtgcagaaatgtggttctgggtggggaagtgctctgcaatgcacggagctccttaccagcatttaggcttaatagggcagtggaaacatgaaccaggattgagtatctacagaagcaaggcatttttagtttgttttgctctgagtgaggcctagaggcacagggcagtgagcaagagtctccttagtagctagcgccccagggggccaacagggttatgtgtcaagcatacactgggtgggactgggagactctggcagagtgactcaggctttttgcctgtagaaatcctgcctacactttagggttcggttgaaatgctacctctttatggatctgcccttgatttcctcctggctatttctgagctttcctttttctgaactccctagtaccttgctggtttcactcatgtcccttgtattacagctgcctgtgtaaccgtgtgatcagaggcatcatgggagagagagcctaacttgggtttgagtcagattcagttacatgttaactatgtgacattgggcacatcacctaacctttctgagccttaagtccttcatttgtaaaataagaataatattcactttaccaagctgtttgaaagattgaatgtagggtatgtacaaaacttgatatatactatgcatttaataaattgtcatttattgcagactgtaagctcttaaaaaatagaatcttattcatctttttttttttttatctccagcacctggcacagtgcctgggacataattaggcactcagtaaatgtttatttgagtcaagtaatgaattacttttaaaaagatatttctcaaaatttcttatgtcctgtttagtgtttcctaaaaaactttagcccctgggttttgacttctgtagtctcttaatgaaagagctaaagaagacattcaacatgtgaaagggggacagactgccccaagagctccttggaaatcttcatgttatttcctgcttacatctgattgatgatttcaggacaggatggcttagaacatccatcaatttttttttccttccagattcttagaatttgcaccaggtataccccagaacaagacaccatgactttctcagacggccttaccctaaatcgaactcagatgcacaatgctggatttggtcctctgactgaccttgtgttcacctttgccaaccagctcctgcctttggaaatggatgacacagaaacaggccttctcagtgccatctgcttaatctgtggaggtaccaactatgtagaaaagcctcatgaaattccatgaagaacagtttatacttgtaatttgtgaaaaattcctcatttcccttttggagttgttttacatgggaaaacatgtgaataaagccaggcatacatgcctggtttcattgtatttttccatgttgttacaaattaactaatggtatttgggatccttctgctcagaaagaaatcccaaaaagctattactccaattgccacagattttttttcttaaaggcaggatcacactattataaaatgaattgtctggggacatttgaatgatgacaagggacttgtatgtgctgtttgttatctagtgggtaggcatacaagtatttggctgggccctcccaccaacccttgcaggactgggataaaatttagctttcttctttgtagtgacccctactggcctataggaggctgaatcgtaagtggttaaaaagtaatggttttaattaaggagcagatttattttatgctaaaataaccatcctgctcaagatttgttttaattcagtttggtagtgacaccttctggtcaaaggaggtaattctttccctgggacaaaagcaaccaggcatcaaaatgtttatactaccaagggggggcagtttttttttgtttttcaagtatcactgcttaaagcaactgcataagtctgcaaatttgtgtatgtaattgaattaccaaattaatgaactcataacagtaggaataaggaaacaaggaagaggggaaaagggcataaatcctgattttgtttaatactttattcctggtatccagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtatgtcttcgtgctctcagtactgtagtcacacagtggacttgagggccttaccaggttgtgttgctttattcaattcaggatgtttaatggctgcttttaaagtcttggaactcatttctcattgaaatcaaaaggaaatactatccctcccccctctaaaaaaaaaaaaaaaacacctcaaatcttaccctattcaattatcttaacgattgagagctttaaaattcatgactgattagaaaaacattgttttcaagagaatgtactaaaacaggctaattctctaggttcatacatttaattccagctttctacacatctctggtttatgttaccttgactccagtttttcttgaatatctaaacctttgttaagtttctctcaatcactttagccattgctcttttgtatataggcagattttcttctgcacacttctaagcaaaggaattcttgcctaagaggtatattctttgcctagtgattttctgtttatgtagcaactcaagcaattaatagaggtgcctagatccatatcacagttgagtgtttaacagtaaggtttttctatgtagagagacaactcagcagctatccctggtaccaaatgggctattgtcattctcctttccccatcagactacttactctgtctctgaagatgtttgctagccaaggaataaactctgtatttcagaaagtgcttaaaagcacagggaacttgtttgacaagcagtcttaactcgagctccttctaagaggtctcctagatgagcattctgaattcatccttgcatggaattaagagtagaagtaaacagcagataccagtgtggttgtgaatacggtatctttgatttttaaaaatgaggctgtttaacataatactatcattctgtatagatgactagactagtgatatctaatagaatttactgcaattacagaaataatctgtactgtccagttcagtagccaccagacacaagaggttctcgagcacttgaagtgtggcttatgcaactgaggcactgtttttctcattttatttaacaaatttaaatttagctacctagtgggtattgtactggacagagtgctgctaaatctagttgtcaatagtcactgcacatcgtgaactcctctgtttgtgggtaactgccatcaacctgtctttttcaagatacacttctttcatcaggaacttctctttgtaaattgttatttcctgaaactaagacatcatatttaaacgtcaccatatctcagctgcttttccacaaagtaaaaatgttttaatggtgtaaaataaggatagcctctgggaggcattgtttgcataattttctgttatcaaaaggagcaattgtatcagttattgcttgcataaaagacgaatgaagttctagcagatcataaaaagaccctctctatcaacatactatgagtctgagctggttgagaacccaatctaactaactttgcaataaactaacacatgatttttggtggatgcagttcccattccaaatacatttatctttctttgtatttatgagtgtgatagtaatcgatagatctttttcaacaaaaagccacctgatatctacatttcataattcctaagcaagaatcttaggaaacacctctgttaaaatatatgaaaattggtccctggttatctgtcatagcttaactccttatcttaaccatatttccattatctcttttgaaaaggtgcagagcgtgtaattaccttgaaaatggaaattcctggatcaatgccacctctcattcaagaaatgctggagaattctgaaggacatgaacccttgaccccaagttcaagtgggaacacagcagagcacagtcctagcatctcacccagctcagtggaaaacagtggggtcagtcagtcaccactcgtgcaataagacattttctagctacttcaaacattccccagtaccttcagttccaggatttaaaatgcaagaaaaaacatttttactgctgcttagtttttggactgaaaagatattaaaactcaagaaggaccaagaagttttcatatgtatcaatatatatactcctcactgtgtaacttacctagaaatacaaacttttccaattttaaaaaatcagccatttcatgcaaccagaaactagttaaaagcttctattttcctctttgaacactcaagattgcatggcaaagacccagtcaaaatgatttacccctggttaagtttctgaagactttgtacatacagaagtatggctctgttctttctatactgtatgtttggtgctttccttttgtcttgcatactcaaaataaccatgacaccaaggttatgaaatagactactgtacacgtctacctaggttcaaaaagataactgtcttgctttcatggaatagtcaagacatcaaggtaaggaaacaggactattgacaggactattgtacagtatgacaagataaggctgaagatattctactttagttagtatggaagcttgtctttgctctttctgatgctctcaaactgcatcttttatttcatgttgcccagtaaaagtatacaaattccctgcactagcagaagagaattctgtatcagtgtaactgccagttcagttaatcaaatgtcatttgttcaattgttaatgtcactttaaattaaaagtggtttattacttgtttaatgacataactacacagttagttaaaaaaaatttttttacagtaatgatagcctccaaggcagaaacacttttcagtgttaagtttttgtttacttgttcacaagccattagggaaatttcatgggataattagcaggctggtctaccacctggaccatgtaactctagtgtccttcctgattcatgcctgatattgggatttttttttccagccttcttgatgccaaggggctaattaatattaacaactcccaaagaaacaggcatagaatctgcctcctttgaccttgttcaatcactatgaagcagagtgaaagctgtggtagagtggttaacagatacaagtgtcagtttcttagttctcatttaagcactagtggaattttttttttttgatatattagcaagtctgtgatgtactttcactggctctgtttgtacattgagattgtttgtttaacaatgctttctatgttcatatactgtttacctttttccatggagtctcctggcaaagaataaaatatatttattttaaaggtgtgtgggagcttttactacacctttatcttcagtaaagagacagagaacacagttccatttttaatgtttaaatttcatttcaaaaagcaggtctgtagtttgtaaccatgacaattaaaatctgtgctaatgcacggcagtctataacaattctacaagccaatcagacagtacgtgacatttcaatgagtaaaaaagagcataaaactgtatgtgtaagaacaaaatgttaaaaggcctaccacaataataaaaaaccgtcaattacatcatcacattaaaataagccagatgtacaaaagtctgagacagagaagacaaaaggacaacacaagatatttgttgaaaaatgtttgtgctctttgggcacttaattaaacattgcaaaatcaacatcatcttcttcttcatcagactctgcaaaatattttacttctttcctagcccgaccggttcgtggcagagaaggtggctcagtagggaagtctgaggggaagatgtccacatctgaatcctgatcaaaagatgtcttcttcggtttctagattttttttcaatagatttaaaagttatgaaaggaagtaaagactagtattaagaactatcactccttaaacttcgcttatgtttaggaagtattacaaataatggtgcttttaaaattagaatcataatgctaacctaagtgtaagaccagttatcttattttttggaggaaaaagattacatacagtaattcaccaccttggtggtttcatatttaccaagttctagcctgaaaaatgtaacacctttatttctgaaattatatattacccaaaaagtatgcacaatgcccagattagtaaaaattcaagctgtcctactggtaagtacatatcaagaattcatgggaggaaacaagactcctgcaccgtgtgtagtatgtgtgcactgtaagtgtttaaaaaaatgcaaagcatcaccgaggtggacctgagacatagaagatgactgaatggaagaggtcaatgtggaaatcaacataaaaagggatgcgggggagctgatgtcattcatttacctaaaagaaatagtgtacttctggaaaagggtcagactaattggaaaaatcagccacagtcaaatgaattcaattaaaaaaaaaatcaaattagccctggtcaaataaatccaagttaaaaggaaacagtctttagtctgaaaaataatattttagtctgaaagagtctaatatttaggtagcataacactactacagttcagtggatgaaatggaaggttctaagtaggttaatttatagcacagttatttaggaaatagtcctgattatataaatttatacttgaataatttcttaaccaaatacaagccccatattgatacgagatgctaggtggaaagctgttccaggactatagtcataagcaaactaagtcacttacagatctttttttaaaaagccatgcactaatatgcaatgatgttcccggttaccttgcttgttgttttggatgttttcctgccagggttataatcgccttcattttcagagccagatgctttccttttctttgcccctcggcctttaccttaaaatgatacaaaaggttttttcttccgtggttaagtgcaatataaaaagataaatgccacaacattgtagtttatttctttggcatgcccaatcagtggagcattgcagtcctgatctcttactatgagtgattataaacaatttggcagtagcatttcaattctggggttgacatgaccaaagactttttgacaaatacatttaaactagtgggaaagtcccaaagacaaattttaatgatgaatcccttcatacataaaacatttgtatttgctatttggtccttgagcctgaaaaggaaatatcttggaagagtacttcttaaattacatgggatttaaatattttttttcatttctaatttgtcatgggccaatacttttaaaaataccata

SEQ ID NO: 14811 - DNA, 174170 bp, Human; identical to SEQ ID NO: 14810
  misc_feature (1)...(174170): n = A,T,C or G

SEQ ID NO: 14812 - DNA, 174318 bp, Human; identical to SEQ ID NO: 11880
  misc_feature (1)...(174318): n = A,T,C or G

SEQ ID NO: 14813 - DNA, 174318 bp, Human; identical to SEQ ID NO: 11880
  misc_feature (1)...(174318): n = A,T,C or G

SEQ ID NO: 14814 - DNA, 9721 bp, Human
aactccgtctcaaaaaaaaaaagtgtatgtttcttctcctgttaatttgtctattgtcagttcattttagcagtgaacactcagagggtggaggggaagcccctacaagagctttaaaagctactgatgcttgggtctcactcagagattctgatatattcagcccaggtgtaagattttaaaagctgcccaggtgatcctaatgccaaggctgaggcccctggaggaaccctgcagagctgcactcactactcagcaatcccaatccacacgtgaagggttaagcaggagtacatttgggtgcagggggcagggcattgttttgggactcaggggcctctgaggaggcttgtggcctgagtttctgccaacaaactgaatgcctcctcttcccataacaaagcgtagaagcgggaggcatttgcatttgccgcaaggggctgtgacttctctgaatttgtccctcaagccccaggtgcttcagccttggtgggtgatgaagcagagcagcctgggggtgacctgtgctagggtccaagggtttccaagctcctcagaaaatcatactggcttcagtggagctgcagagccacttgcaggagaacctggatgtgctgtcctttggaagagtggccataagggtctacgagttcattttagggtgggctcagaaatcagattgactcagcaggccccagagaggaacctgcactttttttttttttgacggagtcttactctgtcgcccaggctggagtgcaagtggcgcaatctccactcactacaacctctgcctcctgggttcaagcaattctcccgcctcagcctccccagtagctgggattacaggcatgcctggctaatttttgaatttttagtagataccgggtttcgccatgttggccaggctggtctcttgaactcctggcctcaagggatccgcccgcgtcagcctccgaaagtgctgggattacagccaccgcgccccttcaattaactcctatttttttgtttgttttttggagacagaatttcgctctattgcccaggctggagtgcagcggtgcaatcacattcactgcagccttgacctctaggctcaagctatcctcctgcctcagcctcctgagtagctgagactacagggacgcaccatcatgattggttaatttttgtattttttgtggagatgggggtctccccatgtttcccaggctagtcttgaacttctgagctcaggcaatccacccacctcggcctcccaaagtgctgggattacaggcacaagccaccgcgcccggcaaacttatctcctactgatggatattgcaaaatttttcttctaccaaaaaaaaaaaaaaaaaaaagatagatataatccataccatctgttcaatcttgtcctttttaactttttcagggaaacttcccccaggtgatagatggatagatacatgagatagacataacgcatacgatcagttcaatcttatcttttttaactttttcagagaaaacttcccttaagtgaacatttaaatctgaattacgtcctgttaaactgttctccaggaaaataaaataaaataaatcttcaagtttttgtttacctaacaatttgttgtgtcgaacaaaccttcctacttttcaggtaacaaaatggcagcttaggctagaaagccgctcatattcgcaggtacaagggctgggtaagaacgccccgcctggctgactaacttgagttccgcgctctggacaggaattatgcacagggcgtcgctgtggcactagaaaccccaaagtcacaagcgccccagatccgaccaggatgccgctaccggctacagcccagaaggcccgctcctgcggcgcaagcccgccttcctgaagaaaaagcccagtcccggcagcgttcttctccggctccgcccttcttccgctcgactttctttgccattggctgacaacggagtacataaggacgtcatttcctgccgcctgtcttttccgtgctacctgcagaggggtccatacggcgttgttctgggtgagttccgtgtagcgtccctggcgccttccagggctagaaaaatgagcttttcctgctcaaatgaagggtgagaagactagtgatgaaagccggtcagactggatctgtctcccgcccggcgcgccccaccttaggcctgcggcccgcacgtggccaggctcgggctggcgggttcccagagtgccccgggagcgggtggaggccgccctccagcggaggctccgagctggggttcggaccaggccgcgggtgggcgggagtgcagaaagcgggctaacatcctgtgttgctatcccttcggagtcccacacggcggtgagtctaggcccaggcgctgatttacaccagctacttgggctggtcgggttttcccttcgcgccgtgcgggtcaggagttaaggttctcgggtttttagacaaacaagtggtgacagcacagcgaagtaattccaaagcatccgcctacaatctgcttgaaaatgtctgaaaacaattcatgccttttttgcctttagtttgcatattccaaacatggctgctcttttatatctagttgttaacttggcgcatccacaacttttccttaattcctatcttgagaagtgttgaatttccattcgctaatttcgtgtagttttattactcggttactctgccgtccacactatttcctcagtaagatgtgcgctgttccgtaatacacgacatgtatgggttaactttctgtttacccttcactacactgtaagctcaatgcctgacactatagcagatggagtttttggttgcttttaagggtgtgccctacttaactcaatggaatgaaaagaaataggttgctctcttatttcagattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggttagtcattgctttaattttttgttactccagctgtaagtacaaattttgagcttgctattctcgtggttagttctgggtaatttctttctatcttccttaaatgaagccagacccctacgttgaaaacatactttaaataaatgttcttgttattgagagaaaagatttctgctccaggggaggaatatgtcagttgtctgagttacgggacttgggttgggtcatgaacatgagaaagttcattggctgagtttctaatagctcgcatagtgccttcaacttcataggtacttacacaggctattgaactgaattttgagtggaaagtggggtaagaggtgggaatgaacaatatggtttggaagaaccagaggatggaaggcattaagttggctaaggcacttacttattttagagataaagctaccaaggacttgggagtgacatgctgtaaaggagttttaggatgaatcttgcatcagtgcagattataaaagggaaagagtggcagaaagccaggaagtggattcttaagaaccaatgatggaataagtacagggaaagagaaaggaaagatggatttagccaactgaatctaggctgcacactattaaagctcagggtggaggccagtcttggctcatgaacttctgagtgtcggaagtgtgctatatcaatggcaggattttcgctaacaccagtagagcttgcctctatgactggagtttggtagtactcgctgccacatagagtaaacttgagaagaatgtttgcacagccaggtcaagtgttacaaatccttctgccctcacttaggcatctatatcataaatctcaagaggacctgggagaagcttctgctggcagctcgtgcaattgttgccattgaaaaccctgctgatgtcagtgttatatcctccaggaatactggccaggtttgtggaacagtggttagtttttatattatagaaataaagcttacagacattgtgagacatagaaagacataagaaaacagaaataactcaggccgggcgcggtggctacgcctgtaatcccagcactttgggaggtggagtccggcgtattacgaggtcaggagatccacaccacggtgaagccccatctctactaaaaatacaaaaaattagttgggcgtgggggcgggtgcctgtagtcccagctactcaggaggccaaggtggagaatggcgtgaacccggtgggcggagcttgcagtgagctgagatgcgccactgtactccagcctgggtgacagagccgagactctgtctcaaaaaaaaaaaaaaagaaaatagaaaactcaaactccactgttagagatcttaagttggactgagccatagaaatcgcccttatgacctatgaccttcctttttttttttttttttttttttccttcaagacagtctctcgctctgttgcctgttgtccatcctggactgcagtggtgtgatatcggctcattgcagcctttgcctcctaagctcaagggattctcctgcctcatcctcccgagtagctggaattacaggcatgtgccaccatgcctgactgatttttgtatttttagtagagacatggttttaccatttggccaggctggtcttaaacgcctgatctcaagtgatcctcccacctcggcctcccaaagtgttgggattacaggcgtaagccactgcgcccagcctgtaagaccttttcaacatacatgctgggcatctggcagtatgttgaactttataatttcattttgtgtagacttgtgccactaaatatctagaaattctattaaagtggcttatcacattttcccatggtcaaagtttttaccttaaaacaatgaaatactgggacagaaattttttaagaatcttagccagtcatgacggcatgcacccatagttcccgttaattgggagtctgagccaggagatccctcaagtccaggagctgggggctgcagtaagttatgattttgccactgcactccaagcctggggcacagagtgagatcctgtttcttaaaaaagccagtcatgggtggctcatgcttttgtaatatggggtactttgtgaggctgaggctggtggcttgcttgagcccagaagttcgagaccagggtgggcaacgtggcaaaactccgtctctaccaaaattaacaaaaacgagctgggtgtggtgttggcgtgcctgtagtctcagctgaggctaaggtgggaagattgctagaacacaggaggttgaggcagcagggagccaagactgtccactgcatcccagcctgagtgacagagtgaggccttgtctcaaagagaacctctgccaacttgaatgaaaaataccttaatttgtatttttaagaaatgactagttagtaaaacttgaatcttttttgccacagctctattttaataattttttctgttgagaaaactagtagatttcttgaattctaagagttctaacagggattttattcatcttaactattttgacagatttaaaaattatgtagtaagactttatttcaatgttgacaggacgggttcccatgtgtgtttttgcagagggttattcctgaaactgacttgttactaggaccacatagtttggtacacagtagaaaaaaggcagttagttattgctgtagaatgaactgagtgacagttcttgcttgcttgagaaaaatatactgagcatctagattgggccaggtagtgttgctaggtgctcgggatatatagtagaaaaacaagcctgtcttttttaatgtatgcaggaaatctctggagaagtaagaggggttaaggaaagctgggtatgtgcctgctttacatggagtagtagtgattaagttggccagtgcccagaagtgcttactgggtgccaggattgttgctgtggaatatcgagtaccactaacttttaaattcttcaaagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaaggtaatgattttaggatctagagtttgtgaatgcgtgctctagaaaaaacattcctgtgcacattgttagagcttggagttgaggctactgactggccgatgaactcgcaagtgtaggtagtgtgctacatgaggggcaagttttcgctaacaccacaagggtctctggcccaatgagtggagtttgatagtaattcttgctacaagtataacattactgcatgacagctttgtggagaaatgaaaacatttggaaaatagtgtgttcttctgcctttgtccgtgtttcttgctcaggcctcaggcacttggcctttgttttcacaccaacttgatgggttctactataagatgctaaaaaggtgggttgtgtgtggttcagattggttgatttgtaaccctagttgtgcataagaattgcccagatattttttttaaatgccagtgtccaggcatttttttttcaatccctatgattccagtgtgcagacaaggttgaaaatccctatttataatgctccctgttacaattgcttttcaactaagagatgtctgtacttttggtacctagatgatgtaagagccaggaaggtgcttgctgtttgggtttgaccaagtgtcactttttaataatctgccactcttggcagggagctcactcagtgggtttgatgtggtggatgctggctcgggaagttctgcgcatgcgtggcaccatttcccgtgaacacccatgggaggtcatgcctgatctgtacttctacagagatcctgaagaggtaagcttctccaaaggcttgtggttacataagcaaattggacgacttggactgtgcttctaggaagcaaaacttgtcagtccctgtaagtctttcctcttttttttttgtaacccagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactggtatgtatcaggatagaggtgaatcaagctgatattttgcaacttctcagttttattctaactttaatgatctctgtgacttttatactagctttaagaggttttcattccagtgtgctacagcatctgatagactgctgttgggagtggggtaaggaaaaatactacattgaggacagagctgatggctttttttggtattctcttaacagaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaagcccactgtagatagtgtatattgcttttcacttcagaatttccctgagcttccttcctgtgtggagaacatgtgtgctgtgaaaatagatgtaagtggttacacatacttagttggtaacctcaggaatacttttccgaggccctgatgatcttgcttttattaccatttgcgtaggtaagttctatagagcttaggtttttatttttgagagtcttcctgtcacttaggttaactattcctggaagccctggagaggcgatggtccttccccacattgagagacattaattgcccctcttgtcagcttgcctacaggttctgggagaggagaggtatgtatgtatttaaaaatgtgatgttctccatatttgtctttgccggggagggggttggggagacagtctttccctgttgcccaggctggagtacagtggcgtgatctcagttcactgcaacctctgcctcctgggttcaagcgattcttgtgcctcaggctccttcgtagctgggatttcaggtgtgcactgccacacctagctaatttttgtatttgtagtagagatggttctgccaggctggtctccaactcctggcctcatgtgacccgccccaaaatgctgggattacaggcctgagcctgaccatatttgttttttatgtattaatgctggtggcttcatcctaaacggatttcaagattttcattgcctattaaaaaaatactcgtggctgtcatgttggctcacccatgatcccagcactttgggaggcagaggcaaagcgattgcttgagctcaggagttcaggaccagcctgggcaatgtggtaaaaccccatctctctccaaaagatacaaaaaattggcagggtgtgatggcatactcctgtagtacctcagctacacaggagactgaggtgggagaatcacctgaggccaggagttggaggctgcagtgagctgtgattgagcccctgtatactctagcctgggtgacgaagtgaggccctgtctcaaaaagattatagagacatttccatagattggattgaatgcagattttgagatggcctgaactgatttacatggattcatacattctcttggaaaatttacaaaatacatgtacatgtgaccacattcctagggctccttccggtggtgctgaggcaatgggaacactgcaacctcaagcattgtcttcatgggaagcctgcttatggctgtaagcgaggctgggaaaatctgccctataatgtctccaagttgaatggcattcagtgagatttatggatcctgaagttgcaagtggttagcaatactggtagagattgctggaatcaggatggtgggaagcagggacagtttaccagaaggctactggccaacaggggagttggagaagcattgcgaggtggtgtgagcctggagtaaggtatactaagctcatttatgagcgggttctgggtggagtctgttcagcgaacagagaaccttggcatttctggacacttgaagatactgtggaaaacatccgttgtgactatccagcaacctccaggattaccccatcttactggggtcccatgcaaacccagcctctccatagacttgtgtcctagtgccaagcacctccaatcaggagaccttggtagcattctcaaagcagttccagaaagtctctttttctagattctgaggttagggaggaggtagtctcccttggcagggttcattcatgttcagctaagtggaagccagcaaatactagaggggatttctctcagacccactcagctggggttagccttccctggcaggccttaacctttttataaccttgtatatctgaaaataggatcctctccccaactccactcccctggccctgtacc

SEQ ID NO: 14815 - DNA, 11050 bp, Human
gccagaatgtgacttttaccctcttctgaagactttttctctccaattagtcggcattcattcattcgatcatcaaacactttccatgcccctactttgtgtaagccctggtggatgaaaacaggcactagccctgtccttgtggagcgacattctactggagatcaaccttgatggaataatctcacaatatatagaatcacaaagagaagtgctgtgaagaaaggcataggaaaccatgaaattgtatcccaggtatacatgacagagtctgaggattcaaaaagtcttccttcaagaagtgatgtttgaacccagatcagaagggagttgagaggcagctggggagggatggaggatgaagggaggatgatctggcaggggaatggcccagttctcaaccttggggcaaattggaatcatcttgagagcttttaaaaatatggatgcctagcacatgtatacatatgtaactaacctgcacattgtgcacatgtaccctaaaacttaaagtataataataataataataataaaatatgggtgcctgaccaggcgcggcagctcacacctgtaatcccagcactttgggaggccaagggagatggatcacttgaggtcaggagttcgagaccagcctggccaacagagtgaaaccctgtctctactaaaaacacaaaaattagccaaacctgatggcacgtgcctgtagtcccagctactcaggaggttgaggcaggagaatcacttgaacctgagaggcggaggttgcagtgagctgagattacaccactgcacttcaccctgggcgacagagtgaggctccgtctccaaaaaaaaaaaaaaaaaggatgccttatgctaaagtggtaaaaaaattttttttaataaataaataaaagtgtggatgctgcctaggttcagttcagttttcagaagtcttgatggaattggtctgaggtgtatcctgggtatcagagcctttaaaaaccaaggtactaccctcacagttcttccacattgctagggagtacactttctgatcatatcttttcaagacatgtcctcacttcttcagcaccaggggagggtaaatgggcagagcatatactaatgttctattttcttccagaagaaatgaaagaaacccacatccagaaattcctctgtaaagatcctacattggctgggtatggtggctcacgcctgtaatcccagcactttgggaggctgaggtgggcggattacttgaggtcaggagatcgagaccagcctggccaacatggcaaaaccccgtctctactaaaaatacaaaaattagcctggtgtggtggcacacacccgtaatcccagctacacaggaggctgaggcaggagactcacttgaacctgggaggcaaaggttgtagtgagccaagatcgtgccactgcactccagcctgggcaacagagcaagactccatctcaaaaaaaaaaaaaaattctatatataagaaaaacaaaagttttttaaaacaataaaagttaacagtcaataatatgtttgtcggcaagaagccctctgttaataatggtctaaacaaataggacattgtttttctccaataaagaaatccagaggcaggcagtagctggctttgattcagcctctgactgtcactgtcagggccccaggccccatgagcctttcgtctttcctgcatgttggcttatcttctcatgcttgtgacttcctggttgcaacacggctgctgcaacaccagacatcttgcctgtcttcaaggcaggaaggagggggaaactatcgcctaccagctatttttcttaccttagctcctccatgtcttggatcaaaagcatctctttgaacctctccctcaggcataccctgaaatgctgtggactttaaccttttttctgttgcaaaggtcgctcacatctccctggttgtttggtcttctcttccttggctctagtaacacagcagtctgttgcttcctaggacaacttataatgggacccaaaggggaaagaggatttcccgggcctccaggaagatgtctttgtggacccactatgaatgtgaataacccttcctacggggaatctgtgtatgggcccagttccccgcgagttcctgtggtaaggctttctgggagaagtctggggtggttatccgtgaggacctctcacctgatccttatggggctttgtaaaatcctttcagtaaaactaactttttttcacgactctgagtacaccctcattataggaaattggaaaatatgagaaaatcaagaggaaaaccaaattgtccatttgattgtgagtccattttggggtattttctttgtcttattaaaatctaacttttatatggttgagattatattgtataaaaatgtacttttggccgggcatggtggcttatgcctgtaatcccagcactttgggaggccaaggtgggtggattataaggtcaggagttcgagatcagcctggccgatacagtgaaaccccatctctactaaaaaatatatttaaaaaattagccgggcgcggtggtgcacgcctgttgtctcagctacttgggaggctgaggtgggagaatcgcttgaacccaggaggcggagattgcagtgagctgagatagcaccactgcactccagcctgggcaacagagcgagactccgtctcaaaaaaagttatactttgttatcttagttgaaatcctgccatgtttccacactctataaataacattttaaactttttattagggaaaatttcaaatacatataaaagcagaacaaatagtgtaatgaacccctgtgtacccttcacccaactttaataatgatcaactcatggcgagcctgtgtccttgttttctctttatgcctactcactcctgcccattctctgttgtattattttgaagtaaaccttggacatctgttcatcataatcatccatctagtgtggctgtgctacaatttacttaaccagtgttggtgtttaaccaacctattgcttattggccacccccaagctttttactaatgtaaataatgctgtaaagaatatctttgagtaggataattttaagaatcacttccagatgtcaaattacttgactatatgacattgccttttaacttaagtcttgggaacgttttaaatatttaaaaatgttaaatccgaggccgggcgcggtggctcatgcctgtaatcccagaactttgggaggccgaggtgggtggatcaccttgaggtcaggagctcgcaaccagcctggccaacatggcgaaaccctatctctactaaaaatacaaaagttagccaggcattgtggtgcacacctgtaatcccacctactcgagaggctgaggcaggagaattgcttgaacccgggaggcagaggttgcaatgagccgagatcacgctacttcactccagcctgggcaaccgcgtgagactccatctcaaaaaaaaaagaaaaaaaagttaaatccgagtgaatattttagtttcaaactcagacattaggaacttgattgagaaggtgagggaatcaagacactcctctcacttcagaaggaatgctagagtgtagtgtgcaaacccctcttcccactgttgagcagcccaaggatagagattctgtttcctcctccagcttttttcctgccccctgcagaagtgttttctggaatcctcaccagtgtgttctctggcagatttttgtggtcaacaaccaggaggagcttgagaggctgaacacccaaaacgccattgccttccgcagagaccagagatctctgtacttcaaggacagccttggctggctccccatccaggtacccccaggccattacctcaggacatactccctgcccaggagagagatgcatccattaaaggaagggaaggccaccccactgggcctggggagggctttctacagtctgtctgcatgggagggctgagcatcctccctcaaactctctctgagcagccctccattcccccaccctgactcccaaatagaagcccctctctgagccagggttccagatggtctccacatccctgcgtgccaggttgctgtcttgatctgacccaacatttaaccagctacagagctctgggcaacaggaaaggagtacctttcccacccctgggaggaagtcaaggcatgccccccagcagtgcctttggaccaaaaccaatgacctccctgcctgcggctgcctgggtatgccatgctccagttaatgctgtgtgcttctttggccagctgacccctttctaccctgtggattacactgcagaccagcacggcacctgtggggatgggctcctgcagcctggggaggagtgtgacgacggtaacagcgatgtgggtgacgactgcatccgtgagtgaggcccagaccaggaggacctgaggcctgaacagcaggggggtgggactcagggccagccctggacaccagctgtggtgctttgggacctttctagagccagagaagggtatacccaggccaccttgtgccacccaccccagtccctgctgccccagtttcagcccaaatattaactcttccaccacccaagcacctcaccaggggcggatgtcaaggatcctgcccccagttaggccttctttatctcaaaatgtagccaccaggtcctcccagtcctacatcttagcaaaacccatgttacaggtgcagaagataaaggtgatgggctctcactttgcatggagtagtgaaaggcaaaagggagaggccaagaatctgaatgagggctcatttaccaggtagagctctagtagcaaagccctccgtaggggaaactgggccagccagagctgctgtcagcctcgtgggctgctgccttaactggtaggcagcaggctctggagggcttgcttttgtttgtttttgtttttgtttttaatcaagtaacaaaaccaggaggtgtgatggaaagcaggagctttagagtcaacagaggttgaatgcaggccctgagaaacaccaaccaccctcaggctcaaggcagaggccacatggtgggtggggtaatggggggcaatttacagctctgagcctcactttccttgcctgtaaaatgggtatgatgtgctggctgctcaagtccctagagatcctgtgagctaacatgtgcagagattatctggatatagtaagggttcaaccaccattcactgaattcatttagggcttgtggtttaagcccctgctctaaagatccaggctggggctcagggctggatgtgtggatgcaaagtcatggtccttgctctcaagaagctcaggggaggctgggcacagtggctcatgcctgtaatctcaacactttgggaagctgaggttggaggatcacttgagcccaggagttcaagaccagcctgggcaacagagcaagacccaatctctacaaaaaaaaataaaaattaaaaaaattagccaggcctggtggtgcgcacttgtagtcccagctgcttaggagggtgaggtgggaggatgatttgagcccaggggttcaaggctgcagtgaactgcgattgcaccactgcactccaggctgggaaacagagcgagaccctgtctcaaaaaaaaaaaaaaaaaaaaaacagttcaggggaaggatgacagggcagagtgggtggcgggagatgctgctgactgtctcagtgtggccgaactgtctcccgacagctccagggatggcatcccctagaaggctggccctgcccagagtcccttctgcctctggtgcacagtgtcaaataggagctctcacagtaggaaggaactaatggactgtccctgccctgtgaaaacaacgctgggatccatactccaacaccctcccatcgtgtgagagcagaggtctttgctgaagatcatgtggctccccagggacacaaggctgggctcaccagtgtcacacagaagctctctgttgacagatgagagtcaccatgcaccctcactggggctcagcagtcttccaaccctcactcccgggacccccacactggctttatgaggtggaggtcatgtcagtgtcccagttttgcagataacaacctggagtctccccacccctcagctagtaagttgtgaggcggggctggagccaggatctccttcttcttgtcccatggcacatcgctgtgggaccagagcctgtgggcagtccctggaggagtgtgaagcttaatggaggtcagttctttaaggggtgcagcacttaggttggatcccttgggccgcatggtccttacaagctgaggcaagcctatcgcctctgctccttctcaagactgcacctccttatgtcccctcaggctgtcaccgtgcctactgtggagatggtcaccggcatgagggtgtggaggactgtgacggctctgactttggctacctgacatgcgagacctatctccctgggtagggatgactcccctccctccctctcccccttctttctccctccctcctctttgctttccttctttccttcacaaatattttgagtgcctctccactttgtggtgccttctagacactgaggtatggtgatgaatgacacaacacgtgctccctgcctaccacgtgccctcttggtcagcactgcctgcgtgccactgagactgagccacggcacccacagccacctgctccatccaaggcccagaggggagctgcggtctctgagctcagctgctgccctgcatgagcagcccccaaacccagtggtcaccatgactacatagtctcctgggctgtgggcctaggtgggaagcccagtggagagtaaaggtctcagggcatttccaagaatcgacatgtctacctaacctgacttccctggaacaccctgcccatccctcaggcatgcctgtgactgcaagtgagatcaaatcagccttaatatctaattttgcaagctcatggcccctccaagaaaatactccctccaaggacccctctagttatttctgagagtcctcagtggctatttatgttgttcaggacaagtattctagtgtcctggctccacactggcgcctgccaagccaactgagggccaccgccccatgaggtgctgattccatgcccagattgtaaccactgggctccttccaaggtgcagaaggtacatgtctccccagtccttacagaaccagagttgtacaacgttctcaggaaaatggggaggccgttcctttttacctaggccatgccctgctcttcactgggttccagagtggatctactggtgcttccgatctcttctgtccttgagtccagtcccttcagcttttgctcccatcccattttctcttgtagactcggacctgggcccttggcagggctggggagccatgcctgtctctccattgccttctctgtgctctctcttccaagggggtctccctaacactcagatattagcatgttcaaccaggctgggagaactacagacctgtagtctcccccagtctcccccagactctaagcccatttaggcttggccaggaccccactccatgtatgtgtctgtgtgcagtgcccctctccctgaaggaaggaagacccctgacaggcctctgccagagagttggctcttcatggctccacagagacaaatcaatgtagacgatcagatatggagtacaggatcgagtagagcccagggctcccccacgctcactgtggttacacagctattccccagaagcctcagagggacgcctgtgactgtgcctgtaaggtttaacgccctgtctcggatgatcatccgggcctacagaggtataaactgcactgtccaatatggtagcccccattcacaggctgctgttcaaatgtaaagtcattataagtaaacttaaaatgcagttactcaggccaggcactgtgactcacgcctgtaattccagaactttgggaggccaaggcgggcaggtcacctgaggttcagagttcggcaccaccctggccaacatggtgaaatcccacctctactaaaaatacaaaaattagctgagcttggtggcacgtgcctgtaatcccaggtactcaggaagctgaggcaggacaatcgcttgaacctgggaggcagaggctgcagtgagccgagatcacaccactgcactccagcctgggggacagagcgaaactctgtctcaaaaaaaaaaaaaaaatgcagttattcagtcacagtaactacatttcaagagctcaatagccacatctggccagtggcttcacagatacaggacatttttgttggtaggctgcatcgtagcaagggggattccctcacagatgctgtgctaagagcagggcaaccacctccttccacccaggccccgagctagacctcaaggcaaaaatcccagagacatgattcaactcccccaggcctctcactccaaatgagaatgggaaaaagttcttgtagagccattggcccttggccgctgtttgataaggtttgaccggaagtcaccagcatataagaggtggccttttagaacgtgtctttgcctccctcaggtcatatggagacctgcaatgcacccagtactgctacatcgactccacgccctgccgctacttcacctgagggccgtgaggagaaggtgggctgcgccccacagaactggcagcagcttctccactgtcatcaaactggccatgtcctggccccgtctccaccaacctttgtgtgacaaaaacaaggacaaattcctgctactaagacatgctgttaactcagtctgactggaagaatttaggaccactgcatcctgtcttaatccaaggtactggaaaaccttccacatgcccaacctgagacctgttccccatcgctaccatttggccaaacaaccggctacaatgctcttcctcttctggaatgttgctgacccaggccgtggacttggctgagcactgttagacacacatagacctgcaggctgttttagtatgttttgatctctttggggaatctggagtacaggcctctccgcccctgaccaccgaaacgtgcaggcattctcactcacactgggcagcccgctgtcgggtctctctaggcctatgaaccacaaagcagggaagtgggcacgttctctcggggtggctcacagctttgaacctgccaaaggacccctcgactggccacagcccagcccagcctgacgtggatgtggctgcccaggaaaagacttaactgtgaaaaagtactgagaacccacctgacccaggcttgccccaagcagaggctagagaagaggctcctcttctcagtgtttcccaaaggggcggctcttgtggtttcaaaatctctggcaccatcttgacctcttggctctctctgcactttgccccctgtctcaaaaatgtccctcatgtccatttcctgtccaggagactcatgaggactgtgtgacctgcacaagcccacacctgggcaggctgttggtgtctccttggtccttaggcagatactcccctgagtccccgatctagggccagctgcagagggctctctctaggcagagcgttcctggccagagctctacctctttgcctcctgctgacccctgacagcgtcccgtggcatttctttcatgtctgcatattgcatagccttgtcctcctgtgtgcctgagctcctcccttttcaataagattattagtcgtgcatgtctgtgagctgcctttcatcaccatttttcctgagtagggcttagttttattctggaaagacatctccaaggtgaggtccacccccacagcagacctcaagtagaaattgcccaatttttaccagctggagggacacccttgggtttttgtacgaagctatttaatgagcctgtgtcttggggactcagcaggctggagcttggggcctggtggaccatcacctggtgtctgtaggtggacccggtctcccacaggtgacatcaacctgagggtggcgtctttagagacaggcacatgggcagccctgttcccttcgcctctactgcgaggcctggggagatgttgttttcatgctgcttccaccatcacactggggtttctggatgggaaataaaaaaataaaggcagttcatttccccactgtggctctctcttccgttggtggtgggggtggggccggtgtctcagcattgccagatggagggaggagtctaaattcaaatctgcttcccaaactctgtggagggttctacaatgtggaagcattccagttccctcaggcacaagggaggaaacagatccagagatgtcatggacttgcccaaggtcaaaaaacccagtcttgctaggccagccctgtcctcagccctagttttaggaccttgtttaggatggaatggaggtctagtactactcctggatctggccaagagaggccctgtcctgggtcccaaggctggagggccctaccctggccctcctctggccattaccctccccacagggtgaggtctctatgtggccaaagtaacatacccgctggagcttgcaagccccactcctagaccatgctccaggtacctgggaaaccacagttccccacccaagtggtcttgagcctgcttcctagacctgcaggcctcttgcccatgtctgtcctcctgagtgtgacctgaaacacatgcaggcctgggggtggccagcaaaaagttgtttgtaggaattatagatggggcttggaatgtgggctgggatttcctcatggacacacatgaagcccttcttagtgtgggatgggccaggggtaaaaacagaaggggatctggcaaggggctggaccctcctctcctcttgctaccacaggactttgtggaatctaaaattccaaattcaaacctggccttccattctttatgaaagtatcctttttgagggaagcagatagaacatattgaatcatttaattgggagtggtggcatgtgcctatagtcccagctatttg

SEQ ID NO: 14816 - DNA, 45086 bp, Human
cttaagggaatcatattaataagccaaaaaaagcacttaatcgttattttaaaaaataaagacatatcaaaattgttcaacacagttatttgtatccataggtaaaatattttctcctataatcttttttatattttaatatgcttagcagatgatttttctctagttagtgcaagataactataccacttcctttctgaatgatgtaaattagctaaggagggtgaaaaggtgtagacatttgagtaactcctctgtgccaggtaggaggcttttaaacattttctcttgtttcattatcttaataatcttgtgaagtgagtcttactattttccctttataaatggagaaactgagacagagagggccccaaagcactttgttaaaggatgcctatctgagtttgcctgatttgaaagagtaatactctaccatatcagagtttccttaaatatggtcctcagattctctgtatcagaatctcctggaatttttgttaatactgcagattcctcggcccccagtggtgggacctgggctgctgcatttctgacaaactactgagtgtgccttatgccctctgaggtctgggagccaggcttccatggtgacctcattttggtgatgcaaggaaccttgccagagagtgccctcatgcctcccacgacgagtaatcctcatcatgcctcactcccagtgggcactctgccggctcatctgggctgcttcctccttactcacccacttgccttgcctcgcctcatattacttgtgctgaactcagcatggctcatggtttgacaagtcacttccaaaagagttgagatcgtcacactccctaggaatcactttgaaaaacaggttgaaatctccggtgcagcatcaccagatcccaagcatctcttgtgtgctttatacagatagaatctgtattttgcattctaactcctgcccaaagaaaaaaatcaaaagaggcaacagcttgcagaaatgattacttttgaaacaccagtgtacgctttattttcctttctcgcctgtctttcgcacccttccctggtggtagatttcccataagtctgcccccaattgctcctgacttccctagaattgaggagatcacttgtcccttccagctccagccctcccactaaggacagggttttggaagagccagctggattcaatgaccacctttgcctttctttctccattattatctttttctttcagctttgtgcaatttttctttttcactcccaaatgacatgctttccctcctgagggctaatcctgctccattcctttccaacaagctgtgagtaggaggttgcttggatgactggcagacgttgagacagacatgtgctgatgatccagaggggaccctagagcaacttggatttgtgttcatttgttagcattctgtgttggcaaaagagcatccgtctttgttttggtattgagctcatccaaataaagaaagcatttcctcttccgaaaggcagaggaaaaaaaaagaaaagaccaaaaaaatttttttaattttaaccatgtactcctttgaaactaaatatataccctttcctctgtcctgattggtccgtttcaattgacaagtggatcgtgtggaaaggaaataacctggacttaattgtaagttaagtctctcttaatccagaagagcatttgagattctgtccaagtgttcaatttcccaggccgctgaggtctgtgaatttcttttcccagcctccaggctgctgcagtacaagtcagcatagctaatgcagatagatctcctgcctctcgctctcctcctccctctgctttgattcgatatgaacagcctggtaactccgatgctggggagaaatctgacataactctgcagatggctaggttgccatggaacacctggggattgttctttaaggaaaaggtaacatttatatgctaatgatttcttcccccctcccctccttgttgcattttttccagggctgccagttcccaagaagagcccaaagtcggtaaggacttgtcagttacttggtgcttgttggggctggggtggatggtggggggctggaggtgggagggtactctgtgtggcttcacttcactaaatgtgttttacagtggatgggggagacaggagccggggctcattttcttaagttctggggatctgtttgttatacaaggtatttgggcttgtctttaactgtatagtgatttgtgggcaggctgcaggagccaggataaagaatgcatgtttgaaatcttctctatacaaatgcatccacactctccttcaaagggatgagtttcttagccgttttcacttgatacaaatgctattgtttcctttggaaggagagaaaaaaagaaagctccacctgctccgtgagtagcattgctctcaactggtgttcccagccgttcacatgtctacccattctctcccttagctttcttaggcgccggaggatgaattatttacaaaataaaaagcctgtaggtttaaggaagaattgctttgccccatatatgtgaccatgctcagatggaacaatgttcactgccccagcactgagaataggacatttccttgctgtagaaatgtcctttgttgttttgccagctttagcagcattatgctgcaggtataggattcttaaaaaaaaaaaaaaaaaaaaaaatcaatgttttgctgtcctttccaatctggtttccctgaagatgcattacctagttgacatgttagctaatagcttagaggctatagtgttttgcttggtggtatgggtttatgctcccggggcactaatgacaaattaaaatgctgcttaactcaacatctggaactccagtgcctgtgaaattgatctgggtggaaggggcttcccaattcattaacattaggataaagagggatgtttccatgtggtttagaagatttgggggagggaaaatgtacagcctcgtgccatccaggaagggagaaccttgaaaactttgcggcttacggcgctgcagctgaattctttccacctgtctccaagcctggcagcatgaggcagaagtttattaaggagatgagagagggagcttcctgcattttaaacctcactcctaagttctccaaagagaaaaacctgcaataattgatgtgattccgatggcatagtgccgtggtgattggaactttgacttcagggctggtttccttgtcagtgtgtgttaacgtccaggcagaaaagtgctggttggtgcccacattggaaccacaaagatgccaaagtgtgtgcatgtgcgcatgtgtgtctccctgtcccttggtcatagccagtaacccatccgccttcagagaaatggaaggaaatccagaagatgtgtctcataagcttgagttagcacgaaccctccttttttctccccaaccccagccatgctatgttgatacatgggcttattttacacaccctacatggaatggagtcttaacaaggagtgtgctgagggagacatagtagttttgcacaggtagcatgacgtcaagtagcaaggtgttcttttccattttgcattccatttaaatttagtgtgcaaaggatttttgtaattcatttgcatttctgtttcccccaagtgttttggaattacctggtgaacccaaaggctatcaaataggtattgaacctgcattcaccaagtcagttaagagaattccctatgacagttaatttttgcagaagccatatcattagcaagcagcaagccaattacttgggctgcattcctaagaaagaagctctcaactgctttacccatagtctgctggttcttaattaccacaagctaagagagtgatgtgttgctgggttagaaaataataagcccccagcttggggcttgtccttacctgatttctgtgccaggacagggttgagggttttcacagcattgctggcacacactggcagttgctgtacaaaatttgggagctgtcggccaagggctgctgttggatgtaaagtgctgctaacatctgtgatcagtgagagttctgtacaggtggcttgaaagtggtttccctttcccagtttgaattttgatgatgtcctgccagggagacagatgattatgggatttttctggtggggtcagagggaattcacagggaagctggatgtcctggtaccagaaagccattcaagtaatgacacataaggtcaattatgcaggatgcataattaaaagcacactgattgtacctgggttgtgactcacttagatttggcaatagctctgtgcatatgtgcacagtggtcttagctcaggaccattgtgttgtggttgttttgtttattttattagaggctcctgacaatgttggcttgctcatgtgattggcagcttccttttgccctcataccttttttttttcttaaggttttcaataattaagtagttgagtttttattagaacagaaggacttatctttttttatcttgtttcttctcctggatagtccctgtagcttactcttaataagcaatttcaccttcaagatttagtttaaatgttgaaattgtggtttatatactcattggggacaatggcagtatcttaataaaaatttattaatttaatacctggactttcataacatcagggatttttctgccaaatagcagagacaaaaacaagacatattttctgtcaggttttagacctctctgggaaactgattctgtggcccaacttaatcatcctgactgaaaactcatttcactgagactctcagtctaaatcacccacaaggatgttgtgtatgagaatttaaaactaaatatcacaccaaaccctgaattttaagtcagtatccaccgttttcgtatgaattcatttcccaactcttctcccttaatctgtcccctctttttttttgagatgaggtctcactttgtcatcaaggctgagtgcagtggcacagtcatagctcactgcagcctcgaacttctgggcccaagcaatctcttgccttagccttccaagtagctgggactgtaggtatgcaccaccatgcctggctaatttttatattttttgtagaggcgggagtctcaccatcttgcccaggctggtctcaagtgctcctcctatcttggcctcccaatgtgctgggattacagtcatgtgccaccacacctagctatcgtcttctatttatccatctgttgctccacctacatattcatctttcatccattcattcatccattattcagaaaactagtatttagaacccattaaataacaggtttggtgtgaagcactggaaatactataataaataaggtggtcatggcacctctcttcttgcagtttgcaaacaaaccgtgtattgattgctccttgcaaaaaaaaaaagattaattgccacaaatttccaaaatgtttatgcagtcatttcatcaataagtatttattattttatgtgtgccagacccagtgccaatattggataagaattaatcagaaaacatccctgccctcatggaaatggggagggagaaataataaccacattaacaggcagatctacaaagatcctcacctcatagggattaaagtgtgatgagcattaataaagcagaaatataacatggaagcaagtacgcacataatgtaatcattccactcttaattataataacttataagtcatcataaaatgccaacacccacgattgaataagtgctgtgattgagctgtggagtactttggagttccccagcagcctaggcaacataggaaaccacattctttacttagctattattgtcagatgaaagaaagtgtaccatattcactaaagagacaagagtttcctgttcactaaaaaaaaaaaaaaatcctacaaaaagtttttatatagaggaccctggatggtgggcaaagcatccagtgcccatccgcattgaagaagcagtctcttcaacagcctctttagagcagacatagcaagctgtcggcagggtagccacagtgataggtttttgttccactatcctctctgtccctttcccctgcaagagatgctaaaggaaattgctgaaaactagtcattaagagatgtgagggagagactccttttacacacacacactaagtgaccctggcctagatcattccgttttatgtaccctgcctctttctcagactcacacagttgtgtggcacctgtcttccttttccctgatgccacttgtgtgacaaccagcatgatgattgatcccatcaaagcttctacagcctacaagaagaaacagtgagagtagtagatgggtgaagccataggatcacttcagtcagtctccttgcctctcacttcccgtggcaactccccttctctgccttttggagccctggaagatggactttgccattgtattacattcctttaaaacatgcaatgtgaaccagaacccattttcatatccagtcagtgcctgccttttcttctgcattaactcctctcgcccacctttttggaagaaatcgtttgacttagacccataaatgataaaagaaacaaacaaaaggaatgaccatcctctgcactggcttggattcgagtctctgattttcacacaccctttaatgacgttggcctaatacctcatcagcacttggagtttttcctgttgtccatgtaaatcgctgcagtagccttcgctcttggcagataagtgaactgtaaataattttgctttaaaatggatcaatttgtcatttttaagccacatgaattcttttcatcatttaagctcctaagtgctgtctgtattcatttgctcttccaagcaaatattttcagttcactttctaagtacctacattttgaaatcattctgggaaatactgatgagttgatttttttcgcatttccatttataaaaaccattatgtcttcccagtttccctggcctgacagtaagtaagggaatcattcatttcagagaggttggtacagttttagttttagtttaaaaggtcttgtgatacaggttcatggccaacatgtggccaaagacctttatggaatttttttaattgagcccatttccatattcctagttggctatgaattgagactcagcaataagactcttgcttcaaaaatatcagcataatgacaacaattagcattggaaattcctatcttaatatgtggcaccccttctcaaccagttactcacagtagagatgtggtgcatggatatccttgtttctaagctctcctccttttggtgatcctcttcacctcccttctctcctgtcccctccatcctcctgctcctaagcctcctccattcagtctgtcagcaatccctgttgaatttggcaacaaagtgtcttctgacctcacttgttcttttcctgggtaactccagctaccctggtgttgcccacctcaggtccccacattgactgcacctggggcttcctgactggcctctccgcattcactcctcttccccaccaatccattcaccacccagtagcgacaccaaactttctggaaacatgttggctcttggaacatccccacttgaaattcattaatggattccccctcttgaaactaagaatgaaacccaaactccttacgtagcccacagggctcatgcgttatgtggcctcccagttcctctcaggccaccctcccttgctgtgtcacattagcttttttgttcttcagaaagtccacttagcacaccctctttttttttttttttttttttgagatggagtctcgctctgtcacccaggctggagtgcagtagtgtgatctcagctcactggaagctccacctttccaagcgattctcgtgcatcagcctcccaagtagctgggattacaggtgcatgccaccacacctgggtaatttttgtatttttagtagagatggagtttcaccatgttggccaggctggtttcgaactcctgacctcaagggatttgtgttcctcggcctcccaaagtgctgggattacatgtgtgagccatcatgcccagccttctctttctgttagtagggttcttccagagtcctctctttaccacctttctaaaggacattgcagtgtgttgctatcaatagattatattttattaatattcatctacacacactatgtatacacacacttagatacattcccagggataaatttcaagagctcaggtaccatctattccttatttacatgttgtttccctcagtatctggcacacagcaggtgatcctatgtatttattgggttaagtgaataaatctattgcaggtagggcagcacacttaggagggcctgggctggatgttatatcatttgtgtactaggtttttccatttttccatgttcttagtatgcacagggtttcgttaacagacttaaaagtatacttttaactacagctacttgtctttgggctagtgtctcacctaggaaaatgaggtgaaatacaattgcattaaatgcaaatctgctcctgtgtcataaatagttcagaagtgaacgtattctcatgcccctagtcttctgggaggtgatccagactgctgaaaatgcacacaagttgactttaatttgggagatatataaacatggtttttctcctggacagttctgggctctaaccagataaaggacaacctcatagctaattagaatgctaacagaaaataaaaaaaaaattactttgaactcccctcacacccacagcatagttttaaaaaatccagagtgcccacaagatattaaattacagaatatgtcttcaaattaatgagttttcataattgaacttgagaaggaacatagaatgaggttaagtcttagcagggagaacatccaaaaagcttccagattattgtgtatttagcccactggtgtgccatttatatatgccagttagagatagttgagtggtggcacagtttttagagcatattctcaggatgctcctttacttttattttccagtttgaggtataaagtttagatggcatttaaaggagactcagaggtgcagtttgaccgagaggcagttttgcaaactcattccagattgtgtctgtcatttggtgttaaattggacctaaatgagtcatttattggggaggtgagaaagggtgttataatttgaaaaatggcccaagcatttccagtagacttcatttgcactctctatttctggtggaaccatctcttcagttaaatgtaagagatctaggttcttccatgtcagggatttcttatactgggacagacatgagagggtttcaaaaacccatgacgtgacatgctgaatctctgcacatgcatgtacaggtatgtatgtaaaagcacatacgcattttctctgggagacaggtccagtacttttatcagactttctcagtgggtcagggatgccagaaggatatttctctccagttcaggaagaagaatcaagtggaaaaggtttgagttaggcttcaggaggtaatggcccaagaagacaatggaacagaaactgccaataaccctacaaaagaagcagcagcacaaggctgtttcctgcaggtaatcctgcagtgtgcacacctttgtgaagcgtaatttcaacacgatgagaccagagcttccagggtcagaatttagtgcttataggccgaccctggaatcaatctggcatctattaatttgaggaaccaaaagagagtggtcctttgaagggaggcatgccactctcagggtaaatgcagaggtcttttactgagttttttgcttttacatttaaaatatctttccccttcagaggtgaacaaaagtaaaacattactaaaatgtaaaaaaataggaagtagcagttcccgttaattctatttaccaaggttcattttgaaatgaaaatgactttaaattttgtcttgattataaaaagtattctctatgcaccataaaagtaaaaaaggtaggtaatatgggaaagtataatgataagagggaaaaactccacccataatcccattttttctatgtgttgttatgtaggttcacacaaaaaaagggctgatactgtacatggttgtttataatcaagacccttgtaaagaccacattgaagagggggggaaaaaaagcaactgtcccatgtgcatgcaaaagaaaatgagtatggtatccatcatttacattttctcactctggccctgggagctgaattcactgttggaggagaaactgttgaagttggcagagccaggttctatcaactctggaatggcaaccaaatctgagctgagcacttgatcctcaaaagagaaaaatggtgacgtgggattatgatggtgtttgttcccacccaaacatcagcgtgttttcctggcatctgcaacagtgtatgtttttccccttgaattgaagtgaattaagcctctcatacagttttcccaagacctccaggataggttagaatatggtcctcaaatttctcctgcaggcacatcaagtataattttaaacagtctaccttgccttcattgaatgcatgtccaattgttctcaattttgaatccttgccaatacctgcattcaaatctgtaatagtcaagagcagatgaagtttttgtcctccttgggctttcttcagatacttgtttcaaagcaattactggaaggagaggaagtatagggacctgagaattaaatgaagggaccttgcaaatttccagcagaattccaggggaatgaaagatgaaggatactcggggagacagcaaggaagaatggccttgataggattgatcggaacacctggtggaagatttgggctctataaagaacttcagggatctagaatgatcaaggtcaaagctcttataaagtactttaaaaccacgagctctacaggatctataaaagagaatggagagccctttcctgtcctctaccccatacaatgctttaaatcagctaagtatagtgacatggtgtctatggtatatgaggcatgactgcaggattttttgttttgaatagggaatgctaaacacctgagattaccacagtcttttattggagaaaataagaactacagttattttctgttctacccactattttcctttccattaggtcttactctccattcattccccattctaacagagctttttgtaaaatgagaagggtctttgctgagcagattttaatgaacaaggacttggttattcaactgaaatttaaatggaactcttcccctttgaatattataatacttggactttggagaagttgcagatctaagaaggctggcccccagaggtcaactcatatacaaagtttgatcttggttttcaaccaacagtactatcggcagtttaagaggtgaagtgtaatgcttgccaaattgattagctaagaattatggaagttcttcatatattagtaatttctacacctagaaataccagtaaacatataatactaggcatgatttttaaaagatctgacctccttttttttaatagtcgaaaagaatggatagcaaactcttagagaggaattgggtattttattattaaaaggtacaagacatggagtcctgaggagcatctttagccctgattatatttcttctggatattatagccttatcctaaaccactcatggtatttggtgtcacatatttttgtgaaaatgaaaatgttaaaactgatccatcttgcagtaaacgagcatagcgtcttagctgagaacctgtgatgaatatcagatttgttttccgctgtagcccagagagcagtatgggttatgattatgtcttcctatctggcccacccctctgtttgtctgccagtcacctggggatttatctacattcagcattagctggagaaaggtgggagccaaaatactgttgatatgtatgtgtatgcaaaagtgctaaacaaagacaagctggtggaaagcacccattcagagaaccaataataatcttttcttcttgcccctctcacttgcttactttcagcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacgtgagtagcatcctggcctctgtcttaccctgacccctccgcagggctctacctttctcttgaaggttattgaaaatagatgagttgcagtgtgtaaactgggtaaagtgaaatccgcaagatgcaaaagtatcacagagggagtggactctgctggctattcatggagtctccactatgccttcactttggggagggggtagaagtggatggttatcacataaatgccctgggtaaaaatgggttttttcgtcccttcagttaaaaggaatggtagataagagctgctgtctcattaattctccgagtggagattgtgatgtgctctgagcacaaatctgatatgcaacagaacttaaacatgtttgactgggattttgggctaatgagaagaaattaaatgctttttaagtggtctcttgatttttaaaaatactggtaattttttttaaccattataatctctctaaacattccccatgaaaaggaaaaaaccatagcagtgagtggttgtgctttaattacttatccagtgctttaccttttctataaatatgagccagtgatagtatactttgtaacttcttggcttgtataaacataatatcaccctcatgtttaacgtctttttattatgaaatgatttccaaaaactattcaccataaataatattcatttatcttaccaatgaaagttcctaaaaatgccttaattttaggcgatgcaaattgattgttgttgttgggtggctgttttctgatgttttcttataatggtcagggtgaggcagctatgaaggacagatacctcattttctctttttggtatggggtaggagagaggtgttgtgatggtggagattcggtttgttgaagggtctgggagaagctggaagagtgaagggaatcattttgctcatcctcccctcagcacaggtttcattcctagctgcaaatgtggtcactgctcagcagggtccccatcgagagtcgtggcagagaggttgtgtgaggtgtgggtccccggcctcccgtccaccacacagacttggccatgctgtgcttcctttgccggccgaggtgcatgctgaaagtcgactcctctgtgacccaagcaaaatggggcagtgaggccagcatccttgtctgaggaggaaagttggtcagtccactgaatgatgctcagcagttggggggcagaggtgagcctggagtcttgctggttatcaaatgttaggagtcactcagggcttcatccttttcctcctcaagggagaaatattactgccttcttggtaccacaatgcatggaattaaataggctgttttggctacaagttcactctgctgacaaaaagcccactaatttgagcagggacttatttagtcgctggactagaaagacacccctaaagtacccctgaggcctgactaaaggaaatgaagttccatttggaatgacctcatatgcagtggatgctaaccaggaaccaggttctgtcctcattgtgtctcctcgctcactgtagtgatttcactgaagaaaaccatttaagagatatttccaaagaggagcgttttcacattccccgcgcatttctctctgagcttgtggctcgtccagtcaatggcccaacttcagttaatgttgagatattgctttattgaccgaactcctgctctcctcaatacagtacacatttatgattgagttttcctgtatgaatctttttgtgataaaatgaattgcattctgaagggctggcgggggcgtcctgggttgacaggacaattgtaaaacatccgtttaatagaaggctcttgctcaaatgccatttttaccctggtggcggcaaattttcttaagaatttgacttaatcaaatgtgtctaaaaagttttcactaggaaaaaaaaattaggaaaatatgtaatgtggccatagccagctactgtaagtactgaagttgctcaggtggcagccggactgaaatattcggggccaggcgccacggctcagtcatataatcccagcactttgggaggctgaggcgggcggatcacgaagtcaggagttggagaccagcctggccaatatggtgaaaccccgtctctgctaaaaaatacaaaaattagccgggtgtggtggcgtgcgcctgtagtcccagctactcgggaggctgaggcaggaggcatcactggaacctgggaggcggagcttgcagtgagccgagatcatgccacttgcactccagcctgggcgacagagcgagactgtctcaaaaaaaaaaaaaaaaaaaaaaaaaaattcggaatggtgccagttttgttccttcactttctttaacatctaaggaatcggatagagcagcacaaatgagaacctgttcctttttggtaattggagtctctgtagttgacggatagatagtagcaacctaattgatgttaacattcacatggatttcttcctcactactaaatgaggataatgatgagacctccccctggcccccatggtaattattcagtatctgtcacagattttcttattttcacagcacctaggaatgatcgtgcatcaatctcgtctttgaagcagtatttttctttatctgagatcagtttctgccattctcttaggttgttttgtatcttgtctttcaaagagaaaaaagtgtatagccttgttagatgtgattccctgccccctccccccaagacagtaaaatgagcagagtaatccaggaaaaacaggaaaattgaagtcagcaacagcagcttaactgtgccatattaccctctttttgttggaaatacatttttctttttcttttcttttattaggggcaatgtggagattaacacaatctgtgaacgcattccttcacatggtctaaatgtgttgcaatgtaccatatttttgatatggccatctctcaaggcagcagtattagaatgaatcagtctgaattacaaatgtgttcatgaatccttttgaagggtttcaatgtttaattaaaaacaaagacgagcactgaagtcctttaaaagccatgttgcctgttttatggtttctctagaattgtgcacatcttaaaaacgacagcgatgcagtgttattagtaaatgtttaggaaaatcagatcctatccagtagcatttactacaaaagaaattataaggcttatagttgaaactttgcctgttcactatatagtttggaaagaaaaaactgaaaactgtcctattaaccaacattgtaaatctgtcctgccttggagagacatgcttacaagtttggaagtggcgattgagcttctttatcatagtgagcttaagaagcttggatatacctccagattttaagagcaattatgagtttgtatttgtgtgtttgttcagttctcggatagatccattgatctgcatctctaaatataagactattcgggcttgaaatgcttagaattcacctgaacagatattagtacaagaatgaatttcatcctggacttgatacacttttgaataaatgctgtagtatagtggtagcacaaatatacttaaatttttcaaaaagcaataaggttttagacaaaccatgattgaagtaaggccattcaagaatgtgtactttagaatgtcattaaataaggagagtttaagatagtaataggagttataggaaactctcagtggtgcaattgtaaattctaccttttttacaagtaaagcactgtaaaaaaaaaaaagaaagaaaaaatggaatcaaactatagtcttttaacataacagccatgacctttattgtgaaagctgaactgactgttccttatcaatcaaaactaaattaaagtgaactaagagaaagaatgtacattaagctttgcaaaattgtgaaattaatattccagctatgtcaccttcacctgcgtcgggattgagcaagggtgagagagagagagaaatcaattccacgaattttggagaatgtccgagtaaggatccgctgaaaacttttgtctctccgttttcattcatcttgtttgatgttctcattggtctgggggcctggggagaagttcagaaaagagagggaagaaaaaaggggcatgaagggaagtgctttggagctcttgttgaccaaacgcaaaccaaagacaagatggaataaaaagggttttgcatgcccttgtcaagtctggaaatgtgttagtttgtctgtagtaatggagacaccaggcagtttctttgcaaatctggtgggtccattctttctaattatcaaaggaagtcttttgactgctttattgaattgtcactggcattacccaaaggagactaactgcagaaactgttcatatgcaggggcttacaaatgaaaattggacaaggttttcttagctctatttgatttagcctcactcaaaaaaagtgatattaatattgggaaaatggttctaccttactgccgcctaaaaacttaattctaataaaatctgcctgaagtaaggaagaaaaccattttgggggaagtagtttagaaacttcaatgcctctaagaagaggtggcctcagaggacacagaagagagaaattttataatcccataatgtgtttcagtactgatttattgccaaagttataaattggggtaaatggcatttagttggtagaagagtagaattcttaaaataccaaaattaaagtagcaagactttctttgtaacgtgtctgtgtgtcgacgtttatgtctgtgttttctggctcactcttgtgtctttaacatccctagtgtcagtgggcatcttccttttcaacagaaaacctttaaataaatttgccatttaccactgattctcagaaggaaacgaagcttttttttttttttccatgtggcctaaacggtgtgataagcctaaatctgttggccacaacctcccataccatgctagctcacacctaaatgagcaacagtaggcagaaacttgttacatttggtgtcactgtaggatgggcaaatgttctggtgttaaatgatgctgagaaaaatgggtctgggctggaagtctctgcagaggccctttcgttgttcccagaaaagccacacactcagcagacctaaaacagactctgccaggagcccagtgctggctggaaagcaccagtggtctatttcagtaataatcctcttgcttgagtgactcaaagacggagacacaacttgatttaatttgttgtttcattgaggctattacagcaaatatcctttagccagctactcgaacagaaagaaaatattgttaccttagcgtgctcaagaaaatattactctcaaattgtgtttatgggagtcctgtgcagtagcttagctccatgttctgggtgttttgcagcttagcctcagcaattataataaaagcagtggatagaaagcacccatttacagccctggcactgagatagctcaagtaaaaagatcagattcaaactcctctgacttgtacttactggtcacttggtttcttctctgttggtgtattcattcactatacattttaagtttgtgggtgaatcactaaaaagggacatctcttcgccaacctaaaatctaaacatccaccttcttcttccctattccattgtacaaaactggagaagaaaagaattaaattctcaggcctgcgctttccttcagccccaaatccagttaattaaataagaaggtatgcactatagcatttgaaaatctcctttaggattcactgcaactgaaatatatattttttctctttaaaaaaatgatatatcattttataggtcataaaacaccctatgtatacattaaaatattacgtaagaattaaatagaaataactcttttactttagtgaagtaacagagtggtgtatagaacaatttcatgtatagtaagtattttcttatggaaattgcatttgttttaaaaaacaagatattcattttaaagccctggaccattgctgagtattgaaagtaaaatatcaggttactggaaaatgaattaatacttttaatgctgaaatatcataggcaaattctagagtaaagcagtcattttggcaatgagatatatgattcattaacatagactttttgtcatcaccattgatcttaaggatttggaggcctggctgattttggtaatagtattgaaatcctaataaaatttgtacagtcacccctcagtgtctgctggggattggtttcaggacacccgcatcccccaccaaggatataaaaatccatggatgcttaaatccctagaaaatagcctaatatttgtgtgtaacacacacacacacacacacacacacaccccttcctatattatttatttgtttgtttgttgtttgtttatttatttgagacagggtcttactctgtcacccaggctggagtgcactggggcaatcatggctcactgcagtctcaacctccctggctcaagtgattctcccacctcagctcccgaatagctaggagtacaggcacacaccaccatacctggctcattttttattttttgtagagacaaggtctcactatgttgcccagacttgaatgcctgggctcaagcgattcgcctgccttggcctcccaaagtgctgggagtgccactgtgagccactgcaccccacctcctatatactttaaatcatctctacattacttatgacatctaatacaatgcaaatgccatgtaaatagttgtgatactgtattacttagggaataacgagaagaaaaaaatctgtacgtattcatcacagctaaaaccattgtaggtctaacaaattttctatctgtgattggttgaatctaaggatgcagaacccacagatatggaggactgactgtatgcagaaatactaggatgttttagagtaatttttggcaaaaatgatctaacaaagcctattagcattgctagccttaattattttaaggaagaagaaagtgacttaaagataaatcagaaagtctgtttaaaccaagctgttctctttcatcctctagtagaggaaacatctggtgacttaacatgacttccgaatccttagatctggcttcagaggtgactctgacttagcctgagtgttcttggacatggacacctgctttgtggtgtggcacataataattttaatttacttaattctccttgcaagaatactgaggaaagcagttaatgctgactatttgtagttaaggatcatggcttgggcttgattcggaattatcaaacagtgatgggtcctgtgaagaactttagggctcagtgactattcccactgtttatccccgtgtcttccattatttcacctgttcagagtattttgtttctttgcctatattgaaaatcttccatctgatcaagcaccaccattcttgtcctgcaactgtgttcatcttgggggtatcattgcttttatcagtaaaataatccttctcttttttctcccctctctgcagttccagattaccaggaacaggacatcttcctctggagaaaagagactggatttggatttaggattctgggtggaaatgaaccaggggaacctgtgagtcttttgcttgtctctcttcccagcatatttttctaaggcttcaaagcaaattggcgacagtgacaaatcaccaagatttaagtccagctagatgcaacactgactctttaatcttgagtagtgtgggtttctcattgggttttgtggagctctctttgtcttgaggaagaagagactagattctttctaaaaagtttgtatgagtgtttgtgaaaggtgggagctgcctctgtagaccaccccttttcccccaagggagatgaaaacagaaagcaaaacaggaataggcatcacctaatatcacagtggcctggtccttctggccaggtcccttcactctgccagcaggtagtaggctttgtatgttgagttgctggtgtgcagagagtacttcgcaaagccttatgagacagtgattggagaatgtcagacccctgcctttacaaaacttgagaaagaaccctgagtaagggtcaagaaacattgaacttccctgggcctcagtgtcctccattttggaataaatttagaataacataacagggttcctttgaaggaagaaaagaaaactgaaataggtatcgttaatttccttgtggtaataacagccattattcatcgagcgcttactatgtgccaggttctgtgctaaaggctcttaacatacattctctcatttatccgtcaaacccaccagtttatcccgttttcacatcaaggaaaagaaaggctaactaacttgcccaagatcgcagagctaccaaatggagggactgacaaataaggtctgactcgagttcatgttcttagcaactattttgtcaaagttctttgtaaactataaatgccacgtaaaggtagctatagcattattgtctgctggaaaggcaaggcaggcacaaatattttagctaaggtttagtgaatggcaaatataacagcaagacactaactataaagagtgctctgctttcgggtgctaaaagacttcaaaaatggagatgtccaaccaacttttgcttcattcattcatttaagagtatttattacagattccctattcctaggcatgatgctagacccgtaaataaaagtaatattaatattttaattagcagagttttatggaaagagagtttttaggtagctaccaaagaagaatagggtatacaatgaagggagaaaagtaatttatatctgcaaaggggaaaaagagagtgagtcatcaataggccacagataaacatctggaaactaagcaagaaatactctttccaccatttaagaattgttgcagtgcttagcacaatgtcttgtacacagtgggtgctcaataaatgtttgcggcatgcctgcagacatgaatgaatgaattgttcccagagatgtgaaggctattgatgtaacagtaaacataggagagcaatgtttcatccatcgttcaattactcaacagatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcgggtatgtatttcattcattccttcagacagtgcgttgtcactttattcacagaaaaggcctccttcctgtgtctgcctccttgagcgtctattttagcaaatgtttgcaaatgtgatcaagctcagaatttccagatggcttgcttctctcaaaccctgcaaaaattactgtcattctaaagtactttaatgtgccgtttgcatgtgttcaacaaaggcttccagaggaaggctagttgaatatatattacttcccttctatctccttgcaaatcagaacttagccatcctcttcatttgatgctaatcctcagcaaatgaggtcattatgaaagtcagaagagttgtagcttcatatcaagggaacaaaaatcgggtttgtgctacaaaataagctcataaaaaagttactgatttcttactgtcctatgtattaaaccaagattttttttttttctttctacaagaaagttgtagagctggccagttctaggtcagctttgattccttcttcctgcccataagctttgaactttaattctcaaaatactacatatcctttcaggctcagctcaaatataactttcttcccttggaaattcctccttcctccaactgccttcagattttagcattccctccttgccattctagtgactcatggtttactgctgtatcagaatctgccattttgagacagtgaattgtgtgagtgtttgtcctttcccttgaaagctcacgttgaacacaccttggttgttcacctttggatgcagctcccaccttgaaacctttaaggcagaacccagagtgcagcagaggtgattgtcttctatcagtggaattactggagaaatatgacctgaaatattatgaattctcttggcattcatattagtgaaacagatacctgtcagataaaattaattggtaacttcttttaaaaaaaaagagtataacccattttaaatggtatatgattaattatagaattaagatgttaaattccagtgtgtttgtgacctcacaatccttcttaacatactattccatgtagctaaaagcagtcagctggaacgagtttttgagatgagatgaaaactaactatctcgcttccctggcccaaatagaaatagtaaggcaatgtgattttttttgttgtttcaggtttatttttttaaatcttaaatattttggatttttagctctgtgtaaaaggcgtgtcaaatctatgaagagacattatgcaagtgaactagtcacaaaaggagaaatattgattccctttatatgagatacctagggtagtcaaatttatagagatagaaagcagaatgatggttggtggggggtggaggaaataggaaggggaattagtttttaatgagtacagagtttcaatttgggaaaatgacaaaattctggagatggatgatgatgatggttgcacaaaaatgtgaatgcacttaataccactcaactgtatgcttaaaaatggtttaaaaatttgttatgcttatttttccaaaattaaaacaatctatgaaaagagaagcttttggaaataaatacagtctgatccaaaacttggacacaacacacattttgttttttggcatagttggttccacctacggtgttggctatttaggagtgctttaccttgcagtctgatggtaacactagaatggtgactaaattcagaaggaggccagtgtatccagttctgtgatcagagtcgatgttgacacctggaagctaagaagagaagcatgtgtatgtctcacaggtgttgtcatgaaccccacatagggcgggtagcctcaacgttaccatcaccttactgtttgtcgcctgatggaaaaagctgggtggaaatgtgactggaaagtaatgacaatgtgaacgtgcatccaaggttgtatctatgaagccaagatggcggtcttcacgggtgtagccctcacctacgcttaggcccttccctttgtgcaatggggaaatatttcacagcaggccgatcttgctgcagacttgattctgagtgtggatgtcgacatatagcatgctataaacaacaaacgctatttgggagtcccatttggtgttaggtgggatcaatgttcgtagatactgaatggttaatatttgtcaagagaagctgctttcaatccgtatatccaggtattgtgaaaccaggtgctgtctcctcccctcggttcacgttttgatttctagcaggagttgctggaaggagggaggggcagcaggatggaggggctgcaggacacggtgatgtacgcgtgcatctctctgctacagtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttggtgagtgctgaacgtgaaattacccagggtttcccaccatgcctgggagtttttgttctcttgcgagtgaaagctgactcagacctcacgtgcagaaatgctttatagcttcttgctctgggtaattaaagacttaattggagatggagttgatttggtagctttttcccttttgaaggttgggaatatttgttcaaccctttcaacttccacactgagaatgtgatcacgcatacacaacttaaagcatacatcagatttgcgtgaaatttgaatagcagccgggcgctgttgctcacgcctgtaatcccagcactttgggaggccgaggagggtgaatcacttgaggtcaggagtttgagaccaacctggccaacgtggtgaaaccctgtctctactaaaagtacaaaaagtagctgggcgtggtagtgcatgcctgtaatcccagctacctgggaagctgaggcaagagaatcgcttgaacctgggaggtggaggttgcagtgagccgagattgtgccactgcattccagcctgggtgacacagcgagactctgtcttaaaaaaaaaaaaaaaagaaaaggaaaggaaagaaaagaaatttgaataggaacccctggacagcatacagagtctacagtttttgccaaagcaaggctttcgaaaggtcttgaataggatagcactaattgcaagggcctcagaatggtcttaagaatgtcttaagagtttttacaaggagcatacggctgtaaaaatgctctaggaaaaacagaggtgtaaggagtaaaaatactacatgagatgctagtctgcctcatctgtgttctttctctactctatccccataggaattttttttaattttaaataatatttttactgttgcttgatttaaagtctggttaaaatctgagttaagagtcattcgattttcctgtctcgtccagacattgagggtttcagcaaagtatggagaaacacagttgtcactttctcagaaggattcactctcttctgggtacactagcaaagaccaatagaaacccagatgattgcagaaactagtgatatatgaatctgcttcccattgcaatggattgattatagatgtacactccaaaaatgatccaccttcctgattgggtaaaaagtcatttgttatctcccaagcacatttgttacttactatggaatacaatgggagaaggggaagggctgtgcaggctgtgtgggcttttcatgtacctcagctctatccctgaatgacttatccacatggaaactggctagaatcagcaaggtgctacaaccctttagcattctcatccagtagagctcacttggcctccatttaatcctggtgtgttgcttcctgctggagctgtctccccgtaagttttatgtttaacaggggacagtgactcagccaggtctatgcatgtgtggctgcagtaacaaacgcctattactaacagtgctttttgagctacattaataaagtcatcatagcatgtcatggatggatgacctgacatcaaagcaaggttttttggttttgttttaaaattaatttcagagactttcttgcttaatataaaaataaagagaaggaagaggggagaaagaaatcccaaattattttcttcagatctacagtttgactgtctccatgcatcctgtgacgttcctaactatttcagaattgtcagtttcaccttctagaaagaaatagcaaatatgtcaagtggcaggttatgtgttatataatgaatattgtattcacactcacaatttggtctttgattgttttcctttggctcttacaacgaacaaattaaactttccctaataccttgcatgaggcttctgagctttgctgagctttcctcagacctgctgttcgatacctttgttataccaattgtccttggagatcaactaaacttagtcaagaccttgaatttgagtatgggagcattccagcacacctacctattgtattctaatagactgttaacttttaaaaattatcttaccttggtgttccattctgtgatacaagctcaggcaaatctgctgaaattcaaaggaattaaagtgcattttcccacacactttacccttaaggtccaaatcatgacagaagagcctactcagttagttgtaatgtccctcatgttatttgtcaccctttccaaaaggtaactcaactgcataactaccttcatagtccccagaaagacaaattctcaaagtaggtgaatatgcataagaactttgaaactcaatacatgattaactagattaaccagaaatcctatgtcaggcctcaaagccagccacctctctctagaagttagcaatgacatgcagtgcctcaaagtgcacgaataaacctttctctccaaatgcacttttctcggtctttgatatgggtaactgatgatgagaaaggagatgattaaaggaaaaagggtgaggaatgatttgaacctagctttggatcaatgtcctcagcctgaataggtactagattttcgtagtcctttgaggggatttttgtgaggcagcagaatgatttcagagctaatgaaccagtcaggccacgctctgaaagcacataagactagctgcttgagcaaaggtcctaaaaggaaaaataagcttcaaggttgggtgctttcttggctcatctcttataattacaccctttttctaaagctttcatcattctggggagaaggcagaaagtctgagtgtttgttcatcaggtgttttcagattgaatttttggtgctagcagactcttatgcctcaccagatgcccagtgattatttttctaaacagagaaagaacaaaacattggcagaagcttaaacaacagctggcaaaaatgaagtgacatgaacacagaatgagtaaaagcatccatcccagccttgggtttcacatttgcagtcccaaaataagcgaacagccagttattttggggctcttaaaaatctttgaagttgccaactatcccaaattttgtaattggtttaaggaggaaagctggggattcccctaattttgaatctggaaaggatggcagcaatgaattctagtttcagggcagtagctccttatacagacaccctgagtattgccaatgttttgaccatcggtgcagagctctcctttaataacatttgcttaatgctttaatttattaacacttaaccttctctttcccttttcaaccctttttctcttccctttgctatattcccacgtaactttaaaaaaattaaaactcaatatcaaagcaggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatggtaaagtatacctattatctctctctctctctctctttttctctctctctgtctctgtcttttccttttctctttctctctctttgattagtgttcgtgtaactgaatagtattaatttagtggcagctttattcatccctaactaaatatacccatcaggtaaacgtgagccattgttactaacccatacctcaccctcttgtgtaattaatcctgtagccctgtgaccctgtgttgctgcaaatataaaagtttcaggccgggtgcggtggctcacgcctgtaatcccagcactttgggaggccgaggcgggtggatcatgaggtcaggagatcgagaccatcctggctaacacggtggaaccccgtctgtactaaaaatacaaaaattagccgggcgcggtggcgggcgcctgtagtcccagctgctcgggaggctgaggcaggaggatggtgtgaacccgggaggcggagcttgcagtgagctgagatcgcaccactgcactccagcctgggcgacagagtgagactccatctcaaaaaaaaaaaaaaaaaaagtttcagaaaaatcttcaccctttcctcaacttatttagctttttgtgtccttgtcttcaacactataaaatagttttaatacaggtggtacagatcctctgatatgtataatatgagctgtattatatggtgacatgagaaaacctgcatggtggcaattcagagccagtactatggttttttagaataagtgaatatatcaaagtttttcatttaatgggagaatctaagagtttgtgtctactggattttccctaatttttggatgtgaatgaagaaagaatgaaatctctatatttttgataaattgtatctgcattaaactaggcctgtccttatttgtttttgtgattagttaaattcaaatctttggttcttttatgtaagtggtgattctgccccccagggaacattggcattgtctgcagtgggtgtgagtagcatctagttaggtcagacatgcttcaaaacatcctacagaacacagaacagccctcacaataaaaagttacccagcacaaaataccaatactcattgtattattcatgtttaataaaaattaagttgaggctgaatgcggtgtctcacgcctgtaatcccagcactttggcaggccaaagcgggtggatcacctgaggtcaggagtttgagaccagcctggccaacatggtgaaaccccatctctactaaaaatataaaaattagcttagcgtggtggcacatgcctgtagtcccagctacttgggaggctgaggcagaagaatcgcttgagcctgggaggcggaggttgcagtgagccgagattgcgccactgcactccagcctgggcaacagggcgagactcatctcaaaaaaaaaaaaaaaaaaaaaaagttaagttgatacactaaggccaggaagtatagatcctttagagaattagttcctgaatattcactttattctaagctgactttgctcttgggaggaaggtgacacttgtcccaaaatgtttaaatgtcttttttcagtcttgctatacatgttataaaatatatattctaaaagtgagtatttctcaagaaaaaatctagtttatgaagatagtgtgataaaaactctatgccatgtatctataaaataagaaaattagggtttcatctgaaagttatttaccaaatgagtatttttatatactaactgctagaaagtgaactttatagttcaagatttgaaaggtatagccggtgccttacggaaaaggtaaatgcaaaaccaaacagtaaaaatttaaaattgttgattccaagaacagagaactttctctgcaccaaaaatatcccacactaaatgtggaggaaaacactggcctcttgaatgatgatctacttgaccctccttcaaatgcatggttagtcacttaccaactggtctggagttcattccaccaattcaccactctggaaagctgttacaatttaggaaagtggtcacaagatgatagaacataggttcctaataggaaggatgaaggaagccagaaaatatagtgagaagtgattgagagagccaaatgcggtccagacatcccccctttcattgcacttcattttattgcgctttgcaggtacttcattttgtacaaattgaaggtttgtggccaccctgcttcgagcaagtctgtcagtgtcatttttccaacagcgggtgctcactttgtgcctttgtgtcacattttggtaattctcacaatatttcaagttttattagtattaattattattatatctgctgtgatgacctgtgatctctgatgttactgttgtaattgtttgggggtgccacaaaccatacccacataagatgacaaacaataaatgtcatatgtgttctgactgctccactgactggccattccccatctctgttcctttcctcgggcctcccttttccaagataaagcagtattgaaattaggacaataaataaccttacaatggcctctaactcttcatatgaaaggaagagtcacacatctctcactttaaatcaaaagctagaaatgattaagcatagtgagggaaggcatgtcaaaagctgagataggccaaaagctagatccctcatgctaaacatttatccaagttgtgaatgcagaggaaaatttcttaaaggaaattaaaagtgccactccagagaacacatggattttaagaaagcgaaacagccttattgctgatatggagaaagtgtgagtggtctggatagaaaatcaaaccagccacaacattcccttatgccagagtccaatccagagcaagttcctaactcctcaattcagtaaaggctgagagaggggagaaagctagagaagatactttgaagctagcagaggttggtgcatgagatttaaagaaataaaccatctccgtaacataaaagtataaggggaagcagcaagtgcaaatataaaactgcagctagttttccagcggatttaattattaagatcatggatgaaggtggctacacaaaatgacagattttcagtgtagacaaaacagtcttctattgaaagaagatggtcatttaagactttcctagctagagaggagacatcaatgcctagtttcaaagcttcaaaggactggctgactctcttgttaggggctaatgcagctgatgaccttaagctgaagccagtgctcatctggctattctgaaaatcctagaacctttcagaatgatgctaaatgtactctgcctgtgctctagaaatggaacaacaaagcctggatgacagcacatatgttgtgctgtggtttattgagtattttaagcccactgttgagacctactgcttaggggaaaaaaatttctttcaaatattactgctcatggacaatacacctggtcacccaagagttctaatggaaatgtacaaggaaatgaatgttgttctcatgcctgctaacacagcatccattctgcaactcgtggatcaagaagtcattttgacttttaagtcttactatttaagaaatgtattttgtaaggctatacctgccatagatagtgatggctctaatggatttggaaaatccatttggaaagatttggaaaatcttctggaaaaaaattcacccttctagatgccattaagaacatttatgattcatgggagacatgttgaccttaacaagattttagaagaggttgattccaaccttcatggatgactttgaggggtttcgagacttcagtggaggaagaagctgcagaagttcctttgtggtggaaatagcaagagaagtagaattggaagtggagccggaagatgtgacttaattgccgtaatctcatgataaaacttgaacagatgaggagttgcttcttatggatgaacaaagaaaatggtttcttgagatggaatctactggtaaagatgttgcaaactttgttgaaatgacaacaaagggttttgattattaaatcaacttaagttaataaagcagtggcagagtctgagaggattgactccaatttcaaaaaaagttctacttagggtaaaatgctatcaaacagcaacatgctgcagagaaatctttcattgaaggaagagcaaacttcattgttgtcttattttaagaggttgccacagccacccaaccttcagcaaccaccaccctgatcagtcagcaggcatcaacatcaaggcaagaccctccatcagcaaaaaaagattacaactcactgaaggctcaggtgatcattatttagcaataaagtattttaaaattaagttatgtagtgtttttaaacataatgccattgcacacttaatagactatagtatagtgtgaacatgaattttatatgcactgggaagccaaagaatttgcatgactcactttactggaatacctgcttttttattgccatgatctggaactgaacccgtgatatctccgaggtatgctttgtgtatggatttagacacgtttatcaacatgtcatggaaagatatcaaacagactaacccaaaagaacaggacgcagggattgacttgctgggtttataattggtcaatcttattgtgggaatgagaacatccaaaagaaggaaagaaagtactccctgagtgaagagcttagaaaaagagtttgaagtcagtaaagacataaatactcagaagcgacttattctgcagtgtagatagtagatgttgacttaatttaataaaatacacagctgggtgcagtggcacacgcctgtaatcccagcacttgtggagactgaggcaggaggatcacttgagctcaggagttccaggccagcctgggcaacatagcgagacgtcgtctctgctaaaaattcaaaacaattagctaggagaggtggcttgcacccgtagtccaactatttggggcaacgggcaggatacgctggcgggaggatggctggagcccaggaggttgaggtcgagcttcagtgagccctgatcatgccactgcactccagcctggatgacagactgagaccatgtctcagaacaaacaaaataaaataccctggaaaaaaaacttttaagcctgaacaccaaaaattatcatgcaaggtggattatccaataacagttggcattataaaggcaattttaaaatttaaatatgtaggaaatataaaattcacatagacaccttgtgctaccttggttagaaacaagtaaacataaaactggtacaacatagttgaggattgatattttttaaggcaatacatgttctgctgagcatgtgatttcatccaagatgtttcaggaatttggttgatatgataataagcctcttctctagttactttgtaagtgccagaagcccggtaaagggaatcaagtctggcagagggtgaatatgtgatgctcaattttttttttttgagacggagtctcgctgtgtcacccaggctagagtgcagtggcatgatctcggctcactgcaagctctgcctcccgggttcatggtgatgctcctattttaagtgggtctgagaaacagcattttggaaattagagttgaagcaggggagttagatttctcaaaagatgtgggagatccaggaggattttgcaaacccccagaagacaaagagtgagcattacagttcagtgaagagataatcacactggatccacttcctttctgtgaaagcgtgttggacatagttgattccaaggtaaaatggaggtgcctatgcctcaggtctctttcagattttttactcgaatatttacttcatcaagtggcccaaaaaccatttgtttcatgatatctacaaggagactgaaggtcttaactcagagtggtttctaagctcttagaaatccatcacgtctggggccgggcatggtagctcatgcctgtaatcccagcacgttgggtggccaaggtgggcagaatgcctgagctcaggagttcaagaccagcccaggcaacatggcgaaacgctgtctctactaaaatacaaaaaattagccaggcatggtggcgcgtgcctgtagtcccagctacttgggaggctgaggcacaagaattgcttgaaaccaggaggcggaggttgctatgagtcaagatcataccactgcactccaggctgggagacagtgagactgtgtctccagaaaaaaaaaaaaagaatccatcacgtctgggacactgttctcgaaaccccagcaggccctttgaaaagatgctctgccctttgtgcagtgcgtgagtctactctgagtccatttccatgtctagttcatgctatctaattctttgctcttgtcatcggtagccttattctttctgcagtttcactcatctcagtctttagtttccctcactctgcttcccacatttttctctgacttttccaacaaaacctccaaaacgtgattcctctttccttggcattattgtatgttagaaggtctggcaggagtgttttcacagccttggtcaggccaaggttgggggagtccttaccttcattgctttgattctctttgggaccagggtggacaatgggggagggcagaaccttctctcctgtgagatatgggcaagggatgaatgaataaatacacaatggcagcacagaagggcccagagaatagctgaacttactgaatctgaacttgaaatctaagaagtcaaacaacatttgcattgtatggagatgccccatggagtgggagagagactttaatcagacaaggacagaagctccctgagccaggtaacatggaaccatcagattgaatcaagttcaatataatgaaaatctttagaagcttaaaaatgctttatttgaataatggtcctaaatttgcacttcagatcactctgattcaaagtatttgcttatgtaggaggtagagcttggcaacatatagatattgctgtttccttggcaaaggcattagaatagtaaaaagtcccccaaaacttttcaaatatttatgggattcaaatttccccatgccgcccttagatatttattacatacgtgtttatccagtaaaatatttacaacaggaataattgtatcctttgttgatttgcttggctttcaatgtggattccgtaaggggaggctgaggatattaatatgggaacaaggttagaattgtaattgcttgtcacagatagataggttgaaacccaagatggaagctgctgttggaagagtaagtgccgagatttggaatagtccctggacagggctgtgagagctgggatttgcttctcttgatacatgactgctattgaaagtgtagtaatctccattttcactcctctgggagagctaaagtaggtataaacactgtttaataaaggatgttgggtactttctggaatttgtcataaagtacctaatctgtccatgtgccttgcagttttaaaagtcaaatacattgacacctctttctaatactgtttctggagggcagggagactcatactcttgtttcaggcccttcttttatattttttccaccgtaagtagtcaattttgctttgggataaagctcttttttataatgggctcatctttatattttaaagcgctagagagcatttcagcaaatacaatcctggtttaattccaaatgaagaagtaaaagttcattaaaacaagcataactttattgatagtataaaaacatcctggaaatctagggtatacctaaaattattttggtgctgctctgaggatggcttataaaatctagccatcaaagcagggtgtttcatattttaattcatctctgatactgcttggtgaggttggtagtatttatacagtaaaataaaattatttcttttttgaaaggaatgttccaattagatatgatttcctcaataccaacacatgattcctatgtaaaccaaaaactaaaagttcactgtcaggcaggtcctgggtttaattcccagtatctccacctgctgcctgagtgaccttagacatattacctacattttctacaccccagtgtcttcatttgtaaactggggccataattgcacctattttattgagtggtgagagtcaaatgaagtatgtggtaatggacttagcacagtgcttggcacgtttaaaccatccttaaatggtggtgcttcatagattaagataaacaacaaatgaggaaaattcagcaaggtcaaatcgacatttccatgctaaatgttaattttactatgcttaaaattaagcttcaacccaaaaaagagtttcacagacatacagatgaggaaaaaaaatagcaaataaaggatgggaataaaaataataaaggaattctgtgtattgggtgattatctcatcaaattatgaaagcagcagaaaaataaaaataatttgagaatggaatctgatctgctcagaaaactctggctaccaacaacacacaagaactgtaaagaggaacctctgtacaattcaatcattataatcactttgattacaaggagacattctttttagtatcctgattgtgatttccccatggcctgaacaacctggtgatttctgagagtctccataaaattaattgcaatgagcaatatgaagtttgctaaaggaccaatacacgtgtttatgaaagttctggagagtcacagcgatgggctatacagcttgtttgtcctatttagtgacacagtgagcgtactttataaaatatcactgattcatcaccttggttctgctggttaactgccctcaaatgggagtcatatgaaggagctagttttcctccaaaagctctgaaaataatttgctgttaaaatagcgtcattaaaatatacgaacaatatgcttttaacattatgatgacaataataaacacatggtaccaaaaatatgctaatcacttctgagcagtttttgtgtgccaggcagtattccaaacaatcttcttggatcatctttgccccaatttccttagataattctcttattcccaatgtgcacacgagaaaactgaggcactgagaatttaagtaactttgcttaagtcccatccaggaaattgaagagcatagaatgcaaagtcagataagacagtctgactccagaatctgacctagtcaccattgtgctaaactgtctcccagtaagcctgagaaacaccacctccccagcttggacggtcacaggcatattggtgtagtaaagactcagaggagtgcataggaaatgattggtaaaacagattttgggaaacattgtcccaaaacatgaatgggattcacctaacaattcacttgatttagttattttcttcttactcttgtgccttagctagaagaataatgggcttttatggctgcagtaaattaactgttgaaatcatatttcgactttctcattttgcagagagcttaaataacttatacaaggtctcatagtaataaaaagtagtagctgtaataaatgtgtattgagtgcttattgtatgtcaggcacagagcttaaacattgcatatacttttatccatgagaggggaattattgtcatcaccccattttaacagatgagaaaaataaggcacacagctaatgagtaggaaaaaaaggtgatttgatcccaggtctgaatctcaagcccatgcttttaaccactatgtgtcatgaaaataaaataacaggaagccggaccaaagctgagtaagatccttgggaaatgtaaatggaagatagaccacaggtagttgggatttgtgggatgtcttttgttccaggactccagtggaaagatatatattataggtatctcagtttggaatagttaacatattttcccatataatagttaaatgtgatgggaagatacatgtattcagtaaacacgaaagtgcctactataagccataggtctcctggtaacttctagatttgatggtgcactgaattaaatgggcatgcacaggtgaatcttataatggaacctaacaccacatttagcattttctttgttagaaaatgtatgacgagtttcagtcaacctacaattaaatattaaaaatacaacttgctcatagttggttgctacttgccttggtcttaatgaagaaattattagtaaagaacatatagctattactataggacttttcatgagtgataccaaacaagatctgtcaggagttccatattttcagttgtgctttattaaaagcagtgggaaagaaagtggatattatatgtgtgtttaacaagttgttagtacacttctgatattaatattcagttgaggaaattaagccgactcactaaatattgctgataaattgcaggaaacattggtagagacattaattatcagactttaaagttctggaagagaattctgctgtggtgcagcactttgatgggactgccttttttcagtggcaggggaggagtgagaaacatataccttggctagaattttagagcagtgttttctttggcaaactctgttttatttgtggagatgtctgtttgggaggagggtcatggggacatacatgacccacatcagagaagatcttaaaatggtttattaaactcctaattgtctagaaattcaagtcagactgcttgaaatggggacagagaagtcacacttgttattcagatacagggcttctgcacacctcctggctggaggatgtcttctctggggtcttcatttctttatgctctgtccctctttgcagagtcctcgaatgccaccttgctgaccaatgcagagaagattgccaccatcaccaccacacacaccccttctcagcaagggacccaggagacaaggtcagacatgactggtttcctttgttaaaggggaaaaaagtaactcccagcatgacaatatatgtccttgattctttctcagtttgctaatgggttgctcttatatttatttctttcactttggcaggaataccaccaaaccaaagcaggaatctcaatttgagttcaaagcaccccaagcaacacaggtgagcaccatgtctcttttttctctatactttgcacgtttccttccaactttctcaagctacttttatgggatattttttgaagcacctttaatttaaaagaaataaccttttgtgaggtgatttaccaaacgtatacttacatttgattgtctaggaaataacatgttattttactaccttaaaatattcctagatagccttttctaggggaaaaaaaatgaaaagcagtaattgtcacaaggatcggcagttagagaaagcaaagcaaccaatatctactcatagtattcataaacatgcttctgccaagaaaatgtctttgtgataaggtgtttttcaggcttgagaatttaaggtgagatccatagagcaaaatgcctgtcctcaggatggcgagggagagtgtgaaaatactagcaggtgaaacaaatttgaggaactttgggtgatgcaaaattaaacagattcctttttttttttttttttttttttttttaagagacaggggtctcactgtgctgcccagactggactgaaactcctgggctcaagcaatcatcctgtctcagcctcctgagtagctggtattacaagtccccagctgggttctttctttactggttgcctgggggctttcagttatcccttcataattttccttgatcaggatttggagaggttttgttggtatcctcatgatgggcacagccagcatttattggacacaggtcagggaggctgggcatccagcagccaggtggctggtatcatgtaatgaggaattgtccttccccaaatgcaaatcacagcctcactgattaaattttaatccacatgttataataaatacacagatgcatatagacatgctcataactgttttcaaattctggatctgtgacttctgagattaatgaggatgaatcaagattattaataaacaagagtcaccaagagggggatagagattgtgcctttttgccaagaatgtttaggaagagtcctatggatattagttctcctagaatgattgcatttaatttctttaaataggagcaagatttttacactgtggaactggaaagaggagccaagggatttggctttagccttcgaggaggccgagagtataacatggacctctatgttctgcgcttagcagaggacggtcctgcggagaggtgtggaaagatgagggtaagtggagagaggagtctggggtaggtgcaaagaaaccatctgcagtgaattcttgtcatatatggttagaatgttcatgttcataagaactacattttctatagctttcatgattctcttaagtgcatgactcctaccctaccaaatatttctgcctaaagcacaattaattatagctgctaaagttaggtgaacacttccaactctttggggttgatatagggaataaaggatttaaattactttcaaatatattaaagtagatatttttcagagcccatttctatagtttttgtgcttaatgtcatggggcaggcacatcacttgacaggaattctggggtaccctgggatgcttagaaagcaggaaagccatatggccctgtagattctgggcagtgaggtctacttatcctctagctggttaccagtggtcttaccttaggctcagagacagcaagtctactctctgccttagcaaagagccagggctctgtggcatgaatattcagagttgctctgtagtaagagctacagatttttaatacataaatgccaaaagtccactctgctctgtttcgctaatatctgttactgtagatgaatgtgctgttctcctgggcagattagatgattaagaaaacataaatcatctacccatagataggtcacatagattgggaattgcccatggagagccatttacaacaaattaaaagaaatcaagacagtcaggccaggaaaggaaaaaagtgaatgcagttgggcctgagcagaaaaagggaaaaactgattaagggtgaggatcgtaacacttgcacttaagccacaatcttgatgtttaagtttgttcagcatgaattttttaacatttaaaattgagaaggtagagcattgaatgtgttttaagaaaattaaacagtgaaaaatgtagtaaaaatacagtgtccagggccaaacagtataccagtttctctcatattcttttcttttgcatgtatatattcaaggggagatacatggtggtacatattttttttgtttgaaatttcagatataaggaatttattttcccttgccttttaatcactttaaaaagttaattactttaaattactttactttaaattactttaaaaatttaatctctttaaaaagttaatcaaatgaaatattattatgctactttgtataatggtgtatagtttacatgacaggtttacatgtattacctgatttgatgccagcagcttggtaggtgtgagtggtattatcagcctcttctataagtaagaaagtagactccaggaagttaaagtactgggagcaaatcagttaccaaatgataggattcaaattaaagactgtagacttgaaagccagtgccattcctcctctttttagaatataagctctatttgagtggggatctgcctcgtcttatttattcttttatttccagtgtctaaaatagtggctgacacaaagtgaatgctgcattcaatacatcagtcaggattatggtctcatctgaagtctcacctggggaagggtttgctttttaagctcactcacgtggttgttaccaggattcagtgccttatagggcagtccctcatttcattatcatgggactccagaggatagctcataacatgcatcagggcaaacaagtgagagaagaaaagagggcaagtaagacagatgacaaaatcgttttatgacctgatctttgaactgatatcatgtttgccatattctgtttattagaagcaagtcacttgacgtagctcacattcaaaggcagggggagattacacaggttgtgaatgcaaggaggcagaaatcatgggagccttcttaaaagctgcctaccccaaccattaacatgcccttactgctttttttcccccctttctcatgtgatttggcatatatgtagttttctaattttcttaattgtctttccctctttagaatataatctccatgagggcagggatttctgtttgtttttgtcactgccacctccaaagcaatagatgttctgccacgtgcttaataaacatttggtgaatccgtacatgaatttcaaatctcacttagttttcttttgctttggcagattggtgatgaaattttagagatcaatggtgagaccaccaaaaacatgaagcattctcgagctatagaactgattaagaatggtggccgcagagttcgtctgtttctgaagcggggagacggctcagtaccagaatatggtgggtcaaactatgaaaacattccttccttccctggcatgactccatgaatttgtctccagaacggcagcaggaaagtcttttttgtttcccctattcaccagtgtcttaccagcctctcgcaccatgtgattatttgcctcgcttgttctgaaatctctacacatttcatccttttgcttgcttacgtggactggggcatggcctaagacaagatctttatagccccctttctgataatcagagagaacgttttgtctagtccgaccaagagcgaaggaatgtttgtttgtactgtgccaaactgttcctcagatccaattgttagcacaaaatgactatatactccttttaagaagcaggaaagcaggtttcctgagtgatatgttgaggcacaattattttttcctttttggttacttggtgtctttatttaagaggcatgaaattttgagagatttgggggctttgctaacctcccttatgctctgtatacaacacttctccatcccccaactggtgtcttaccccaaatcagaccatctgagcccactactatcaaacaaacaaacaaaaactgttaatatattagccataatgtttttaaatgataaaggatgaaataaattcccagtgctcatcatgagggaaacatgtgactatacctttcctatgaggaaagccaggttatacatagagttcctttgtcatatctttagacttgatttgagtagacagcaatgatctttacatagcttagtgttctgatggcaaaatattgtatatgataataattatgtcctatttatttgagatttgtgtttaaaattaaaaaaaaaaaaaaaaagaagaagctatgccctagatgtagggctttttttcccaaccaaaggtctaccaaagtttctatagaaactgtgattgaatggtccccagatacgttggtcccctttattagggatttatctattatcaccctcttttctgaaagtcattctgcacaattctcagttgcattttggacttgatgagatgtttaattcagatgcagctcaaggagaaggatagctccttggagggccagccttcccaggtgttcgacatttgtacaggtgcaaaatacgaggggtccgaggtacagggggagggtgggtattagacaaggcccctatagacatggccaaccacaggggaagtattttgacaacattaagatgccgtggctgtgcactgtactgaacttctgaccattaggtgtattgataccactgaaactgtgtaacattgtctcccttttctgtcttccctatgcttctgttggatgtgatatttcatttgagagtcatcgtcagtaacctgtgtaccttctcaaaacctatgtctgttgcactgaggatgaaaatccaacactaacaaatgttctttgggctaaaaataaagatcatttaaatacatggttttccaagaagggttgaacctgccacagggttgtgctactgtaatgtctccatgcgtcacttggactaaatctctctaattccattgattagagtcacaaatgggttataatatgttaagttccaatatttttctgacttgattggaacctgcttctctgtgaggctatttttgtaatgagttttttgtacttaatttaactgccgcggtctttggtgggggtgggaagggattttgttcttttgttgtttattgttaatgctctcctatgccagcctgtcattgttccagttgtttgaaaaaacaaaacaaaacaaaacaaaaaaggatgcattcgttgtctgggttctcgagtcaccttatggctgtctaaaaatgtcactgttccgattgcggtctctgcagccttatttgagtgttgccttagactgtctgactggacaaataaactctctttgccctatgttaacaaatgtagattttttttctttcctctgtgttatagggaatctaaatgttcaactttttctctttctctctttctccttctctctgactgttcttggtgctgggccctcccttccacagcgatgatacctcctaatatcgctgcatgtatgagaaatgaaaagctcggggaggcttgcttctaccttatgggccataatcaaactacggtttgtagctcaatcaatactaggtgtttctgtgctgtggcctaatttcctcattgcttctgcttagctctgttttgatatgtttggcaattcattctgagcaccctgcgttctttgaattgtaagtacaacgctgaccctgttgaagtgttgccttcccttgtcttaaaagtaggcataagaagccactggtgatccaagtgccttcctgtatccacatcttcacatgacctttgttaagaacctgttttttgttcattctcgtagccaacccagtatttagaaagaatgaaccttgtttcatggagccctgtatcgtagggctttgctagatgggaagacgagatttcctgcttggtcaggtatctctttgcaaactgcagtccatgggcccaatcctgtccatagcctgtttttgtaagtaaagttttattgacacataggcacgcccattacttttgtgttgcctgtgtttttataccacagtggcagagctgaatagctgtaacagagatggtgtggcccaaaacacccagattatttactattgccctttagagaaagttggctgacccctgcttttggcttttcacttgctttttgttaaaaacccactctaggttttgggaagttgtcatgaaacaggttaattgctaaatattgaccttgttggctcatgaaagatccttaaaga

SEQ ID NO: 14817 - DNA, 66480 bp, Human
  misc_feature (1)...(66480): n = A,T,C or G
tgctatatttatttatatacatatttgttttctgtgtctcacagtaacatataaattccatcagggcatgagctttgtcttgttcaccagtgttttcccagtgcctggcatgtgttggggcctcagtaaatatttgttgaataaatacaatatataatgccatgaatacacacacatatacataaacagagatatatttatatgtatataataacagattattatactgggatttgaacggtaagattctatcaattcattctaacaaaaacataaactataatgtctactaaaaattattgagcaaagccctcaaaaaggattatctcattcagtacacacaacaaacttatggattaggtgctattattatccctattttgcaaacaaggatactgagaaatagacactaaggaacctgtccaagaccacaggttggagaggcagaccatgaacctaggattcgcactccagaccactgttctttaacagtatatgatactgtctctatgtttcctgtgcctgacacttgagatgtaaatttaaaagttgtgaactacctcaagggatttgtcatcacctgccaggggaggcacgaaacgggaacaaattaggaaacagtgtaagagtagactttttaacctgaaggttctagcatgctgattatgagaagcaaacatctatactataaccatcctatgcccaatttgcagctatttaaaatattcagatttcagatagaagaattatgtgcactaaaaatacattttgcctgagtaaagtgtgtactaagtgttgagtgtttttgacttatgaaaattgtgaatatccagtgtaggtatggatgcggttattcacatgggcagatgatcagagactgcacagtgctaagaacttcagcgccactaggcacatatagtcggttatttaattgcattacatttcaacgaagagatcctagacatagggaaatatcgttgcttattatataggaaaacgttgaccttaaatcaccaccgcaggtaataatgccttgctaaatgagctctgttgaatgtaacagcagaagtcacattttttgctcttttttttcatctcataatatttaacataggctcctagtacagggtacataattgctgtttggtttattttcctttcttgacttatgtgtaaaccacattctgctcattgcttccactttgttgactgagattgggctaaaatgataaatccatagcccagcacctgagctggatgacttttttactctggatgctctgccttatttcataagaggaagcgttacatttgttagccactgagaagatgaccagattaatgcagggggagaattttctagcaaatgcagcgtcctttctccctagtcagaattcatggacggcctctttttgcccaacatattaattacatgaggagcagcagcattttaatccctgggagatgtccaaccacagatctcaggcaatcatatttctctggtgatgtgtttatgcagcaggtgtcattttctttaaagggctttggaacttgccggttgtattgaggaatacgagaatctcaaggcctgtgataaaaacacaaaccccttaggctctgagcttaaggtggatacgtttttagtatttactggagtcgtaaaagctgctgactgtgaatgttgtctgtataaaatccagttcaccttttttattcagtgcattatcaaaaatggtataaaactctctctaggttacccagcggtgcttggttttctctctctcccatttggggtcccaggcactagagtgtggaaatgagaatgctgttgtgttgtattagaaagaagttgcctttactgtgtccctgtctggacagatgaggcagcagagtcttaggtacgccctcttactgaacaggttattttaattacacctggatgtggaacttcctgttttagttgattgatggtttgttgtgcctttgtattttctgctacaggcacaacccgatctcccagagaaggagaagtgcctggcgtggactataactttctgactgtgaaggagttcttggacctcgagcagagtgggactcttctggaagtcggcacctatgaaggtgagttacttgtacgacagcataaaaagcttctctcctgggtacttgagaggagccagagccatccaggcaaaaatgttttgtggaatctggaggtctaaacaaataacaggagattgcagttcaccttaatatgacgaataatagacaaagtctatggaataaggctttgtggagttctttaaaaatagttttagtttttctctaggagttttcttttttaatttacctattcaagtatgtgggtgtgttttgtttttaatacggacatgtgcggtattaggagagaaggaagaatcatggttaatcacaaaatgtgatcctataagtagtgttgttttaatcttgaagaaataaaatatcactttcctactgattggtttttaatgtatttttatgtgattcataaagcaaactttttttttttttttttttgagacggagtctcgctctgtcgcccaggctggagtgcagtggcgcgatcttggctcactgtaagctctgcctcctgggttcatgccattctcctgcgtcagcctcccgagtagctgggcttacaggcgcctgccaccatgcccggctaattttttgtatttttagtagagacagggtttcaccgtgttagccaggatcgtctcgatctcctgacctcgtgatccgcccgcctcggcctcccaaagtgctgggattacaggaaagcaaattattttaaaaatatttagctaagtaatcttcatatacctgtctcccacctgcctgatttaggattcaatattataaataatctgattaccttctgaagtttatgtcaatacagacatgcgtgtgcacatgcgtatgtacatgtgtgcatgcctgttgtatggatattcccatttcttcccagttttccccaaaaggtagtatatagtacatgctgtttggaccttgctctttttgtttaacagtatgtcttaataggtcattgcaattcagtaataaagcacttctggttttcttctttttgaaatataattataaaaattataattcctttgtatgggcataccgtaatttatttaaccacttccctctgaacaaatatttgagtcagtttcaatgtttcatatttctaaacactgctgagtcgaatgacatggatgtatcatttcatacaggtgcaaacatatccataggatcagatcccattgctgggtcaaagccaaatgtggtggaaaaaagtcacatttttctgaaaacagtattatagcttgattactttttggagtgttattattatttgaggcagaagtggtgtaatgatactattaactaggacagattattaacttggtcaagttattatgtgtatctctttacaaactctttaaaatttggatttattaggcattcacggggcattttaaagattagacttaaacataaagggtaaatacaaagtagattattattttattagggacattatagctttaatgtgataattgcttctgttacagtgactaacactcatatcatgatcatgaatcttagagatggctgtttctggtttgatgttctttggagaagacgggaaggagcattgtctttgtacatactgctcctttccaaattgtgaatatacagtagacagtgtatattaatcaaattcctgctcatgaatcaggaatttttgtttgtttgtttttgagtgttgctaattatcagttggcttagtttcctgaaactacatgttgggatgtgactgggtggctggtgggctgggcaggggtctgagagtaatcgaggtctaggagtgtatagagggaagggaggggggctgcgggaaggtacaaggagcttcttcaacatgttgtcagcatgctgtcctcacatgttgtacatgtgaagaggagagcatgtgtgactcctctttggttagcagagagagaattgtcctcatctgcaatcagttattatgcccatctggggggcttcagtcgtcaaatatataaaacatctatttgcatttttggagaggctggggtgggagtggttgtacaaagcaaaagaggattgggtcggaaaggaaaaacttgtgatttagactccaatttaacttggaagatggaaagtaaactcactttattcgatgttaatggaacaaatgatatataggtggagtcagttctttttctcatttaattttatcattgcaacagaggcggctattatcttcactgaatttttagatggggacactgaagccaagtggtattaaataactatttcagagttgcacagccagttctagaatgctagagaaggaaccaaacccagctcagtgtgactctcagatcctacactctttcctaaaaacccgaagaatatcctagatataactaagaagctaaggaaaataacccattagtacttgaagctaacttcctggtgtatagcagtagaggaatggttttcagaaaatgtctgattgtcttgtagaaaacggtgcctttgtgaatgttgcatagttattttggaattggaattttcttaggcacaggactaatcttttccagttctaacccatttgtacagcgttcttcagcctttggcctattagcagcgaaatttccttaccatatgagagggctcataatttttctttcttttttttttttttttttttttttttgagacagagtctcgctctgtcgcccaggctggagtgcagtggcgcagtctcagctcactgcaacctccccctcccatgttcaagcgattctcctgcctcagcctcctgagtagctggaactacaggtgcatgccactgtgcccggctaagtttttatattttagtagagacagggtttcaccgtgttggccaggatggtctcgatctcatgacttcgtgatccgcctgcatcgacctcccatagtactgggattacaggcgtgagccaccgagcctggccgagatggctcataagtttttggaactgaccagagtatattatattgactcttaaaagctgagagccaaatggaatgtttattaaatgccatataccctcatcggagtagggctggaaagacatttagagaacttccactgtctttgcctcccctggacaagtcccctgatggtggctgctgtctattggtggacgctaacaagcatgcaagccctgctgtcacactgcctgagtttgattctcagcccctttgctattgagctgtgtgccctccggcaagttgcttaatgctgcatgtctccattttcccattggtaaaatgaggataataatagtgcttcctcagaggtagggctaaatgagacaataattggaaagggcttagcagagtgtctgacacatgtaagctctccttcagcattagcttttgtatttacacgcacctagttcaaaattgctcccgtagtggatccctttcccctctactagtcagtaaaccagcagatttgccagtaaaatgtctttatttacttcccaggtactcaccatcttttttcccctcctgaaattgctttctccagacctctgctggttccagagaggaaaagtctaccacaacaacacaaagcactctttaaaggaagacatatataaatgtttaagtaacagtaataagtgtacatgatggaatagttcctacagcaaaagccttaaaactagctaagtcctacttgtttcccctcttccatataggtaaccactattaaagatgctagtgcaaatattcagaaaacttatatgtacacaacatatatgtatatctcgtttacttcactctgttattgccgtttgcccttaacataccctggagatctttccacattaccgcatacagtttcacctcattctttataaatgctgcatagtgtcccagtgaatgagtatatatatatctctacatctatctatgtatctatctgtctatctgtatataaatatataacttatttaaccagccccctgcagatggacattttaaatgtcccctgcctcacctcccccttctgtttttggtggtcgtgttataaacagtgcttcaagtatattgttacgcaattatgagcataactatagggtaagtttctggcagcacagttttaaagcaagccttttaatgcatatatagtttatttcaacaaatatttattgagtatttatttcaggtcagactttttttgtgaggcaagggatatgatgtacagggcagtagaccaaaactacctgactttgaaggtgcttatgttttttaattaattatttttgctagggcttgtgtggcacatagtaggtgctcttcaaagtgcattatatgcacaaattcatttaatcttcctaacaagcctatgaggtaggttctatttatgtccattttacagaagaggagtatgaggcccagaaatgccagtaatctcttcttagttcacatggtaaatcaaagatagagctgggattcagattcaggcactctggccacagagtctacactcttcccacactcagtcttgtgaggcagattaaacataaacaattttgctgggcgtggtggcggatacctgtaatcccagcactttgggaggctgaggtgggaggattgcttgagctcaggagctcgcgaccagcctgggcaacatggcaaaaccccatctctataaaaaaatacaaaaatgagctgggcacggtggcgtgcacctgtaatcccagctactcgggaagctgaggtgggagaatcccctgatcctgggaagttcgaggctgcagtgagccaagatcacaccactgcactccagcctgggcaacaggagcaagactctgtgtaatatatgaatgaatgaatgtaaacaattttaagaaaagtgatgagtaggccgggtgtagtggctcatgcctataatcccagcactttgggaggccaaggcaggcggatcattttaggtcaggaattcgacacaagcctggccaacatggtaaaatcccctctgtaccaaaaaaaatataaaaattagctgggcttggtggtgcatgcctatagtcccagctacttgggaggctgaggtgggagaatcacttgaacccaagaggcagatgttgcagtgagctgagattgtgccactgcactccagcctgggtgacaaagtgagaccctgtctcaaaaaacaaaaaaaaaagaaaaaaagttatgagtgttttgagagaaactacacagcgctccagaagcttatagaaagcttcatctagttttggcagactccctagaggaggcgaagctatgggaggactgtgttaggtcaggtgagaggctgggagatggtgtttgaatttagtaatcagcatgggccatggggcttgaatccacagagaacgatgtgatgatgaaccaagagaggattagaaggatggcttctagaaagggaggggaagcaagcacaccctgtttcccttagaaccactgctatcctgtaagaacttccttccatgctgggaatgttcagtattctgtactgtccattatggcagccagtggttcttgtgattgagaaaccaagttttaaattaactttaattcaacataaactcatttaaatttaagtagccacacatggctggtggctccagttttagaataaaagcttctgaaaggaaggttgaggacctgctcaacaagatctctgtcctcaccagctgacttcacaaagcaaagcaggtcttaagagttaagctcctttaaaaaagaatcatcatgttgaatcttcccaaagaggatgttatgcagaggagtggtgatcttcttttgtggatacattctatgacaggcaagatggcagacaaatagagtgaaccagtgaagcctcaaggcccagtaaccttcagaattctctttcaggcccaatatttgcttgatttacattggtcggttgtaggactttacagctggaaatgcagtaaagttagtttcttcagatgatagaactgaaatccagagagagcttgctttaagatacttcagggagttagggacatagcctggccaaatgttgcaggactgggatgcttttatttccctttgcctgaaaagtaatgcttcttttgtagcctcagttactagtttgtgagttcattcatttattcattaaagataaaatgctgaacaaaagcagatatggttgtggtcactgtctttatgggtcttaaatgtctagtgaacaagacactttatttaaataaacgaatatccaattgtaagtgtgcgaaggtctttaaaggagaccataagacagggagagtggatgtctgtggaatcaagaaaaagtacctctgtagaagtagtaattgaagtgagatctgatggttgagctggagttaggttgctggatttagcaaataaaaacgcggaacaccctgtcttgcatttcatctggcaaccacagttggagttggctttgaaccaccttggtgatggtggtggtaaatagtcagctgaatctggagatatttatgtgaaaagctgaatttgttaatgtattggttattgtgagaacgaggtagaaaagacagatgatgacaatcctcctaagataactcctagtttctgtcttctattactggatagatagtggtaccatttgtgaaaataaaaaatactataattggggtaggtttgccgggcagggactccatcctgaaactttctatccaccgacagctgtaatgctgagagtagcattatactcccaacagagtagagccccttcctggcgatgtaaagaatctgattatcatccctcacaaggcatagaagttattagtagagtttgtcattgatctctgctttacaatttgaaccagctcctcattctgtcactgaacagaattggcatcaaagcaaggtaaagaagacaagaataagcacatctttccaacttggcccaacttcctaattgtggcactgagcttatttatttgatatggtgcttaaaataaatcagctgaaccatttcccttttcccttgcttttctttttttttctgttgacatttttgctctgcaagacaggtcactgcctcagccagcccttgggacttctctaggagagagtttacaagggatgaactattcagtggagggtggggatccagacatggctgttttacaaatgcctctgggtagaagaggctgattatacactttgagcattgcaaaggttttccttcagcatagaagtgcagtgccagggtgacatttcaaattggagttatgggttgcatatttctgcatgttaattaggaagaggatgtcagcattcaataatgttattgttttgcttcctagaaggtctgcaaaaaggcagctgccaatggtataatttttggggacacagagataaaataggggtgaagagagttcttgtttctggttaaagaaagcgagactgtctagagtcctgttctttggcaggccttagaagcagtctgttgtgatgagctctgttggcaaactctgtcgtagaatgttctctgttgataatgaaagtgaccaaatgaaatctgtgctataattggctgttcttctgcttatgaagatggggggagctggcgaagttttctttaattccctgcttagagatccccaaatattcctggagttaaaagtgtagatgtcagagacagactaatctgtatttaaatgccagtcatcatctttgacttgtgtaaatatcagtttctttatgtgaaaatgggaatattgatgcctttttttctctaagattgtttataaagattagagtaagtgaatatatgcgtagtgacacttaatatgtgcacgataaaggtaactttaaaaaatgttgttctttgaatatgtgttgtgataatacactcttttacacattaaccctattatctatctacaacatcaggcctgattggagactggcagagttgattataggctaacattgtgtcaagcacagtgctgggtgctttatacacattatctaatttaatcttgacaaaaacctattaggttgccatgatttttgtctttatactgtgtgaactgaggctgaagagagagaggtcccttacctcactcagggtcgtaaaactcttatgttctcctgtttggtcttgtattagaaaccaaatggcactggcaagaacaaactgctaattatagaacagtggtttattgtccttctgtgcatgaacatcctatttttgtagggtggggcaggtaggaaaaggaagagtaaaaagaaagtattgcagttttatgaaggaactatcatgtgctgagcaagcaagtagcaaagtgaagtgatgcagatcttggtaattcaaatgtaattgacggactggaaagaaagtgttgtgagtcatgctattaaaaactggatccacaatacaggtttttaggaggatcccaggctggaattcatgtgcactatctgcctttattcatttactcattctgcagtgaattaccgggtaatggtatgtgcctggcactgcgtcaggcctgagaacacagtggtacacaaaatcagatgtggctcctggcctctttgagtttatagtctagaggtgaagacaggtactgattaattaaacagtctgctatatacaataaagggcattaggaaggggaggtatgtggttccttgagaacatataagaactgataaggacagctttgatgtagtctgtggggtcagagatactgttgctgaggatgagcaggtagtaacagggtgaggagcagagggaggagtgggtgcaagagctgtgagatgggggaagggggcacagtttacatgctgggggctgaaaggcaaccagtgaggtcagagtgaaaagaacaaggtgaaggcaatcaggacaagtgcttggagagtgggcatggggcagaccactcaggaccgtgaggccaaggcaaaatcagatatgctggatgtccatgtattcatgtactctatacatatttgcactatacataaagagagtaaggtttttgtacctctctccccctcaaaaaagaaaacaatttttgcccccttgggggtgatattgccccattgaaaatgcatgctgtagattcccagccataggtggtcactaccatcctgttctcaggcttatttgcaaaagcttgtctcataggaagaagacagacaagtacccccaattcccacccccatttaccttggaccagccatgtaactccatggcaggcgtttctgccactttgggcctctatgtttgtcatctgcaaaagaggaatgattttctctgtcccaaatggctttgctacacaaacagtgtgatccatggatctcaggcccaccctgatcattacttaatgtaatttaattgtttgcacattgaagcttgacaaaactgatgtatgccatatagaatggttgtgaagatcgtgtttcagtccaatttttactttgtatttcccatgcctggcattaaaaaggttttctgtaaggaaatgaatgaatgaatagtaaatttgtataatttgaaagccatatagatttgattcatcctagcttaaattccagggttacaatcctccttaaatattttataaagccctaaaaattgatttgcagtgcctattaatttttaaatgtgtgtcagaaaaatattttctttggctttgtcctggccagagattttgcttgttaattaaggccagcagtggcttcctcttaagtcctcctttgccctccgctttcctccctggctaccctccctgttgagatttgttgtagaaccagttctgaaaatagcagcagagagaacaagtttccacttgggagggagcccagccactgcaggaaacgtgtgttggataacgcagagcctgtgggataatcagcctcacggctcctagacactgtgcagcctgccaagtgatagccccaattaagtttttaatcacttacaatttttcagatgatttttatttaatactgttaagtcgcgcatactgtctgtaaggtttgtgtttctacatggctagactttgtaaggtttgtgtttctgctgtggctagactttgcttgattgtgatgagagtgcaaaccattgcaaaggtggaatactttctggaaggttagagtcatgaactcaaatgcctgaggggccagacaggtcaggtaagagggtgcatagaggcaaagaagaccactggtgactgtggcaaactggagcaagcatgacccatcctgcccattgctgcacggtaagggcagttcacagcagaataagacagccagagttgaaataagacagccagagtttttgtccaaaagcccagggccgaaagcaagctctccaaaaatcagttcactcaaaggctaatctgtgaattattgaagactttttgaagtttaaggtttttttacatctactcatgcctctgctcatgcccctgtatctgcctatgcccttgcattgcagcagcctgagggcactgttctagatggggtccaagatctttgtctgtcaagggtcaggcaaaaccaagaggaggagcaaaaatttctctgcagaaatccttgatttagtatgttcatgtgaattggctttagacacatacttgcttttcaacatcctctataagagatggagtccctggaaccagactttacagtttgtcaaacagcattgagaatccagacttaactagaagctttctaattttaaatgttggtcactaatccaaattattttgaaacagtggcgtatgaaagtttgaacactctgcagttagaaaaccactagacagaatcttttctgtaaaggttgtaggtttcagtacgggaaataagaaatagtggagagatttggataattataacactatctcatatttaacaccttatagtttacagagtacctttgaaaactctgcattagttaattttcacaataatcctatgaggttgctacagctggtgctaccattcccatttcacagagaaagtactagagagactgagtgttagaagacttggttatttggttattgacaggtttgcttgcttagtgctcagttaccatgtgcagcactttgcatacatgatctctttgatcctcaaaacaatgtagtatgggtgtcattttaaagactgaaaacatgtgatagcaactttaggtagcatttatctaccctcaccatagtggcagacttcagcataggttaaaggcagaccgtctcattttgtcttcctaacagctattctaggtgtaaactaggttctcttagaatcccaagttaaaggcggacaaagactggcccagagtcacacagccagttagttagtagtgggctttcaactctgagctgtctcttccaagccttttaccccatgatatggtgtgccaaggctctgcagtattgctcatgggccactcattagattaaagccagtgaaattgcttatgtttgacagtttatatcttctacaacagcaatttcatatggttcaatctaatattatctactttatctgcctccattcaatgttaaactaattttcagaaacaggaaaccattgtgaacaagtggattgttttgggttgtttgtaattgcattaacaaatctgctaatcatttattaacttaagaaagattttgaacttgaaaagtgagggtaggtacctaatggaaaatccacacatatttgtcaaagttaagtggaacttttattttccaagcacttattatttctgccataaatgcagatgttgaagttttcattgattttaaatgattaataattttatgaatgctacttcagtttaatggcactgaaactgagtgatatggttaggaaattatgcatataaaaattacgagggaggggttccacatctttcagtagaagtttcttatttatagacattggccttaatttaacatctgacttgaaaatgtacatgatgtcgtgatataataatgattaaggaatgaaaattaaattcattagagctttgtctctctcctttttttctcactatgcagattatttttaaaatagttaaccatcatactttcctaaacttcactaaagagtcttcagttaatgagaaagttaacagtttggcctagttacttacaccttcaatgaaggcatgagacatcctttgatacaaccactgtagaaatgcaagattaagtgcatttcttgtttgacacgtgctaatttcttctttgctcaagtgttagcccctaaagacacatgtggaatgcctttcttcaagctgattcgactcaattctagcgcctgtaagttggaaacctgaaagaagatttttgaagataaggatagattacttcctatgaaaacacttgaatgattgagttgagtataagccaccagaatgtgcgtatcaggtttctacctggcacccttcaaatttgaacgtgatgctctttcatgtactgcatttaaaaaaatgtgtatgttgagttttcctgctgatacagactattacactcctctcaaagaaagtgggtgtgtatctctataaattttgatgattcaaaaaacattttaaaaaattttaaaactttttatcttaaaaaagaaaccttattggccaggcatggtggctcatgcctgtaatgccagcattttgggaggctgaggcaggtggatcacctcaggtcaggagttccagaccaacctggccaacatggtgaaatcccgtctctactaaaaatacaaaaaagttagccaggcgtggtggtgcatgcctatagttccagctacttgggaggctgagactggagaatcgctcgaacctgggaggtgaaggttgcagtgagcccgagatcgtgccattgcactccagcctgggtgatgcagcaagactccatctcaaaaaaaaaaaaaaaaaagaaaccttatttataagaataaagcctgatagaagcaatttttttttttttgagataggatctagttctttcacccaggctggagtgcagtaccacgatctctgcttactgtatccttgacttcccaggcttaagaaatccttccctcttcagcacccccaagtagctgggactacaggagagtaccaccaagcctggctaatttttgtatattttttagagacaggattttaccatgttgcccaggctggtcttgaacttctgagctcatgtggttagcccgcctcagcctcccaatgtgctggtattagaggcatgatccactgtaccctgctgagaagcaaattctttattatctgtatgtctcacggagaccaggctattaccgtctccttttgtggttttttgtgttttttttttttttttggtgcttgtgtaataaaatgtgtttgttatgtaactatgtactgaggttagacaatggggttggatccttgggaagatacagtgtgtacaggatttattattatttacaaattctgttttactaagcatagaattacaaacattagttaggattgatccagcatctcagaatcatttcctgtcttcctggccttactctaaaagatgtgaagtggtaaatggatcgatggcattctaaggttgatgtcttttattatgtagccgctgaatattattgattatcaactgtgtttttcaaactttgatcttgatgaaccaccctttgtgattttgttcatatgagaacatgtattatttatttaatgttatctttaaaataactttaaaaaaatagcttactttttaacttttcaaaaggaaactcttattactaccatccctattatgtattcagctgattaatttcttattatataaaactgtctttttaaactttaagtgaaaaataagtcaattttttaaagtattgctttttttcttaaattctaaaggcaaactttatattggtatcataacttgccagtgagatttctctatggcaaattaaaaatatatgtatctattaaaataaaaaaattaaaatgtaaaaatctatttatgtacaagtgagagtcacatagcacactatagtgggacctaaatcaaactgggaaagagtggctgaaagtgaagatgggccactactggaagagtgacccatactgggtgccaccattgacacagggttttctgttaaagcttggcaagggttttttcctaccccgcatgactctgagagtcaagcctgccattcagctaaagaggcgccacgtggggtttactgtcctcctttttaaatattgccctggttccctcttgacgagtccccttattaagggaaagtgacctcaactttttaggcctgtaaggatgccggcagtaatgaattttttaatcttctgtgaggcttgctctaaattggattcagcattatgctggtgcgtatatgtaaaaagatgaccaattgatattcaaatgtaatgaggaggaaggtttactattcagcatagcctcctttgtttttagccctagtaggttgtttgcactaaaacaatacagctttcctcttcccatctgaaattactgtgtctagctggataggaaagatatcttttctaacccactccagaaataaaatacagtttgttctggttttctagtttaattttttttttaatgtgcctagagatttggatgtgaagtcttaaaaaaaaaacacaaagtattccttttgaaacatgcaaatgtgtctctccatcacctaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacaggtaaaggtcagatcatgttgccctcaatggacctggggaagggatgacgaggaggcttttgcatagagttttgaaaaggatgctgttctcaggagggattttgtagagtcgccaaaattcaaacttggaccacacagtgcttgcagaagagatggtcctttccctggtcttcttttcatgcccctttacaagaatattttaacttcatcagaataccttaaaggagctgggggtgaatgtatgaagaaggcaaacgagaaatcagcatggtttctttctcttcaaaatgatatatgtatataaatatctgtattttgttcattgattttttttggggggggtaacttgcagcatctctatcattatggctggttgctatgaagcaaaatatgagaatgtgttttatcagtttaatgtcagttgatgctgtatagaaggccagcagcatcctcttatatctttgaaagcagagatataatggaaggatattatgtgttcagttaacttacgcaaaattgctatatgccttaaaagggagaaagatggaaaagtaaaattctaacattatatctatatatgcattctatattatatagcctatgtattactgactatattatatatattttatctatattcagggctgtctacctccgagcttaggtatgttgtattttatgaagggattttcaaggacaaggcctttgggtaaggccatacaggctgagtactgcacaactccagggggtaccatttgcagggtatgatgtgtgttccctgaagggcaaagattgcagtgagccgagattgcaccactgcactctagtgtgggtgacagaacaagactctgtctcaaaaaatataaataaaaaaaaaaaaaaataataataataataataatgttgcgtgttccttgggttagtgcagtgacccagaagagctcaagaatattttttactatatgaagatttgaccttacatagtaactccaaatgtaacagctgagtaagataggagtaacttcagtctacagtgttgtggattagacgaacaccttgtttcttctgttgttattgtacttaaatattgcctttaatattttagagttatagccatgaataagttatccgttttcaacatatgagattatcctctcccatagtggccttttctcacattatcatactttggtcattgtttgattagcatcagctccaatgaaggtggagatgagtggactgttttcccctgtgctaccaactctaacagaatatttaggaaaagtttgttatttatgaatgctgtttgcaacctgtatgggcctcacttaggttttttaaaatttattagctaagctcagaggactaaaatttatcaaatggaaataaaattttttggatgagtttattgtcatagcagtaggatagccaaacatctgtgcaagaagtgttaggtaaagacagaggagatttgtttgttaccctggcttggctcttggtagttgtctttttagaaacattatgcctaactcatccatatgtaaaatgactcgctaggattggatcatgtctgagtttccccttttagctgtatgaatttgactccatgaaaatttctgttttctcaattagaatgggttaggccagtgcctgcccaatagttgtaatatctagaagaaatttgccaccttgtacctatgttttaattgaaatcagctgttttcattcatttaggaatctttcatctgtttatagtggcccttaccaaaatgaaaacagatcatgaaacatgttaacatttctttcaaaaaatctcatactttaatgccttgatattttgataaataagaatagcaaatcatggtataacctaaaccatagttgtggtcacagaaacagaagactttgggggtagtgtgcggcaaaacagttctgccaagcagattgggtggtccccaagaagcttgtgtgcctgtatttgtcctctatttattaaatagattttttggtagaaagaaggaacaaagtagaggtagtttactgtaagtctagatgcaatttcctgtttctaactactatcaatctctctctctagaagccatgcctcagaaaatctgacctcataaaatccccacttgaaatcctggcatcttagaacaacttgtgggcccagatcatcatggccaaaatcagtctgatgattagtttccacacaaaacagaaagccaagtgacacctgattgtgttcctcacgttcttgtctgataccaagaaggccaatagggtgcactgaggaaaaagtggccttgagatatgcacgtgatgggacctcttcacaatgtatggagcacgttgactgtcccctcacttacaacagtgtacctgcgacagctgacaatctgtcatacactaactcatgctaaatctttcaaataattaacactacccagtccataagtatgtgaaactagtggtatcaaagcattttgtgttctgaaccacattaaataggaatccaccagccagtttgcacgtaaagtgacagtggcataatgaggtgtcggcttctgcttgggccagctatgataaaggcatgagcatcatatcaaaatgtagaaatattatgaagccattaaatattatatttaccaggatatttttaataacttgctgctgtttctatcttagctgccttttgcttgagtgttttgaagaaggtatgtctcactaagacgcctaagtaacgttgggactgtgcagacaaaagatcaaggagcctattggccagaagcatctgggaaggcagcccacccctcctttctgcagtcattgattaaggcagaagctgaacagtgagcagtcatcccagatgctcaccatggaactgactgtgaacacaaagcaatgggacagtcttctacaaattgtgcccaaattattgacctaaaaagagcccttgagaaagaacacttcctatgtgggcttaatgaaggtagagttagactgttggccaaagcacagatatatacacaaacaaagacttttgcaaaaatattgtgtttattagagacaacttagaaagtgtgtaacaaggattacatgcctgtaatcccagcactttgggaaactgaggcgggcagatcacctgaggtcaggagttcaagaccagcctggccaacatgataaaactccatctctactaaaaatacaaaaattagctgagtatggtggtgggtgcctgtaatacaagctactcaggaggccaaggcaggagaatcacttgaaccccggaggcagaggttgcagtgagccgaggctgcaccattgtactccagcctgggtgacagagtgaaactccatctcaaaaaaaagaaagaagaaagaaaatgtgtaacaaatcaccacaactaaaaagtaacagattcattcatgaacacctctgagagacatcaaaacatttcttaatcatgtttctaggcttttttttttcccaataatccctgatattcttaaacattaggttgctgacacttcttttttgttggtagagagtgataaagcattgctttggaaagttaagagataatcatttctataagagctaatgtttctcaagtatggactatatggcaagcactttgctgagttctttatgcatataccagggaggtcaaataccttgtccagtatcgcaaaactggtgagggagggtcagagctgccactgcaacccagaaagtctgattccacagcctgagtgcacacctagtatgctatttgtgttttaaatcaagttcatcagctttatggagcctcagagatcatgattggttgtacacagtgggagatacacataaacctaaaagcatgtataatttaaaacgagcttcagaaatcttctttgacttggcttatgttgttgaagtcaccttgaaaagtccccaagagtgagtgagtgtgcatgtgtgtgtgtgtgtgtgtgtataaaagcttggaagcttctgatttactattaataaaaatgtcattcatgttcgtttctgttttacaaacgatttttatgtgtattccataaacctcctgaaaatcttgagagagaagcaatccatatattaacttcccagttttgcagatgagaaccctgaaggactgtgtacctgttacaccactgaacaatgggaaaaccaggttccctgtctccccattccatcttgttccagtattccattctacctgtcctctttggattcactggtaacctttagtaagaaagtggtggctgtgctcctaaatctttggtaaattaaatgaaaggtttttttgtttgtttgagacagggtctcgttctgtgacccaggctggagtgcagtggctcaatcacagctcactgcagcttcaacctcccaggttaaagtgattctcccacctcagcctccccagtaactgagactatggacacgtgccactacacccggctaatttttaattttttgtagatatgtggtctcactatgttgcctagactggtgtctaactcctgggctcaagcactcctccttcctcagcctcctaaatagctaggattacaggcacatgccaccatgcccaacaaaagatttttttgaaatcacagcatgtgtcagagtcaaaaccatgactaaggctgtgaattcttgagtctgccgtgtgtctgtgccagcagctcatttttggactttccattttctttcagagaatgagattcagattctgttgagctgagaagaagatatggaaagcatataaaataaaaacaaatacttggataatttaaagtaagatctcgttgctgaagggatttttttttttcctccaggaaattaaaattactaagagattttcccagagagctaatattccatcttcacgcattgtctgggaacattggcaggactttttttttttttttttttttgtaaacatgtagacactcagcgttaaattgagtgcatctcatttcatatgtagtggcactacccttttcctgttatatccagtttctattaaaataggttaattaaaattttcaaatgaaattattctttctccttatcatcctaacagtttactgcctcctaattgaaaaggctgtcaccgagtttggacagttgtagttgcaataagaggtctcagtcccaagcacccattgagcatgccccaggtgccaggcactttgcatgtgttaattctgttcttatgccatgtacattatgcccattttacagatcgagaaatatgtgctcagaaagttaaagccacacagctagaagcagacaagactataatctgtggtttgatgttataacctatccttcttctacctatttgtaatgtatttgcaggctgggggacaggtctggcctgaagacaaaattaatcataattttgatgaagatagaggtacttttgctgctggcaactacctactatggctcactatgtgctagacactattctaagcgccttatccatttaatcctccccacaaccccgtgaagtagagattgtttttgtccccattttccagataagcaagtgaaggcacacaaggttaagtactttgcccacatcagtaaatggtaaagccaggattcaaactcggatagtgtggctccagggtcagtgtccgtaatcatgacctttcatttttcactgatgtcatactgcattattttttaaagaaattaagattgaaaacttgggagattttacataaaaatacagatttccaacttgtcttgaaaaatcagaagtttggcaaccccaagtccactctcctccagggcacaaactgtctggcactgagtgcccagctcccttcagcctagacccactctctacacgtctcatttgcatctctggcctggcactggtgcacggaggagtgtgtagccagagactgcaccactctctgctcattggcggcagggcaacacctgtcctaagagctggaggtcctggtgattctggaaaatgacaggttcaaaccaagaagcaggtagagtaattcccaactgaaattagaactttttaaacaattggttttctacatcattttttcttttagttcatgggagaactcttagtgtctttgtctttaaaatgtagttattataccacctgaatattcatcacctgggtacttaaaaagtgtacattttggaaccttaccccaaacctgtttcctggaggacagagccagaaatatgcattttaacaatctctccaggtgattcttttatgcacttaagtgtgaaaagtctaccttccaaagatatgccagaaatgaatctttgttggcttctagagaattaaaggtgactcctttaattcttgccgggttttgaatttattttgttattgattagtaatttctaaatttttcttctatgttggcctaattcctttctgttcccttacttatagttgatctattaatctgcactcttgggtgcaagttgcaaaactaactcaaattggtttaagcaggaaagtgaatttgggggttcaagcaaacaaaatgagggacatccttgatttcaagtatgaaatcagagatcagaggctcagtcagtgatattagatgactttcttcatctttcacctctcctttcctctgtgtggacttaattctctggcaggtcatgtcaagctttgtcaagatggctccagcacctgcagcatgagaacctattagcaaacaggctccagcctcaagcgaccacctctggcttcatggttccagtaaatcttccatgtctgacattcaaattgtttgccttagatcatgtacctattcctgacctaataacaaagacaaaaatgatagaatactcctgattggcaaggagtatgatgtagagccaggagtaggtcccgtcctggaccatgtggacctggagtggggaggggcaccacaaggatacctgagtggtgctagcaggagaagagcaaatagatgcagggctgggaatacctacaggcagcctcctcaagggtggtagattattggtggtggtggtgttagtttagtaggcttggcatgtcttccatccagctttcagattacctttactctcatgtgtgtcattgggagcttctcatcagagaaagctttgaaaacagccttttatcattcttcactctgtttttgctaaatcagaaatgtctacagaattactgtgggacatagaaattcactacataccctgattattcagttttaaagccctgtggagattgacatttaatatcatcggcctctataaaaattcaaccagaatgtcaataatgccattcggggatactttgatgacatcacccctgatgtttctagttaataagaaggcaaggagactcaagtatttcgagccttcttttaagactcaagtcatatcagtccacccacatgatactgttctgggggtaactcttggttttcacaggaacataactttttcaaaagaggttccaatctgactcactggtatagctctctccatattctaaacttttgtatacgtttcagcttaattaaccattctttgatctttgccagtgtctaccaaaaatatttatacaaatataaaaataacttataaaatcgtttatacaagagtggacagtaatgccactgtgtctgtgttttcaccctggatacttttttgtgcccaaacatcttctgactaatgaaatcaaatgatacctatggaatgagggtgcagatccatctgtgttttgatggccttcttagtttaagagtttgagtcatgaattggtttcttctttgacatttccaagattgtgagcaatgcattacttgggattttttcccccttctttttaagtaaaataaatttcattgatcatttcgatgctttctaattaaggcacagacatctaaatgaaatcgaagtaatagttaatggccaggaattaggaaaggataagagcatttaagaatatagatgtgtatagttgcatacttcccgggtatggggtatgattgctgaataccattttttttttttctctctctctctctctcacctcttcacatgattaagcagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagagtaaagtataccattatttctacctaaatctctctctctttcttttcccttccttccctctgtctagcagttgccaatgtaaattacatttaagggattgatcacccactgatggtattttttaataaggtttaataagttttgcataaaaaggtaattaattattaccaacttatcgattctcaacagtttgaggaagcataaggttaatcatttccctaaaggtttagacaactaaattatggtatatagaaattatgacataatattcaaagagcatatttaaccattaaaaataaatatatttttatatatttaaatattttaataaatatttaaatatatttataaatatttaaatatatttaaaaataaatatattaaaaataaatatattgcttttttttcttaattgaactacagtgtccttattgttttaagacttcttcatatattctggatataattcctttatcatatatgtgatttgtatgcattttctctaagtctggcttttctgttcattgtctccatcaaaatcttaattttgataaagtctcatttatcagttttctttttagtcaattgtgcttttgctgtagtagctaggaaatctttgcctaacacagagtcgtaaatattttcattttttacattttgtgtttaggtctgtaatgcgcaagttaatatttttccatggtgcaaggtgtatgaattaggtttgagaacagagagacaggaaagtctttcagatttataaaatgtaaatactagcttttctgaaaaggaaaaaaaaaagccgacatttgaaaccattctggaaaatctaagataatgtggttttcctaaccaacagtagtcagtttttaaatgcagtattttgactttattatcctatcattgagattcaccatgttttaatgtaccactgagaaagaaaaagaaaatggctgattaaattaaaaaaaaataccacagattcatctgttatactcgtatagattgaaactgatctactgttaagtcaacaataacgaaggggaggacattgcagaaaactatgagaaggatctcaattttgcaaattatacatgtatacacacatatcctacatctattctctgtgagcatttgtttctgttaatatgtagatcaagttctaggcacagaaagttctagaagtatctattaacagttgggtttgagttaagtaaataacttactttctaaccacatttttcattgatatgcgttgtgaattttttatactttgtgtgtgtgtgtatacacacatttatttatttatttatttatttatttatttatttatttatttatttattgtttcccttcctgagatggggcctcactgtattgcctgggctagagtgcagtagcatgatcatagctcactgcagcctctatctcccaggcttaagtgatcctcctgcctcagcctcccaaagcgctgggattacaggtgtgagtcaccaagcatgacatacttagcatatgttttataattagaaaaaacaatgaaaattaggtagtatgatttttctaaacatatgagagttagagaaaaggcttggaactcagaacaccctctttgacagccgggtgcagtggctcacgcctgtaatctcagcattttgggaggccaaggcaggcagatcacctgaagtcatgaactctagaccagcctggccaacatggcgaaactccatctctatttaaaaatacaaaaattagccaggtatggtggtgcatgcctatagtcccagccacttgagaggctgaggcaagagaatcacttgaacctgggaggtggaggttgcagtgagccgagattgcaccactgcacagcttgggtaacagagcaagactctgtctcaaaaaaaaaaaaaaaaaaaaaaaaaaagaataccctctttgagaatctacgcgggaagagttctgagataagtgaaatagagcttctgtgctattttccagccagagagaggggacaacccatgtttctgtcttcatgttaatgacaaatgctttttaaagataaggataaaagaagcagtcttttcttgagagtcaagaagtgtattagttaagagctcaactaaagggtcatgttgtttccatcatttacaagttatttgaccttaggaacttgagtttacttcttgcatctcagctttctatacatatatataaaaagaggacttgaatattatgaattgtacctaccttgtcagactgttgtaagaattagaggagatagagaagctaaagttcttgggctagtagtaattagtgatcactattgttattgttaccattttcatcatcattatctgtggttattctgaggagtttaaacattgttataaaaatggataccaaccataaactcaggattttttacttagcttttgcattaaattgccttcgaaattatgtcacattagtaaagaagaattacgctgagaaaagggaaggataataggtgttcctggtacagaataatctgtgaaactcagattcttagaaaagaatgtaccagtaattttgttcaagactgacttgatatattggaaaaagggaaggtggatatcttgatggttagcaggatgctggcctcctaaactatggctggcttacaagagaatgtagtgatttgcctactttttataacttaggttttagctgatgtgaagccaatgtttcatttacctaaggtttagtagaaaacttatacaaaaatgtggctaatgataattatgggatttgggctgcaactatcaaatttcatatatattaagtgattagatacatatcatttatattttagcctaaattatatatacttgttactttgttttcatgtgtttttcattccgaaacacttctttttaggatatcttccattgaatagcaaattaaaccgcattagaaccagatctaccttgtttatgcatgtacgtgtatgtacactcacatgcaaatatatacacatttgttttatagtttttgggaagttgaagaaatagtagaaatttaaaagaacattaaaaaatcaagcatggatttataaacctttggcattgtatagaaaacaaacataagaagactttgaaaggaagagcaaataagacagactggctagggagcatgggatcaaaggaatactaggtggtgagttccctttctgttttactccatttatccagacttaaagctaaagagccagcaacccagaaatgcctacagatagaggcaaataaagccctgataaaagcgtgctctctctagccaaaggatcaggaaaggggcatcctacaagacagaaaacttttatccaacaaccattctactccagcaacagtgcagaaaaacctgtggtcctacgccccaagggtagaagcttgacaggctgtgggactaggagctgaaacctccctgctgggtggcgtcagaaaaggccaagtgtagagctggcactttgcatccaggcagtaaggaaattccccttatttccacatagatttagtggagaccacttgagggaactcaggacttccaccccacctggcagtaatgaaacaccctcttcctccccactggtgtggtgtcagaggaggtttagaggagaatcaggatttttacccccatccaatggtgaagagcccaccctctccctgtggagtcagagaggccagcttgggagcaatagtgagatagtcctacccctcccagcctagctggtatcaacaaaggcctggtggggagctcaagccactatccccacccagcggtaagaaggagcccattcccctctccggtgtcaacaaaagccaaatggagaccccacctaaaagtaacagatagccccctttcctcttttcggccatattaggaaaagcccatagaaggtttaagatccagacccctataatgtaataccaaaaaatccatgttaataaaaaaaatcacttattatcctaagaatcaggaagatatcaaaatgagtgaaaaaaggcaatgagtagatactaacacagcgataacagcactgttagaattacctaacagattttaacgcagccatcataaaattacttcagcaagcagttataccatgcttaagccaagtagaaaattagaatgtttcagccaaaaatagaaagtctcagcaaagccatagatgatttaaaaaaagtagaaaattttcaactgaaaaatacagtagccaaaacaaaaagcttagtagatggattcaacagcagaagagagtggggagaggagagaatcagtggacctgaaaatagaaattacccaataagaacaatagagagaaaatcaactgggggaagaaaaccaaccaaccaacaaacagagcttcaggggcatttggaacagtaacaaaagatctaacatttatttcattggagtcccaggggaatagaaagtgggtaggactgaaaagaaaagtacttgaagaactaatggttgaaaattttctgaatttggcaaaagaaataaacctacagattcaataagctggctgaatccaaagaaaactacagcaagacacattcatagtcaaatttttgaaaactaaaaccagaaaaaggttgaaagcgatgagaaatgacaccctatgtatgttagtgaaacaagtaaaatgacagcatatttgtcatcagaaacaacaaaggccgaaaggaagtggcatagcatttttctagtgctgaaagaaaagaagaattaacccaaaattctacatccagtgaaaataacctttaggaatcaagggaaaatgaaaatattcttagacgaaagaaaactaagaaaatttgctgccagcaggcctactctcaataaatggccaatggatgttctctaaacaaaaagagaattctaaaacaataccaaaattctaaaaaaaaaaacaaccaacaaaaacaatgaggaaaagagaagaatggagaaagtaaaactatagataaataaaatacttttcttcatcttttgagttttcttttttcccatttttattgagatataattggcatctctttaaattttccaaattaggtttgagtgttgaagcaataatagtactgtttaatgtttctaaatgtgtgtagagagaatatttaaggtaattcattataagtgagggagggtaaaagaatatcaatggagataaggtttatctacttcagtcaaagcggtaaaatgatgatgccagtagactataagatatataaaatatatttatagattatatatatatatatataaaatgtgtgcatatatatgtaatgtagtacctaaagcagccacttaaaagctatacaaaggagatatactcaacagtactgtagatatataaaaacagaattctaaaatattcatgtaacccacagaaaaataaaacagaggaaagaaaaacagaacaaaaagaaaattacaaacaaaatggaagacttaagccctaacatatcaataactacatttaataaagtgaactaaatacagcactttaacgatggggaatggcaaagtgaattaaaaagcatgacctaattgtgtgctatctatgacgcatgatttcaaatgtagcaatataggtatgttgaaagtaaaggatggaaaaatatatcttgtaaatgttaatcgaaagaagcaagagttgacatattaatgtcagatacagtaggaaaatctccaatgaattagaagcaaactaaacaacatacttttaaataatctatgggtcaaagaggaagtctcaagggaaattaaagataagcaaataaattgaactgaatgaaaatgtaaatacagcacattaaaataggtgggacacagccaaggcagtgatgagaggtaaatttacagcactaaacatatatatgagaaaagaggaaaagtctcaaattaacaatctaaactcccagtgcaagaacctgggaagagaagaataacttaagctcaaaaagatggaaggaaataataaaggtaagaggagaaattgtcaagagctgaaaaacaatagataaaaatcaatgaaagaaatagctgattcttcaaaaggattaaaaaaattgaagaacctctaataagattgacaaagaaaaaaatgagagcagaccaaattgtcaatattaggaattaagtaaggagtcactatggaccctaaagtcattcaagataataagaggtggagattcctcctctctggccagggcatccctgaaagagagaagaatagaataaacacaataaaaaatgataaaggggatatcaccactgatcctacagaaatacaaactaccatcagagaatagtataaatacctctatgcaaataaactagaaaatctagaagaaatggataaattcctggacacatacacccacccaagactaaaccaggaagaagttgcatccctgaatagaccaataacaagttctgaaattgaggcagtaattaataacctaccaaccaaaaaaagcccagaaccagatggattcacagccaaatactaccagagttatacagaggagctggtaccattctttctgaaactattccaagcaatagaaaaagagggtctccaccctaactctttgtgaggccagcatcatcctgataccaaaacctggcagacacacacacacacacacacacacacacacacacacacacatttcaggccaatatccctgatgaacatcgatgtgaaaatccttaataaaatactggcaaaccgaatccagcagcactttaaaaagcttatccaccacgatcaagtcagcttcatccctgggctgcaaggctggttcaacatatgcaaatcaataaacataatccatcacataaacagaaccaatgacaaaaaccacatgattatctcaacagtttcagaaaaggccttcaataatattcaacaccctttcatggtaaaaacactcaataaactaggtattgttggaacatatctcaaaatgagaagagctatttatgacaaacccacagccaatatcatactgaatgggcaaaagctggaagcattcccgttgaaactggcacaagacaaggataccctctcttaccacctggaagttctggctagggcaatcaggcaagagaaagaaataaagcatattcagataggaagagaggaagtcaaattatctctgtttgcagatgacatgattatatatttagaaaaccccatcatctcagcctaaaaactccttaagctggtaaacaatttcaggaaagtttcaggctacaaaatcaatgtgcaaaaaatcacaagcattcctatacaccaatagtagacaaacagagagccaaatcatgagtgaactcccattcacaatggctacaaagagaataaaatacccaggaatacaacttacaagggatgtgaagcagctcttcaaggagaactacgcaccactgctcaaggagataagagaggacacaaataaatggaaaaacattccatgctcatggataggaagaattaatattgtgaaaatggccatactgcccaaagtaatttatagattcaatgctatccccatcaagctaccattgactttcttcacagaattagaaaaaactactttaaatttcatatagaaccagaaaaagagcatgtagccaagacaatcctaagcaaaaagaacaaagctggaggcatcatgctatctgactttaaactatactacaaggctacagtaaccgaaacagcatagtatcagtagcaaaacagatatatagaccaatggaacagaacagaggcctcagaaataacaccacacatctacaaccatatgatctttgacaaacctgacaaaaacaagcaatggggaaaggattccctatttaataaatggtgttggaaaaactggctagccatatgcagaaaactgaaactggatctcttacttacaccttatacaaaaattaactcaagatggattaaagacttaaacataagacctaaaaccataaaaaccctagaagaaaatctaggcaatacctttccggacataggcatgggcaaagacttcgtgtctaaaacaccaaaagcaatggcaacaaaagccaaaattgacaaatgggatctagttaagctaaagagcttctgcacagcaaaagaaactatcatcatagtgaatgggcaacctacagaatgggagaacatgtttggaatctatccattcaaagggctaacatccagcatctacaaggaacttaaacaaatttacaagaaaaaaacaaccctatcaaaaagtgggcaaaggatatgaacagacacttttcaaaagannnnnnnnnnnnnnnnnnnnaaacattgggaggccaagatgggcggatcatgaggtcaggagatcgagaccatcctgcctaacgtggtgaaacaccatctctactaaaaatacaaaaaactaggcgggtgtattggcacgagcctatagttccagctactcaggagactgaggcaggagaattgcttgaacctgggaggtggaggttgcagtgagccgagatcgtgtcactgcacaccagcctgggcgacagagcaagactccatcgcaataaataaataaataaataaataaaaagtcaagaaacaacagatgccagagagatgcttttacactgttggtgggagtgtaaattagttcaaccattgtggaagacagtgtggcaattcctccaggatatacaactagaaataccatttgacccagcaattccattactgggtatatacccaaaggattataaatcattctactataaatatacatgcacacgtatgtttattgcagccctattcacaatagcaaagacttggaaccaacccaaatgcccatcaatgatagactggataaagaaaatgtggcacatatataccatgtaatactatgcagccataagaaagaatgagttcatgtcctttgcagggacatggatgaagctggaaaccctcattctcagcaaactaatataggaacagaaaaccaaacaccccatgttctcacttataagtgggagttgaacaatgaggacatatgggcacagggaggggaacatcacacactaggggacctgttggagggtgttgggtaaggggaggcacagcattaggagtaatacctaatgtagatgacaggttgatgggtgcagcaaaccaccatggcacatgtatacctgtgtaacaaatctgcatgttctgcacatgtatccctgaacttaagtataatttttttaaaaaagaagaagaaataagtaatgcaagtagtattcccaggcttaaatgaggagtcactcatcacaaaaaaaaaagataatgagggatgaatttgtatatttaagaactcctgaaaaaggaatattgaactattacactatttctacataatgtcttccagaaaataaaagaggaagaacactctacagttatttttatgaagctaatattaccttgataacaaaactaaacacagtacaaaaaaggcataaatgcaaaaatctttaacaaaatttagtaagtagtaatcagcaatttcccatgatcaagtgggaattgttctagtgcttcaaggctttctcagtattcaaataaatcaatcagtgtaacccaccatgttaacaggctaaagaatcaatgctcatatgaatcgatgcagaaaaagcatttgacaaaattcagcagtcttcacatgggaaaataggaattaagggaaatttctttgacttgttaaagagcatctacagaaaaccaatggccaacgttatacttaatagtgaaaagatgaaatgccttccctgcaagtgtgaaaacaagccaaggatgtcagttgtccccactcttttttctttttttcttttttttcttgagacagggtctcactcctgttgcccatgttggagtgcagtggtgttaacgcagctcactgcagtcttaacttctctgagctcaggtgattctcccacctcagcctcccaagtagctgggactacaggtacatgccactacacccagctaattttttgtagtttttatagagacagggtttttctgtgttgcccaggctggtctccaactcctgggctcaagaaatctacctgcctcagccacccaaagtgctgagctgttcccgtggttattcaacatcatgctggaatttctagccagggttatagttcaagataaagaagtaaaagccatacagattgaaaaggaagaaataaaactactcctgtttgcagattatatggttatcttagtagaaaatcatgagaaacgtacaaagaaaattttataataagcgagttcagcaaggttgcaagataaaagataagcatataaatagcagttgtattccgtgttcatggattggaagaatcaatattgttaaaatgtccatactactcaaagaagtctacacattcaatgcaatccctatcaatataccaaagatattcctcacagaaatataaaaaacaattctaaaatttatatggaaccacgaaagacccagaatagccaaatatatcctgagtcaaagaataaaactggaggaagtacattacctgacttcaaataatagtacagagatgtagtaaccaaagcagcacagtactggcataaaagcagacacatagaccaatggaacagaatagagaaccagaaacaaatccatacatctacggtgaactcattttagacaaaggtgccaagcacacacattggggaaaggatggtctcttcaataaatggtgttgggaaaactggatatccatatacagatgaatgaaactatcccatatctctctccatatactaaagtcaaatcaaaatggattaaaggctttagtctaagacctccaactatgaaactaccgaaacaaaacattgaggaagctctccaggacatgagagtgggcaaagatttcttgagtaataccccataagcacaggcaaccaaagcaaaatggacaaatgggatcacatcaagttaaaaagcttctgcacagaaaaggaaacaaagtgaggagacaacccacagaatgggagaaaatatttgcaaactgtccatctgacaagggattaataacgagaatatatatagggagctcaagcaactctatggaaaaatctagtagtctgattgaaaaatgggggaaagatctgagtggacatttctcaaaagaagactccagatggcagacagatatgtgaaaaggtgctcaacatcactgatcatcagagaaatgcaaatcaaagctacaatgagttatcttaccccagttaaaatgggttttatccaaaagacaggcaataacaaatgctggcgaggatgtggagaaaaggaaaccttctcacactgttattgggaatgtaaattagtataatcactatgggaaacggtttgggggttcctccaaaaaaaaaaaacaaacaaacagaaaaactaaaaatagagctatcacatgatccagctaggtatgtacccatacctaaaggaaatcagtatattgaagagatacctgcactcccatgtttattgcaggactattcgccatagtcatgatttggaaacaacctgaatgttcatcaacagataaatggataaagaaagtggagtccatatacccaatgaagtactgttctgccataaaaaagaatgagaactagtcatttgcgacaacctttgtggaactggaggtcattatgttaagtgaaataagccaggcactgaaaggcaagcttcacatgttctcacttatttgtggaactaaaaattaaagcaattgaacccatggaggtagagtagaatgatggttaccagaggctgggaagggtggtggagtggtggtaaggggaagtggagatggttaatggctacaaaaaaatagaaagaatgaataagatttagtatttgatagcacagcagggtgactgtagtcaataataatgtaattgtacatttaaaaataattaaatgaatataattgaattgtttgtaacatagaataaatgcttgagggagatggtcacttcatttaccctgatgtgatcattacacattgtatgtctgtatcgaagtatcttctacacctcataaatatgtgcacctaccatgtacccacaaaaatttaaaatttaataaatagcaagtgtatatctatatactagaatacttggttaccaaaatcaaaaataaaatataatttaaggttgctcaaaaaaataatacaggtgtcaatctaacaaaccatatattggatcttatatactgtaaactataaaatgctaatgaaagaggtcaaagaagttccttataaatggagagatatacttaaacatgtacatgaatttttatagtaaatttgtccaaatagccaaaaactagaaatgatccagatgtctttgagtggttagacaggctgtgtgatacattaatttcatggaatactactcagcaatagaagaaattgattattgatatatacagcaatcttgatgagaattatgctgaggggaaaagccaatcataaagtattacatacaatgattccatttatataacattctttttaaaattatttttatttttattttattttgagacaatgtctcgtggacatacaggaagactcagaattgatagagatgtcagtgctccccaaatggatatacaggtttaatgtaatttctgtcaaaatctcagtctttttgtagatacagacaagtttattctaaaatataaatggaaaggcaaaggaaagagaatagctaaaacaattacaaaaaggaagaatgaagtcatagtaattagtctgcttgatatcaaatgtactaatttacatattgtgactttattatatagtcacaataataaagactgtgtgttattggtgaaggaatagactcataacctaatgggacagaaggcagaaccagagatagatccataagtgtgcccaactgattttttacaaaagcaattcaatttgaaagcattccaatggagggcagatagccttttcagtaaatggtccaagagcaagtggacgaccagaggcatgtaagctaacctccacctaaaccccacacttcataccaaaaaattaaccccaaataattcagactctgaaatgtaaaacataaaacaataaaacttttagggaaccaaaaaaccagaaaatttttgaaatacagggctaggcaaagagacatcaaaagcaagatccctgagaaagaaaaaatgataaatttgacatcattaaaatgaaaattttttgatttgtggaagagtctgatagaggatgaaaggacaaactacagagaaaacgtttacagactccacacctaaaaaaggactggtatgtagaatatacaaaggactctcaaaactccggagtgaaaaaaaaaaaatatcaaaccattcattgagaatgtgaactaaagagagggacagagggacagacatttcactgaaaagggtatatagatggaagatatgcacatgaaatattagttcagccctagggaaaaaattagttagctctagggaaatggaaatgaaaaccacaatgagatgtcatttgcttattaagatggctaaagtaaaaaatagtgacaacactaagtgatggtaaaaattcagtgaaactggatctctcatccattgctggtgggattgtctggcattctagaaaacagttcctaagaaactaagcatgcagctcataccatttggcaatgacacacgtgatcatttatcccagagaagtgaacacttaaattcacacaaaaacatgtacatgaatgtttataacaaatttgtccaaatagccaaaaactagaaatgatccagatgtctttgagtggttagacaggctgtgatacattcattccatggaatactactcagcaatgaaaagaattgattattgatatatacaacaatcttgatgagaattatgctgaggggaaaagccagtcataaagtaagacatacaatgattccatttacataacattctttttaaaattatttttatttttattttattttgagacagcatctcactctgtcgcccaggctagagtacagtggcacagtctctgctcactgcaacctctgcctcctgggctcaggtgatcctgctacctcagcctctccagtagctaggaccacaggtgcgcaccaccacacctggctagtgtgtgccaccacacctggctaatttttttgtatttttttgtagagatggcatttcaccacattgtccaggctggttttgaactcctgagctcaagcaatccacctggcttgacattccaaagtgctggagttacaggcatgtaccaccccgcccagcgctatataaccttcttgaaatgacaaaattatagaaatagaggacagattcgtagttaccagggattaagaagagggttggggggaatggttggaaggtaaccaggtgtgactataaaagagcaacgtgagggacccctgtgatgatgaaaatgttttgtatgttgactgtgtcagtatcagtatcctagttgtcacggtatactatagttttgcaggatgttattattgatgggttctaggtaaagggtgtgtgggatctctcttctttcttttaactgaatgtgaatctacagttatttttgttttaaacacagtttttttgttaatcctgcataatctcctctcctaacaatgatccttgttattatcttactgtgtaggagtagtgcagactgtggattctagtgcaaaactttctgggtttaattcccagttctgtgatgtctcagcagggtgtccttagacaaattgctttacctttctattatcagttttctcatttgtaatatggggagcaataattttaatgctaataatacttctctcatagggttattgtaagaacagattctggcagtcatacgtggtggtgatggtggtggttgctatattaccttttgttatttttattttaacacagttgatatgacgtgtatacattcgcagattctgtttttctcttaagccgtatggttttttttttttgacaattaataagatttgaatcaaaaataaaaaactttggcaaaccctcttccctgccaactcccaaatttacaaccgaaatgtcacagttcaaaaaaagttttaagttactgcctgaacttaatttttaaaaaaacttcttttttttttgtaaaacaagtattttattattattattattattattattattattattattattatactttcagttttagggtacatgtgcacaatgtgcaggttagttacatatgtatacatgtgccatgctggtgcgctgcacccactaacttgtcatctagcattaggaatatctcccaatgctatccctctccccctcccccaaccccacaacagtccccagagtgtgatgttccccttcctgtgtccatgtgttctcattgttcagttcccacctatgagtgagaatatgcggtgtttggttttttgttcttgcaatagtttactgagaatgatgatttccaatttgttttcatgtctagtttgtagccagaactactggactggagttgtttgccccacccacttagctgcatggtgccctgggggctcaagcagaactttgtcccagccactgctttgggaagcacaaaagctgaatgcttccaaccattctggtgacatttctaatatgattgaatggcgatatctttgggaatgtgtctctacactttcaaatctgcagggccccagtcaccatctgttgaaatacttcatctagaattgaactttatcccttaaaaggcagttgagtgacatgtttagcctctccaagcttatccttggtccagattctatttatgacgagtaatttggggctgccttcattatgtccaaagcataatttaggacattgtgatttaatgatgtgtattggtagttttgagtcatttatgtgaattaaggtagtttcatgctgtcatgagaattcttatgtaatataatgaatgaaatagcagccctctttgtgagtttcagcatccaagactcaagtcatagatatacttaaaataaatggaagttttctctgtggcaaatgcaaagcctaaaataatctagacaagggtagatggtatacgcaaggggtatcatttgtaacttatttttcaaaaataaaactggtattattttttaagctttcagtaattgaataatcatatgttaggtaagtaaaaagcctacctaagaccctccccaagccattttataactgtaaactcaggctctcttctggtttggatttgctgttggaaagcatctttgttgtagttaaggaagaaatattcaagagtgtgtaattccgtcattgggcttcttgcttttttttttttttttcaaacaaatttcttatttttgtttctggattgcagccataacacgaaaacaacatcttggttagaccctcggtgcctaaacaagcagcagaagccactggaagagtgtgaagatgatggtaaggggccaggcaggtcttgggttaagtgaattgggggcactgttcacatgtgcaaattttaaagagtcgtagccaggtcagtcgggtcttatgttgagtttttaaaaggtaatccaatttctgctaaatggactgtggtttacaaaagcaggaagaaagtcagagttgtttcaagagaagaatttgtttacacataaagacagatgcttactaatatctccattagaagcagaacagtcagaaactgttcaaatgaagatacgtcctctgtcttcaggaacttagagtaaattctagaaagtctctaggaataaagaaaccaaagacggtctggtcagtcacacattctcaggtttaaccctatcttataaaagtcttagggggaaaagttgggagtttttcttgaactgtacatatttcacatacttccctagtcttggaggtaggggaaacagatctagacatgtttgagaatctctgtgtaacttagagtatacccacaatatgtagtaagtgtattcttttgagacagaggttgaggtgttacctagagcaccactctccctgttaatcttggaaatgaactaactggctgtaagagcttttgttgaaaaagttcatttcaaggctttgggttttctaattacttctccaaaatgaaaaaaaaaaaaaattgaaacagagctagtgtgtcccttttcagtacaccaacgtctatcccaagttctaccaaaattattttttgatgtggaagaatgaaaagggaaatggtttgcttcgctctgctttgctactcattattcaattctggcatgtgaattagtagtataattattaaatatgtattttactgtaagataacagaactttattattcgtcctatagtgcagaatggttgtatatataaacttgaagattttttgaaaatgcaaggcagtattttatagtataatactgtgaaaaccttgcactccatgatccttctattatacatggtttgcagattacgttaaatgacatagactattgtgttggtatttatctgagttacttcaaatggaaacaaaagtccttctaacttaggaggcatgaccaagatgtttgttttatcttggttgctttgtttgattcctgaagaaggaatagaacaggttcattcagctctggtattttgcatgcttgggagataatagactatactgattatttcagtattctgtttaacatgtaatactggttaagtatccctgatcccaaaatttgaagtccaaaatgctccaaaactggccaggcatggtgtggctcatacctgtaatctcagcactttgggaggctgaggcaggaggatcacttgagccaaggagttcaagaccagcctgggcaatgtagtgagaccttgactctacaaataataaaacaaaaattagctaggcgtgttggcatgcgcctgtggtcccagctacttgggaggctgaggcagaaggatcacctgagcccaagagtaggaggctgcagagagctgtgattgtgccactacattccagccttggtgacagagagagaccctgtcttaaaagaaacaaacaaagcaacaacaggctccaaaatccaaaactttctgagtgtcaccatgatgctcagaggaaatgttcactggagcattttggatcttggattttcggattaggaatgctgagccagtaagtatattacacaagtatctccaatctgaaaatatgcaaaatctgaaacccttttgattctaaccattttggataatgactactcaacctgaacataaataaccagttttcaaagatcatagcataaaacacattcaaccctaaaatttcatggaacaataatcattatttgatgccttatgattttgaaagcaatttaggcacttattaccatagggtcttcaatgtcaatatcccttttgtaattattctgggaatgtatgaaaatgcttgttaatacaatattataagtgatagaatactgcaatagcttttactgagaaaaactgtacatagagtgaaagtattgaatggaattggcatttttgttaccaaatctagtaatttttaattcttaaaattcttatctttttgtgttaatgttatttcctttggaacaagaatgtattcataccaaatgcagttagtttataattatctctttaatattagaattcatatattctgtttctagtagaaattctatgtatatctgtgtgcctgtacacacaaacagtataaatatataatcagattatggtaagtatcagtttgcattttctgttgccagttaacgcaaagctgccttgttattatttataacacaaagcagaaaaacatattggttgcaaatattgtccctgtatttctttctgttctctgtaggtcatacatatgaggtgtaacagtatagcatcatacttaattattataaagatttaatatgttctatttcctatctcagaaaatcgagaaactggtttgagattttgatgttagtgaatgactccttctgtcactgctgtgtccagttcagttagaagccctcagtgttgcctttgaactccagaccaatattgtaatccatgtgattgataatgtcaacgattgtctcaaagatacttcgacttagtcgtattaaaaccattaaaactgatgatctttccccccaaattacgtaatatacaaagtgtttcctgtctccattcatggtaaatttatgcatactcaaaattcccccttgatatgtcacttttcttcacacctatttctaacccgtgaaccagctgaattcagttggcatcctaaatatctcttggatccattcactatttttttcaccgcatcttccattctcatctgggatcatgctcatctcccatacagactcttttcactctcctttttatgttgtactcggagaaatcttttaaaatgtaaatgtgatgatgttatcgctgacaacctccacagggtctgcttaggaaatgccaggtccatagcttgctactctgagccctgtgtggtcagcctctctaggttttctcacactatttctctgctctctgctcttcatccccactagtcctcattgagttcctgcctcatgtcagttaaatgtgcatttctctcttagaatacgcttacatttcactatactcttatatttcacaatagttattgaataatttctgtatgtcacgtgcatcctaggtattcgaatgtgtcaatgaatacaacagacattaaactttgcatatccttcaggttatacttcagggaatttttccatgactttgcccccaaaaatatgattaggtcactcatgtatcttactctgttgagaacttatcatggttttaattttagttttatttgtgtgagccttggatttgtctcctgttctggaaaagtagagatgtctgattctgttttttgagatggagtctcgccctgttacccaggctggagtgtggtggcatgatctctgctcactgcaacctttgcctccctgttcaagcgattctcctgcctcagcctcccgagtggctgggattacaggtgagcgccacctgcctgactaatttttttgtatttttaatagagtcggggtttcaccatgttggccaggctggtctcgaactcccaacctcaggtgatccacccactttggcctcccaaagtgctaggattacaggcatgagacaccacgcctggcccctgattgtgttcattttgatatgtcacctagcacagtgactggcacatcataggtcttgataaataactactgaagaagtgaacaaatgctcccaaagacattagataatatccaaatgggcattttcacagatgactttgtgtaaattagattctccttttaagaaacggtgccaatcaaaacttaccgctggcagtgggatcatttttttattattattatactttaagttctagggtatatatgcacaacgtgcaggtttgttacatatgtatacatgtgccatgttggtgtgctgcatccattaactcgtcatttacattaggtatttctcctaatgctatccctcctccctccccccaccccacaacaaatcaagagtttacaaggtgtctaggcccatgttggttatttaagtcaatcattgattgattggttcattcattcattcatcaagaaatatttagtacctaacatgtgcagaaggctacactgggcactgagcgtattgtggtactgaaaacaggctcaattcctgtgtttgtgaagcttataggagccacttgccctgaccctggggaaacattatgtatgaaatgatttttgtgtgttctcccatgttttcttctcaacaataagaaaatgttttactgacagcaagaggacgaggtcaagaacagaaaggatttggacttgttttgctccctgaaatttttgaggacattttaattctaatatttctgagctccttgacttagaaagtgtgtgtgtgtgtgtgtgtgtgtgtgtgtatgtgttttctcacaaaaccagttaaatgcctcccaacactccttcagggcagttttcaaggctttcttctttgatatattttatcttgacgtaattcatctttccagctcctttttgaaagacatcaaagttagctcattatacagtctgcactttcaatttgacctcaccttccatttttcaagcagcactgttacttgtaagttaaataatgctttaattgtgagtataattgcctcactgattagaggattattgaaggattaaaaggactgataatgaaaggtctaacagctttgtttactcccaataaggtctgtaataagtgacttcccacttaagaacattgaaaccgcaaaggtatttgtcatcttttacaaccaatcaaatcctattttgacatgcaaggaaatgagccatgtaattattttgccaatatcagctcttcccgttttgtgatttacactgaggtcgcaagtttactatccaagccaatgaaataagccacaatgcaggtaaggatgaactagagtgatgtgtttgctgctgttttcctgaggagatttcctttcttggtgctggtgtctgaattttgctttctctcttttctgtctcattcctgctattcctttggagaagaaggggtacacaccgaggagctggacagtgaactaggtaaaccctccctgcctgctgctgctgcatgacacgtgcatgacatggcctgcatggttttcttccccagtgaattgcttaatccctgtttctttagtttgcactcctccaattatgattttcattctagcttatccaggaaaggtcagtcttacaacctgcgtgtctgcctgcaggcatcacgcggagttgtagtacattatgtttacaaagaaaatgtctgactgaacagagactagaacgagagttagcaaattggtaatgggtagtcttgtaaagtgaggattgggaaagaaccgaagagatgctcgctgtgtcccttgaactttggcataacctgtctcagtcttatttctttatttgtttagtacggatggttatttgggtaatacaaaaaagccaagcaggacaaacaaaaatcaattaagactagtttaaggaacattataggagcacttgcaataaaagaaggtcactgaggaattgaatagttaagtcttaggattgtgttgttattacgtcccagaccacgtgttgttgaccttgccattgtagtgagtggttgtttatatagtgatgcagcatctgtatgtactgtttgccttagagttgtgtcaatgcaaatcaagtcttgactactctagttattgttgtttaggaataatttatactagcagatgatgccaaattcttgtttctttgctattggaatatattgaattacgtttgctattacgttcagtcctttatgttcaaccttgaacaacattaaaattagtttgcattccgtctgatacatttgctgatggatacataggaaagcataagtttcagctaaattgctgatgaaagcctcggctgatggaagattctttagcaattgaagattgtttaagtagaagattgtttaacatcagtatgagtggaactgtactaagattattgaatctgcctggcatttttgagattgcctaaagacctgaaaatataagtctatttagtatagattattgcattcatttggttttctttatttttgttacgtgagataaagataatcagtcatggttggctagaattatgatagaatagaaccaagctctgtttttcttaacatttggaacctgtctgttgtaattgatgcacatgccaacaatggtcaataactattgatggatctatttttaaagatgtttaataagttgtctttgtgttcattgtgagagggatgacttaaggttcaccctgaatgatagaacaatttgaaactaatttgatcgaaaaaagaatttgtcaatccaatgatattagataaagtaaatgaaagagacagaaataggttttccagacacaaaatgagtgtcttaatcatttgttcagccaatttcaaccactcttgctacctaagtaataggtgtgacagatcactctgctgtctgctggcagccagtggagatagcacaaccttatttgcttctctggaaatttgaatttgaaattttcaggaaagaagtttctgcattttacccacatgtaactgtgatatcgtggtgacttgcttgtgctgttaaagactctaaacatgagttctcttggctttctctgggttcagatcaaactgtgtggctcccctgcttactggctatgcaaacttagacaagctattcaccttcttttagcttccctttccttatccataaagaggggccaaaagagtagctcccatggtgcttatgaggtgacttaatgaaagcgtgttttaatatttgtccctgtgatcagcacattctattagctatttgcagtgttgttatttattacctaattccctcttcttggatttttcagtactttcttatggtacttttttccattaacacagcacaagggaggaatgtgttctatattatagaaatggcccaaatgtgttcttgtaggaagggtagagataaaacctttgatttttgcctgcacatgtccactgtgtaaagagtagcacacgtgcacacacactgttttctgttgcattcactccagattctgttgacaagctcactgctcattttcttaataagagggtcctaatttcaaacaatagcaactgtcaggttttcagtgaacaatgtaattccagatgtgacaaggaaaccctctttgtaatcggcctctgagaggcgtgggcagttggcttgggtattggacacagatcatttgattatagagttgtcatttctgaactctgttgtttgagctgggtcagttgctccattatgtactttggtttgcagaatttatcacgtcctctgcagacatctccccagaattaaaaagcacctgcagaaccttcttttggaattatagggtatccatgtggtgaaaccaactaggggagatagagccaagaaagtaagttctcctcccacccaaaactaagtcacagttttgaaatgtatctctgattttgaacatgattttcaatctatatacagagaaatctctttgaaaagaacttagaacctttgactgctcaatgtttgctctttggagacaaaatagtgcagcatgagattttcagaggcaggagtagcaagtacacaggccacagacatctgtcctattccttttgtgctttcctggaacagctgccatttgttggacactttctatgtgccaggaactgtgctaagtgttcagaagtatctttgtttaatccaccattgacttttgaggtaaatccaggagaaagatgtggttcagagatgttaagtaagtagcccaaggccacagagtagtagagataaatgaaagaattaaggctcaatcttatatctgggcaatgccaaaaggatcttagccacttcaaatctctgtgataggttgtactgtctaatctgctccctgactgtggttagtcatacgaggattcctttttaagagtctttagagtgtttgcttaaaaaattataatgtcattctggacttaaatattttctgcctttttcagtcttttagaaccaaatggcaaattctaggacaaccatcttcctatttaaaatcgatgacccatttctattttaagcattaggagactaatttctatgattaagttaatgaccacattggaagtgagaaactatcttttcaatttctggagtttgctcatctgttccaaaagatgtgtttaaactgacaaatgtccagatatgccagttgactggacccatttttcaactctagaatattaagttgttgactaggcactagaaaagaagtcacgggtaccttcttttctagtaccctcctcggccctccatcaaagcacataccacgtggctgaattttctgcttagatgatgcacttgcgtttgtctttgtgtccctggtgcctaacacaccctcgggcaaaaagtaggcattcaacaaatgtttgtcaaattaataactgagtaacttaaaagcttagtatttcccctgttttatctaaagataatcaggccacatatctcagtttgcagattttgaaaagagatggcgtttctataaacttaatgcggtctcctcacatccacccacccttctgccctatacaaatgtatgactgtgcaccaatttgcatttttttaatcttcgatttcccaactctttggtaatattttgcctggttcattttcatttaaatggtaatttccagnnnnnnnnnnnnnnnnnnnncatttcctaggcattcaatttgcatcggtccgcagtactcagtatatacaaatgccaagttgtatcaacatctgcaaattggacctgtcttgcattttagtagcttatgtctcctacaagtcaaagacttctttaaaacttgctaaatgttttttctttttgatttagaagaaaaggggggaaaacctgtctctttgtttgcaaacaagtaacatgtggagcaaaaactatgaaattaatgtctcttgatgtgcagccaaatctgaacaaaacataaactttgagtaattagcctgtatgtgtttgtgtgcatgtgcatgcctctacctcagtctggaactgtttgtggtatatgtaagccttctgccctgatgacatcattatttaaattagtgaccacatgattccttgaattaaacaaaaatctatttcaaatatttcaagtttgtagtattctatcaaagttggtcttaatagctacttctaggactaattattcactttagagtgtggtgttacataagtttgccttgactacgtgtatcagggaagctttaaaattaagttgaataactgttgttctgcctgaaaggattgtttaatgacaaaaaaaacccacaacctagtcccttctttcaccaagtaaaataatatggtgcagtgggcctttccacaacagattcttgttcagacagaactattacctgtttaataaagttttggcctttgatatgaaaccttaggaagttctgtagagcatggttgagttttcagaaaggcacatacatcccccagtgccattgtaccaccacatttaaagaaataaaatcatccgccttagatagtgagctcttagggatcaggagctgtgttactgctttcacaggttaagtgctgagaaagatgggccagcccagagatagcaattgagtgatagttgtgtgcagttcaaaaacccaactgcattttcattaggaacaaggagaagataacatgcagattttattttatttcaaggagagcaaagcaacactattgtactgaaaatgaaacattaattttcatccatttttgcttgtgtaataagatggcctaggaacaaaatgagaaaaccgtaaacatttaagataggaactaggcattcaaggcaagtttaacctatattttcactaaaatctaatttaatagtgatttagaataaaggctgcattttgttaagttttattttcttgcataaaataccagtagataaagaaatgctgttcatgtagaaaaatacacttataaaataatagatacttttttttttttggttaggatatacagttttaattggatttaaagcatttttatgagtctttctctttttgcctaactcagttgttgaaaacacccaggctcttcaagaatatgctcttcttgccctaaatgttcttttatttttcagaactgcctgctggttgggaaaagattgaagaccctgtctatggtatctactatgtagagtaagtgcccattcacaatccacacattagtttatacctctctataattatgtacatttgtgttaagtacagcctgacatcattataaggcacaaaccaattaacaatattaattttatgatgaaaatatgtatgcatatattaatgaatgagaaaatattcaataaatctgaaaatagcaaatcatattattaaattcacatgggcaggatccatgtcttttgttcaccactgcatcacaaaggcccaacatcgtcctggtatatggcaggtacttaatgagtattagttgaatgaatgaatgaatgagaaaagccaggattcagtagaccagatgaagagggattgtttatctttacaaggagtatctgattcgtctactttttgctctacccagatctgaactccttagcaattacttctttattcattcatacatttcaaaaggttcagccacggtaatttatgaaatgttgccaggattgaggagaaaatggagaactagcctaggatgcagactttgtgtgtttctttgtttctctcttgcctgaggttctggtttcccatttttaaaagtctaaaaccctcgtgactttactgtgtgccttattctagcattgggctcccactttttcctttcatcaaaactgttgatggataggatgatattaaaagaaacccaaggttaggacattgaaaaaaaaaaaaaagctttgtattatgtagtttcctcagagaaaaatgagaggtaactaataaaagtcccttcaaaagaagcaaatgccatataaatgttgtagaaacataatcgtacctgccacactgaagatgtaactgtcatattttctttcctttatgctgctggtgatgaaaagtcatttgtataataccctggtgatatgaacacaagatgaaaaaagtgccaggccataaaatagatgcccagcatcttactgtagaaattatgagttcaatatagcaagtgtccttggccagtactaacttttacctccactttgcctaacaagagggattggtaatatggggcatcagagaggcaaacttggctgcccctctgaccctcagaaaataaatttcttttgtgtgccccaaagatcatctttctcacagatgtactgtggggtttttgctatttgaagctcattttgaattgtccctcaactagtttatgcattaagagagagcaggaacagatgacaaaagcttttatgggtgaagacactagtttgaggggcaagttattatcttaccacacacttctccatctgtcttttcagattcatgtgcctgttaatggtagaccatttcttagaatgaaattgctacaagaattaggaaataaacatgtaggcctttaatagaaattaagagcaatcagtctatcctttctattgataagcctgcttaaaaaaataaagcctagctttttaaaaaacttagagttctaaataatcacaatactatgctcctaaatttctaataaactattattttgaattaagaaaaataagttcaggcatggtggctcatgcctgtaatcacagcatttggggagaccaaagcaggtggatcacttgaggtcaggagttcgagaccagcctggcctacatggtgaaacgccatttctactgaaaatacaaaaattagccgggtatggtgatgcacgcttgtaatcccagctactcaggaggctgaggcaggagaattggttgaacccaggaggcagaagttgcagtgagccaagatcgcaccactgcactccagcctgggtgacagagagagactgtctcaaaaaacaataaataatgtatatttatacgtatatgcttgtgtgtgtatatatgtgtgtgtgtgtatatatatacacacatatatgtaccatatatatgtacatatatgtgtatacatatatatgtatatatgtatatgtatacatgtacacatatacatatgtatacatatatatgtgtatatatataattagttttgtagccgtctaagtgtttggatctttgtcattttgagcacatcacatctacttaggttaactttatttggattctctctgcctaaggcctgtacttttaattgtgcctctatgtttagtgatcaaaatagttaacagatgtgagtggaattctttgtttaacttcattgtttggatgaatgcttttgtttctgtgaaccctactgcagacagttacacagcagttctggcattgtatgttacagacaatgtcacatagccactttaatcttatgtctcaataattccttaatctacttcttattgaattaaagcagcttcccctgtcaggtggtatcttggacatttggagtggggtcagtggttaaaatcctgggatttgaaagcagacaaccctgagcttgcatgcctgtttcctgcttactagctatattatgctaggtgaggtatttaactgcccagacacttactttccttattcataagatatgaataaaaataggacttacctcctggcatttactgaggacttttaaataaaatgcatataaaactggtagcccagtgcttagtgcatataagcagtcagtaatggaaacttcatttttatttcctctttctaactgagcattttaacacacgagggttagcatctcagaccacctgctctgctcagtttgattccagggacttggtctgattggcattttgctggtgggatgaactgtttcaagctgaatactatttgctatcttccccagccacatcaacaggaagacacaatatgagaacccggttctagaagccaaacggaagaagcagcttgagcagcagcagcagcagcaacagcagcagcaacagcagcagcagcagcagcagcagcagcagacagaaggttggcctctttcctctaggctttttcttgatcaggggagcatggggtgaaatctgagcgctgacaccctcgtgtggtcagaactggcctcgatgattgagtcctctcttgccacactgaagagctgatgtcctgtggggaggaagagaaccccctctccgtgttcctctggatggccaaagtggagatcctaattcaaagtcactcaaatctccattttaatttagaaaggagcatcattagatcagagaactttctgatgggggaggaaatctcttgcccccgcagtatttgcattgcaactggtagctaaatccaaaccacttttagcatttttactttaagtggagttactgggcatgaaactaacttttaattttaggaatattacatgtaaagaatcagaaagagctggtagttttgggtgcttttaaaaattacagactaattcatgctctttgtaaaaatatgggcaattcgggagtatagaacattaaattctcccctggttgcccccttcgcattctcagagataagccctgtgcagaaattttctagggatatacatatacgcatattttaacaaaaatctgataataatttatacgtatatagtatgtatgtgagacctgttttctcactttttatttcttgcacatattactaagttggctaatatagatttagcttatactttttaatggtgacataatattccatttcatgaatgcctctgctttatttagccatttgtttattactagatactccggctttccccagtttttcattgtgatcttttagaatcataggcttaatactcccatcaatataatatgtgaatatcaaatagaatatcaagtataatgcttctgttactataatattgaatataacaaatgtaaaccatagactacaggttggcaaactttttctctaaacagccagataataaagattttaggcttcgtgattcaaacagtcaatctctgttagaactactcacctcagccattgtagtatgcaaatagctgtagacattatgtaaatgaataggtgtagctgtgttcaaataaaactttatgggcactgtaatttcaacttcatgtaattttcatatgtcacaaaatattctcctttttattacttttcaaccatttgagaataaaagttattcttggctcacaggctgtatccaaacaggaattggccccagtttggctagtgggccatagtttgccaaccactgccctggactgtacaatttagagagagtaggtatgtatgtctgtgtacattcacccattgaaatgttatctaccttagtctcttttctagctaaaaagaactcttctcatatacatttagtgggtacaagtgcagcttttgacacatgggtatattaagtggtggtgaagtgtggacttttagtgtaaccattacccaaatagtatacattgtacccattaagtaatttatcatccttcatccccctccaacccttccgagttgccatggtctgttattccacacttcatgtccgtaagtacacattatttagctcccactcagaagtgagaacatgtggtgtttcactttctgtttctgagttgtttcacttaaggtaatggtctctagttccattcatgttgccgcaaaagacataattttattctcttttttatggctgaacagtattccatggcatacataccacattttctttatccagttatccactgatggacacttaggttgattctgtatctttgctgttgtgagtagtgctgcagtaaacatacaagtgtaggtatcattctgatagaataatttctttttcttcagatacccagtagtgggactgctggattgtatggtggttctatagaggttgcagtaatttacattctcatcgacagtgtataagcattcccttttctctacatccttatcaacatctgttattttttgtctaaaaattttttaatgtatctttcctgagctgatgaaacttggtagtgttagaaagtgcagtttgcaaatgagaatgtacaattgaatatgttagctgagctggaagtgattctggggtgccatctcaagggtcactcactgtgagttatgtctggccttccaaggtgaataagactacaattaggacccaggagtatttgtaataggtctcatttggattcagagataacagaagagcacacccttagcaaactgctgaaatctaccttcatcttcctccctacctaagacaagctggcctcagcagcccagctcatgtctgaatcacattagagaaatttctcccttatacagctgccattagttgactgtatgtctttcctgacattttttaactgacttcactttggactttccagccagagagaactggagttcttattcattatatcgtaatatttctttcccaaaacgtcttagacaagaaaaaaaaaaaaaagagcttcatagaatgaggtcagataacaacttctttttaatctaagctatctgcccttggtttattgccttgagtattattaataataaggtgaatcataagtaactcaatgagccatttgaaggaaaaataggaaactttcttttctttttcatagaatggacagaagatcactcagcccttgtgcctcctgttattccaaaccaccctccaagcaatccagagccagccagagaagttccacttcagggtaaagtacttgtctttctaattgtgtcatggttttagctcaaaatctaattttttttaaggtattttgaaaagtggaatctcgtaactcccaagtcattcctttgatagtgaaaaccataaataatgaaaacaatgataaatgtattgttagacttgtcaagaaaaattaggaatcttcctgaataatttttttccaactatttgtaatattttaaaaataaagactacttgttaaatgatcattcaaaccaacgtttctcaatctcagcaccattgccattttggggtaagtaattctttgttgtgtgggtttgtcctgggcattgtgagatgtcccctggccactagatgccagtagcacacagcccacctctcattgtgacaaggaaattgtccccagacattgccagatgtctctggggagcaaacccatcccagagataggaatcactgacttagagaccacagatatttaatagtatgttaaaaaagataaatctgaaactcagtattagatatttcaagagtctagccaacatattaggttttgtctaagactttcctataaatgaaaatggtttgatattgtgttttcagttctcattccctattcttgctgcagttttggtatttatgcatgtttacaacgtttcaataggtcttgtttgtttacattcacacataggatgaggcctttatagaggattattcttgaaaattggaagctccagaaccttgcaactttcaggcctcattgctcttaaattatagaaaatatttgtgtttagttttctttttcttttaaacaagcatcatgtttgacagagttgggggatgtttgtggtacagaaacaataaaaatactataaaatttgtcttcctttctatattttaaaagatttaattgtgttacatataaaaagataagtagaataataattcatttctttaattttaattcattataattttcataagaaagaaattgtttctctgctagctgacattgtcactagattagaattagtatcaatttatgtaaaataatttcttctggcatgaatgcactttttaatggtgataatggctttaataaagatgggatatagtagataataatgttgattagtatcaacatgactgtggagtcctcagttttgtggggttttttgtaaacataaaattccttctgtaggctcatgccttcttaccttcccctctctcacagtaagttagcctcctttcagttcttttaaccagcaaaactgtgaaccgcttctgagcctttgcagaggctgttccttctgtttgcagtggctgttccttctgtttgcagttgtcttttcctcctacttcttactctgctaactcctgttcacctcaggtctttgctagattcccctaccatgtttactcttaaccatcctgtacttcacatttatgaaatttaaccattataactagtgttcatttgtgtgctattatttaacaatagtttcctcattagactttaaatcccatggaggcaagagactatgattctctgttttttgttttttcactgtgagataatcccaaactaggcataatcccttgatatacattttctgatgacattattattgagtgaaacagtatccatccatcttccatccatccatccatccatccatccatccatccacatatacatatagaatagccaaccagactttcttacataattatcttagaaattaaataaattaaagctgtaaaggttcaggttctgagtgccaaatgcttagtgcaccaactaagacttgagacggtatttgtctgtattagacacttcatctcagattcttacttttctttaactcagcctttttttctttttctttttttctcttcttccttatttccttatatctcttccttctttctttagtcatctaatgattgactaagacatccactggttcttcattcaggctgctataacaagttgccatagactaggtggcttaaacaccaaacatttatctatcagttctggagactgggaagtcaaagatcaaagtgctggcagatcgagtgtccaatgagggtccacttcgtggtttatagacggccattttctcactgtatcctcatgtggtgcagagtagagagagaaagtactagttctcttcctcttgtaagaattagcccatcatgtgggctccactctcatggtataatcacctcccaaaggccccacttccaaataccattcaatagtgtctgaaggttcaggctcactgaactctccttgagattgactcgtttattcttaccacccttctactgtgtagtctctctgttgatccacacgtttcaagcacttttataatctttggaatataactgataccaaagaaaccagttaaaatccataccatttggctccaagctgtgatttcaataaacattaacctagactttagcctcattggttataactctgggttacctgcctaccggttaagtgtcttgattagccatctagtgtctagtgtcttgtatcttgggcagtatctagtgttgatagactgtcaggaagaagccatatagctaatttggttagattgtttggtagtaattttgccaagttcacaggccaactaaattctcccctgatcaagagtgtacttctaatcttagcaagtgataatttggagatttgctcttatgaaaactctccagcttcaagcttatgcttggagagagatttttgcagctacccctccaccacactcactctatcaccaccgccatcaaaacaataactcacttattgagctcttattatgtgccaggtaccttcccaggcactttacctacattatctgccatggttgtttctcacaactatcatgtgaaataggtatcatcattacctccatttatacttgtgatactccggcagagaggtttagtaacttgcccaaggccatatagccactaagtagcagagcacagatttgaacactatacatgaggaatagtttaacttctgtttgaaaggtttttggttgttttagtttttgtgggatacctcatttgtgtagtctaaatctatgctgttcggtatggaagccactggttacatgttgccatttaaatttaaatgaattacagttaaaaaatcaaaaaattaagtttttctgtctcactagccatatttcaaaggctcagtggctacatgtgactagtggctgccatattgaacagtgcaggtgcagagcatttccatcatcacggaaagtgccattagacggtactggtctagggtatttaaacactagtgtcaagaagtgacatttctttcccctccccccatcctggcagggaaacatgcacctaaggttcattcaggtgcagagttttgggccaagacccagaacatcctgatcagtgagtctaaggaaggaagtgaaaatgagtacattttaaaaagctacccaggggattttccctgggtaagacacaaccaagtcttaccgctggtgactggtaaacagaggttaggatcttagaaaattacatgtaccacagggctgcagctgagagctccaaattccactgcttatggggtgaaaagcgtttctttccaaaagctacattaactaatgatccacccatacgtaaaaaataataaaatgtgcataaatgtgaaaccctctgattttccttcccttgttaaacattggaaaaggaagtcagtcgtataatttcaaagctctgctcatgtctttattaagttaacattctcagcacaaaatatgctaatgtatttttttttaagtagataaactgccaggcacattttcacgttttctaacttagcctataataagagtgaaaagctccaacaaccaaacacctcttttcagccttctcaaagacatgataaatatcatttctgtgtgcttttatttgttcattcattctctcactcaacagaaatttttggagcacataaaatgtaccagacaatattctagatacttgatatacgtataaaaatcctcatggagctaacattctagtggttttatgtacctgcatatcaatgccactcatgcatgggagttggggatagtaagaaaaccaaagcaataagtaagatgtatattcttttggaaggtggtaaatgctaaggacaaaaataaagcaggaaaaagggattgggaatgttggaggtactgcaatttttagtaaggtggttagggaaggtcttgctgcgaaggtaatggctgttgatgtctctgcataactgaaatgtgtttcccttcagggccctggaatgccctagcagcacctgctacaagagtgtaggccagtcaccctcctccccctaaagtaaactttgggggttatcttacctcacctcaatttccatctgataattgtcttggcagctgtctccccaaagctcttggtgcaagtgacaccaccctcccaacgccttggcagatgactttgcgtggcgaatccttgtaagtcttgcctttctttagccactatgacagggctgtagtttgtcaaccttccaataagctttgggactgcgctagagagcaggttagcgaaaggacctctgattgcaggcaatttaaaagagccttctttgcaagagccagaaacttttaaaatatgcaattaaaaattgtatgcatgcccagagaccttttaaactcttttagatataactaaccaaaaataactttctttcctaggtgccaggctcctagtacaggggtgtaggggactaatgtctccctctttctctctctctttttgttttggataacatttttgatagaaaagaaacagggcagatggagaagctgtgtgtggcaaggacagggtataagaagtaagtaaagttagaagagatgaaagaagctgctcatgaaattaggtctactacttgggataatcagagaagttccagtaagtttctcaattacagagaagtgcctagtaaaacccaaaagaaaacgttttggtttatgttcaaaatgttatttgtgaatgtatcaagaaaactcaataaaaccttaggtagcatgtttggaagtaatttagcgatacctctatctgtaaatttattttatttttattatttttttgagacagagttttgctcttgttgcccaggctggagtgcaatggcgcaatctcagctcactgcaacctctacctcctggattcaagtgattgtcctgcctcagcctcccaagtagctgggattacaggcatccaccacctcatctggctaatttttgtattttttttttttagtagagacaggatttcactatgttggccaggttggttttgaactcctgacctcagtgctccacctgactcagcctcccaaagtgctaggattacaggcatgagccaccacacccccagcctaatttattttaaataagacagctgaatttggagctgtgtggctactgttagtaactacttagtttagggattttgtgtgtgtgtgttgtggggggggtttctttgtttgtttttttggtttgtgttttttaaacaaatatcctaaacttgttttaaacagtaattcttagccctaggcatgcgttggctgtatcacaaatttaataaaagatcagataaataggaaaaaatcagttgaatttagaattcaattcaaagtaatgacccttaattttgaaaatagtcattctacatttttgtcaaattattatttgtgactataatatgttttctggtattatctgtgcattttcagcctggattttccgtttgattagttctgttggtttttcaagtggaagccaggcccaaagcagcacatcagaagccatatagcaaaataaaattaaaacaaaacaaaagacataaaacagaccagttccattttctgtgaaggggtttgtggcagctcaattcctgtcaaagtgcatgaatggaaaccaagaagtgtgtcacctgacagggactagtttcatccctctcttgtagtttcttttggaccctggagttgacatactcaatgctttacctccctccatcaacactggggcctaggaacatccttattcctcaaattaagagaggactttcttaagatgctatatgcccaaaggctctagggcataagcttgaagaattatctatatgttgtctcaaatcttgtttaattctccttttcaccagtggtgacattccttatgcgtttcttattttaatccaggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggtagcgtcaacatggccttagtgtgttctgtgtggtgagactccaatccaggagataaacatgtgcaatcatgatgttgtttgtttgagcaagaccaagcaacgtcatgattgcacatgtttacagctttaaacaccttgagaatgagccaggtctccacattacataaattcatcccttgggacagattaaaacctgtgaagtcattttaagtttgggaaactgtttgagtacagtaaagcaatgagttactaaaaatgtagatccccatttaaataaatgaattctaaacttggatttctgcagtgagatttttttttaggagaaagctccaatgttctgtgagtgatttttacattctcattagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14818 - DNA, 16672 bp, Human; identical to SEQ ID NO: 12322

SEQ ID NO: 14819 - DNA, 16672 bp, Human; identical to SEQ ID NO: 12322

SEQ ID NO: 14820 - DNA, 34502 bp, Human
taaagtttgagaatttaagcttgttcccacatctacaccttggcggacggcagcgactgattacggagaccagtgaaaaccctgcccctaactctctctgtcctagccccatccactcaattgagcttgactcagcctgctccctgctgttctcagtattgctcccttagggtcagacgtgcactagacttcagcacgtgggagcgctgatgagcggccaacctgggtctatttaaaactactattcccatctcgaggggcgcctcctcccacagcataaccagcccaggagggcaggcgagtaaatactgctcacctgctccaccggaaacctcaaaatcccggcccgagctagactaaaggtatctggtaattaatccttggcacctcccaccacacgctcctgattgggcgcgtgagacaaggctgtgtctgcgcgcgctcttaccagtctggggaattccatttcctctaccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcctcctccctcccccgccctcctggtccaatctccgatctgtttagtaagaaggtgctgttccgagaagaaggaaaagggcttgacacgtattcactcggccccggacgtgggaagcaagccgtctggcttcggcctcacatcggtcttgtgctcgggacggcggcgttggcggactgatccgcggcggtgaagaggcaggaggagggggaggggcggagcgtggcagctggcagtagttccgtcagagcggacatcttgtggctgtgtcgtgcgcgtgagccccgtagggccggggaggcaccagctgccgcgcggggaggaggccgaggccgcagcttgagggaggccccggcccctctgtacgcgtgggtgtggacggctagggcagggaagggaggccggcccagtggccggccgggtaagaggggcagtgcgggacctgggcggcttgagcggccagcctattgggtgcggtgggttagggtgggaaggttggggaagccgcggcctctcctgctggaggaggagggggaatgggcgcgtcctcgcgcctaagccggagcctcagggacagcgcgggcgcgtggtggaggtggctgggcgggcgcgcgcgggagcgcgctggaaggcggagtgagtgtacggtggcgtcaggggtgacacagaatagctcgctgcgaggatagcaatacacatcaagtctcccttcctttatttccttccttttcccggccgcacctttggacagaaaccgaaagcagcccggcgtccgtccggagtcttatgcttccccctccccccttgcctttctttgccctagtgacgccggtatagcgccgactaggccccggctcctcctctgctgggctccggaccctgccccgcacccacccctttctcctacgcctcttcctctcccacccgggtctcttcctttctagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggtaacccgcggggacaagggcatggggtggtaggagaaaaggaaggctcgggccaagaggaaagcgtgggggtgggaaggaagcataattctgaaaatacctcttggatcacttcttccatggggggatggagaacgcagatatacttcttgaagaaatgaagtttaaagctaggaaacggagaacacttgtggcaagtgaggtgttatcctgagtgcttcagtggaatcggtgcaaattaggggtggaggagagtgacttaaggcgcctttattattttatttttttgctgcttaagaaggagtttttttgggggtccgaattgcggagagacgctccagcagatgtcatggcgcttcctattcttggtgcttgaaaacttagtttagttgtgagatcaaggttatctaggccttctaggggtaagaaagaaaactcggaggagagaaaaaaaatctggcgagtcccgaacttgactgagggtcgggtagaagaagtcttgcgtattgaaggtcagtcagtgagtctagtagaaactcttagtcgactctgggcaggttacaccgaataagtgggtttgggaggagatggaatgacacagtgttgccacttcctgtattttgtagttgcagcttttcacccgaagctatttatccgagggacaccgggaactgatgtaaaaggcattctggaagctcccttttccttttggctggagagtgggggtggataaggggtgcgatggcagtaagggaaagctaatgtacctatttttgcctcattctatttaataacacccttgtttcgttacttgaaatgtggtttgatagtatattatcgatttaagttgaaaaaaaactaggatttttcggagctctgggagtgagcggaacctccacctccggtggtttagtctcattttcttgctctaacttctatcccgcattttaagatggcggctgctttaactggttcaggctctttccggcatctcctttcgtaataatgtgaattaatatgatttgttaaatgttaacttttatatcgcgttgtgcactgctctaagatcctctgctcaaaacttacctaaattcaaactcttaaactgtatttcccttttttgtgacttgtatttgtgtgatgtgtttggttgttgcacaatcgaagagggtggagtgtttacagctaacttgaaaaaaatgtcatggaataaattcagccttactagaaaaattgtggagtgtcggtgagtgttagaaactttggttttaatagattacttttttaaaaagagttctgagaggaatggcaagaatttgcctttactaaaatagacctgatactacatttgcctgtatttaattatgactggagtttatttggcaagattggtgtttcatgaaagaggaaggtttaaatcttcactcttagtatgtattgatatgaaatcgtgaattttgttttgggccttcataacatcgtcattttgggttatgcgaaatacaaatttaaatctttgtgaaatgaaagaaaagaggaagaaacgctttttaggagttaaggattaaagtaaaaattattttgaaataattacctctttttgtgaccactttaaaggccaggaacatattggagaagcctagttgtatgttacagtgtggtttacacaaagagcataacattcagtacaaataaaaatcttttctgttggaattagttcaggccactaaaatgtggaatagtaccagatccatagctttttgtgcatgtggaacagaacacgttaaaggaaggcctctgattttttttctcttacaggtcatacccagctgctgtgacaccacttaaatgatttaaaagctttagagagacaatataacagtggttaagagtgtaaacattggagcagaaatgctccagttagaattctagctctgggcaagtttatgtgcctctataagaagggtatctgttgtaatatgaacaataaatgactgtgtgcctaatatgtaccaggcactgttttagacattggggtggcagcagtgaacaaaacaaattttaagttcctagatttgttttgacgattaaatggattaatgtgcaaatttgaacaggctcttggcacatgacactcctagttattactgctattttaatatcacaatttataatttttaaaaaccgtttttgtttaagaactttgatttctagtttagtactcttagttaaccaggttgtctccttttgtaaatattttgaagatttatgtaatatagacacaacataaaaacttggcatattggaaaaaccagtgtttatgtgaacattattgattcaacttacagaaactttgacgtgtgcatgtggtttggtttttcagctgttaatgttagaatcacatgaggcaactttcaaacattccacatccaacaattttagtgagtggacagctctgaactggaatgctcttcggtttaggcacctcttctagaaatatggggtcaagtagccattgatgtcagtatggtatgcttgtgttacgtacctatttcgaatttattcttgtctgaaggtcccacatttcaagtattatgatatatctgtattcctcgttaatattttactgaaatgattattggaatagttttaacctttagtccatttgatcgagcttttgaatttatactttgcttcagctgtgttcttggagtaagttttttgactgttagaccaatcaacttttttcctgtattctttatttgaacgagctgtaatatggtcttaaatagggctattaaacaacaggagttaaaagtggcactccaagttgattggtattgagagctgtagacaattttaccactcccattaaacagggactacaatatatgtgttttagggacgtttgaagataaatatgtgaaccaagcctaaaagaatagctcatgttttcattgtatacaccctgttaagttttcgtaagggtttttatttctggaagtatgactttagtgtttatatatgattataagcaagcggctagcagggaaaccatgggtaaagggttaaaaaactctcatttgatcttcgtttccctcctaccaccacttccactgagataatttcaagattatctccatctcgaaattgaaaaacttaggcatagaggttaagaagatgacccaggttcatgttgtgacagttgggattagaacctaggcagcctggtccagagtatgtgctcttaacaactacagtttgatatcatcctttagtttttttttgtcattcagaacggtttacttttgcatatagtattatctattacagtagttaagacaatgcagtctcatctaaaccctaactcatttaatcctcaagacaaccatgtgggatagatgtgagaattttatagatgaagtaacaggctcagagaaatagtcgtctagtcacacaactagtaagtgactgggattcaaatcagataggcaccaaaagctcaagctcttttttgaaccatttcaattcctttttttgttgttgttggagacggagtctcactgtgttacccaggctggagtgcagtggcgcgatctcagctcactgcaagctctgccttctgggttcacgccattctcctgcctcagcctcctgagtagctgggactacaggcgcccaccaccacccccggctaatttttttgtttttttagtagaggcagggtttcaccgtgttaaccaggatggtcttgatctcctgacctcgtgatccacccgcctcagcctcccaaagtgctgggattacaggcgtgagccaccacgtggcctggcccttcaattcctgttttataatgtatgtgattttagtttgttacctgaaataagctgctttgctctcccacttatacatctaagtaattgggagttagctttactcttaggttatagctaatttgtgagttaagattttggctaataatattttgaaagtagaagtggatttaattcttttggggtagtctcttcaagcactgaaaactaacatgtgccagttaactgcttaggatgtcttagagtgaacaaaatatatttattgtccccaactagtatataggctgggtaaactgtcttgcatgtgtttcatatatggtcctcaaagcttgttgatagccagctcactttctgtgtaggatagttgtgactgaaggatgctgataataataggacctcagtatttgtttaatttgaaaaaggatgcattactgacactgcatacttttctttcatcatgctcatctgcagtgttgattctagtttttgttatttatacaaataaaaagttgaatgctccatcactgggatgaactactgtgtcactagattgctctgtcaaactttgcccctgagtttaggtgaccctttttatccaagacaggcaatctttgaggattctccacagcatgttgctataatctatctattaaaaaagaaactaggttcgtaacactgagataaaaaaatgtttcagattaaaatctcaaacctaggttggtttttgcattctttttttaaatagcagttttcttgtatctgttagcgtatagaagagcttactgaatattatatattgttgggtgtgacatgaattacatttatattccagaacatttggagtttttaaaaaaattttgtgggtacatagttggtgtatatatttatgggttgcatgaaatattttgatacaggtatgcaatgcataatcacatcagggtaaatggggtatatacctcgagcatttatcctttgtgttacaatccagttatacttgtttacttatttttaaatgtcagattgtttagaatttaaaaaaaaaaatacagctgcatgggggtcttagacttactaaatcattttccctggaaacacataattttgaaaattttctaggtgattctgaagctcctctctgattaagaaccacagatacaagggagtaaaggtcctaatctgcattagacgtagtattctagtcccagggaataaatgaggaagatggtccttatctatggtaatctctgcgttcagtggtgaaaataagcatgtaaacacatgaatagttgtttgtcactttgtaatttacctttcaagaatattagatctagtaggggaggtatttaaaataaattttctatactgtattttttgtactagtattattacaatgtgatttgtcttttattataatgacttaattccccttgccaaaaccagtattttgaaattaatgaaataaaactctccattcttggaaatgttgtggtcttgagcttgctaccatagcagtgttatttcataattaaaaatgaatgcattcaccaaatatcttactgcccagtttctcttattagataagatttattcagaattgtatcctcaaccttgttatgtagggaagggaaaagtttagggaagtatttttatactttgttgaaacatctgatttttatctcctaatgatactttcaacataatctattgtaaaagagaccttcaacttttcatagctgaatttgtcgtatttaaatgtttgtcaattgtgaatcatgatttcttgtacctttttcagtatgaaatacttacattaatcctaaccttgctgtaatttcatggctaatgtgtaattgaatgttttctactactgggcagctgtttggctgttaatctttgttttttttgtttgtttgtttgttttgtttgttttaatgtccataaaacacccttcttgctttcatggagcagagcttcaaatctaaatttgggtttctttgcccatttttaaataatgcttacaaaagaatggctttgaataatgttaagtgactttaccttcagtggtgatcgaaagaaaattagtaatattcaatccattcttagtaccttgtgtaatgaacacgcatgcttgtttcacctataattacgactaaacaggaagttaataccttgtcagtgatgcagtgagatactgtgcagtgcctactgttaaaccttaagataaaaaaggatttctcagaagaaatttcaaattaaaatgtgttttaaagggactatttggagttttgtgaaattgttcatatctttttgccaagcatccttctcttgaaataaccatgtttctgaagtttgttgttccctgccttgatattcgcatctacatattttatacagacatttcataacattaaagttaataaaactttatagtaaaccagatctttatatgaacagttacagtagttactgtctgcctgatggacagctaattgcactgcacttcgacctctattgttggttcgcacctttgtatttttctaggttggttgtaaagtcttcttgaggatgattcttaaaatttcttaaggcacttactccctttgtttcccacctcattttatcatctcttccagtccccaaagcagtgttttgtgttgctcagtataggtttttgaggcaagggctgtttttataatgctgattcacagtcatacaaatcttgtcttttgagtcatgtaaatcttgtctttagttctgaaagaaatagactctcaaatagaatacaagaaattaacctttagtaatggcataagcttttagttttccggaaagtgctgagaggaaatgtatctatactactgcgttctgtcctctgtatgacctttgtgtgatgacgtgcaaaatagatggtagagattgggataacaaatgatttgtggaacatcgtggtgataattttactgtcttaaaggtagaatccatgaacttggccttgccactatataggcttttgaattttgacaagccttggggggatgaaacctagaataagttatttatggcgttacgctttaatagggttgacacttaaaaccttgttttcataaatgctaccttttggttatgttgatctgatgaacagatactggctgtcattgaaagaaagttaaccgaatgttcagatacttattgggctcctggaacatggctgctctgtagcttcatgaatattcataatattcataaatatttgtgaataaatatttttagtatttccaatttataagctctttgaaaggagggaatttttttttttttttttgaggcggagtcttggtcagctgcccaggctagagtgcagtggcgcaactgcggcttactgcaaccaccgtctcctgggttcaagcaattctcctgtctcagcctctcgagtagctgggattacaggcacccgccatcatgcccggctaatttttatattttagtagagatgggatttcacgatgttggccaggctggtcttgaattcctgacctcaggtgatccgcctgccttggcttcccaaagtgctaggattacaagcgtgagccaccacgcccagcaagggaggggacattcttatgtttctcctagcatcctttcaggtctttaatgttttcaataccttggcctactgttctttgtagcctgtggttggtcaccactgctagtaccacttatcattgaatgaggaagatagagaatagagaagcagaaagcatagtttaacatctccaacaatcaactgttaaatcccatatcccatagtgactacagtaaaggtcttcctcaagataaaccatttgcaggctttgtattaaaaatctcatgtaaggaatgtttcagaataaaaaaaaaaatagtgaccaaacccattactgcttaaatcatgtacttccagatgagaacactcaccagtggcttaagctgtacctgttggttgccttttagagagatttttttggtgaaaaaaatcctgccctattttctaccatggtgcccaccaggtcttcaggaaataggcaaacaactcagttgtgtaaagtctgttgctgtctcaaatttctttgtagtgttttaactaatgaggcgaactagaccatgtgagagctttgagagggtctcatttacctagcttagaaagaaggcagaggggtctccttgacttcttttcctataggttttttaaggcttttaaatacaagtattttttccagtgagaaggtctggattctcacactagccaagtgtgcagaaagtttgaggagaagcagctcagaggaagatgacactaaaaggagaaagtttcctaaaagagcactctgtggaaaagaaatgtccaaccttttgttctttttatagctagtacagtttcttagtgttgtaccctgattgtatgtgcttgatcttagtgtcccttcaacgtgagtggaaccttgagcaattcctaaagtaagtcagtgtccccaaccaaacattttcctgtttcagtggccttaatagttgagtaatgctgttccccttaggtgaggggtagtcagcacagtataaaaaaattttacaggtgccgtgtgagagctgttccttctggttcttggcactgttcctcttcctctagactgctaggaaggaataagctgaaaatttcaattgtgtaattttttagtgtttttgtccctgaagcctgtgaaactttaggctctaaaaacattttgttaggtgactatcgtagacaaaattacttttaaaaatgctgagtatgggtgtcgttggaaattgatttccagtccagtaaatggtcttgctgtgggatagaatcattttctcaggccatgtaacttgaaaaatagtactggattcacactacgtacgaataatgagatacagactaacggtggatggttatgcggaaataaatactaaggaaaacattagttttccatatcgtgttcattctggagcattgagtaatagtttggtgcagttgagaatttttttccctcagtttgccaaacattaaattatctttgcaaggacaccctgttgagaaaggaacctttttgaaacttacccctagtccaaatttttaagttgttagtaggtacacttagttcacctatcctaaagctgaacatgttctatgcttgaatgtaatcatttctttcccctctcttaagggactcaactgtaaaacagagaagatgagctctatttccgtaaagtggttataagagtacagttaaacacttgtggtgtacgactgctagtatatttaaaaatcaaaactcatttgtcttctatttcgaaaccatcagtgatttcccattgcctttggaatagtctgactaaattcaagggctcttttaaaagatcaagtcataacctgcctttttagctaaatctgccactctcctagtgtactctgtctggtataccaaactctgcagtatttgttctggcaaatttttatgccctgtgttctttgacactcctgactttgagtttctctacctagaatgcttctctcactccttgttcttggtaaatgcctgcttatttttccatcaagagccagctcaaatggcactcctctaaacccaggaaaagttagtggttggtttttcaggattctcagagcatttgagtccctttattttaagcgtgtaggttgttaaagtataatttttgttttgtcttgcacctgctttctgttagctgagtctgaggaggcatttctatcttaattatcttggtgtttttatacctaacatgcatggcaccaaaaaggcaatgttcctatgaatgaatgaatgttttgatggtgaaattaacattacattttcattttagaaatggatttaaattaacctccagtgtgaaagttaaccttgttactcctaattcaattttaagacttagcttcatttagatttcttacatgtttttcagcaaaactcaaaaactaaattgtgtttgaagtggcataaaatctacataattggtattcagatttggtctctcactactgctgtatatattttttaactccttaatataatccagattaaataagggatttattagaaggaaactgggatagttaacaatgaatggaataggtgtaggaaccagagcaagctacaacctcaggaaccaaaattgcacatctgtatggaaagtcagctctttgttattgctgctgttgaatatggtctctttagcttttgactttaccatgtaagtccatgacacgtgcctgtcaacagctatgggtcacattcttatagctcttgattatagaaggaagaatgtccctttgatttggaaactcttaggttgggatggacaatggactaatagttgggtcccagctgagggaacaaaattctgtggttagtcatgtccaaataattggttaatgatggctgacccaggactacagtcacatgatttggagtaagggaaaaggaattcatgagtaagatggtttattgagtagacaaaatgtctgctagctacaaagagcatctgctatgacttactcttttctcacttttttttcctacgatactgtcttgctcattctgtgggcatataatgttacaaaaattatttggtagctcaaaggtaagtgcttgtgcatggttttgttactattgggtactaagtggtactttaaatagtaatattagatactatttaaatggcaagaaagaaaatggtgaaataagaacagcatttgtatctttaaaaaagacctttgttttgattgttaaaatacttaggtcatttttctatattgaatttaaagtaggtaagtgtattgggctgattttatctctttgattattactaaagagatgtcttggtgatggagaacttcgaaagtaaggcatttagaaatgttaggagagtaacaagaacctgaaattacaggagtgaagagctgaaacccagtgttaactagctgaaattataccttcactctaaaaggatgataatgctagcatttaaaggcttagtgatggataaatatcagtgtgccgaaaactcatttattctataagaaatactttcttactttctttgtaattgaaatgtgtaatgttgaagtagtatggtgtttatattctaggtcaacttcatagttttctgacctttagttttatttataatgaagtattccaacattattgggtattgtgtttagaacaaccatgattacattgatttttattttaaaattaaaatattttatcttaatatttattctggccaggcacggtggctcacgcctgtaatcccagcactttgggaggccaaggtgatcacctgaggtcaggagttcgagaccagtgtggccaacatggtgaaaccccgtctctactaaaaatacaaaaaattagccgggtgtggtggcgcacatctctagttccagttactcggaaggctgaggcaggagaatcacttgaacccaggaggcagaggttgcagtgagccaagattgtgccattgtactccaccatgggcgacaagagtgaaactccatctccaaaaaaaagaaaattacgctaaatatttttgttcagacattttaacatatattaaatgtaaaatctagtatgtttattgagttaattatgagtaaataaatgtaaaacttggattgtgttgtcagctttttaaactcttatttcagtattaggtatattcagatgcttacaaagacatttttagacaactgagcatcaggatttatcacataggtcaaaaatttaaataaacaagtggctatattatgtggcccatgtgtggagcagttttgcttttgttcagtaacagatgaattaagagccttgcccaggaatcttggttcaggatgggtggtctacacatggtctgcttgttaagtaccagtccattatgtgccaggtagtgattcctatttcagagatgagaagagaaccatgagaaaaagtaggcctgtgtaagattaaaagtaagactgcaggcctggtgcagtggttcacacctgtattcctagcactttgggaggccgaggcaggcggatcacttgaggtcaggatttcgagatcagcctggccatggtgaaaccccatctctagtaaaactacaaaaaaaaaaaaaaaaaagaatagccaggtgtggtggcatgtgcctgtaattccagctactcaggaggctgaggcaggagagtcacttgaacctgggaggaggaggttgcagtgaaccaagatcacaccactgcactccagcctggatgacagagggagactccatctcaaaaaaaaaagtcattttcttaatagtggataatttaagttgcaaaaaaaaaaaagcttctgaaatactgatttggttcagttaatattttctgttacaattttttgaaggccaaaagccatgtagtttcttttacagattgttgaactgcgatatgaatttctgtaattcccactgatcagaatcaatagtatttggaatgaattttcttccatttctgaatatgtggaagacatgagggtatatctatacagacaagcatataaagggtgtgtgatatacagtcttaaaattgtgaatcttgggatctctggcaaccttgtaagtagttgtgatgagtttccaaagtgaattggcacagcatatcaggacaattctccttgtctactctatttttgttgtttgttttatggcattaatctagactgaccattcccgaacaactggccattttctgaagtgtattttgaatataagaggcaaatatttgcctcttaattttcctgcagtgttgtttattgtgacaaagcctttcttcacattctttatttctttttaacttttcaggttactggccaaggttccctttcttagcgttaaattagtccagtgttaactcctaggaccttctgttccaggagtgctctcaccaagttgaatggctataaacatcatttgtttattaatgatactttgtatttgttcccagcctgttctcaacttgtatatatacttttcgaattgagtctttacttacattatcctattttacttactttatctctacatctgcccacaagcttcacctgtaagttgaccattttacttaatgccaatctcatgctttgctcaggccaaaaatcttagcgtcaccttttcttcccacatggagtcaatcaacaaaattcattgtttaattttacaattaaaaatgtacatttattgttcaacaaattgctgtacatagtgatgcgtacctgcaactccagctgcttaagaggctgaggcaagaggatcccttgagcccaggagttctgggctatagtgccttatgattgtgattccgcctgtgaatagccactgtagtccggcttgggcaacatagtgagattcccatcacttttttaaaaggggagaggattggtggacttttaactaaacaactttaatcaaaacttcattttttaaaaaagatactattagagcagttaaaactttgtgttgatcatcttaacatttttaaaggtagtacaattattcttagtccgtatttgtgtactctagtttcctagccctgtttctcagtgctgttttgctaatatctctaatagtcttacttaatcttgttgaaagtagcacttttgaggttaataaggtttaaattaataacccccattgactgtagtctataatactataattttttaaatggcaaaatgccctctgggagctaaggtgtcttaaaagcttagagcaaatcctgttaaatgggacaaagtctcaattcttttttaataagacaaaaacactttatgtagtctcttttctttttcagtgtttctcgaaatttcaattttattccatgctgctacagaatacaaacttacccaataaaaatagcagctccattgaaagagctttcccacaaattgaaatatttaaagcacagttacaggcttgtgtactgttggtgcatacattgtttgatttgttcagttcctcagttttgcagggaaagatgtcaacattatctgatttttcaagctatctattcaatgattctaattttctaaaagacttggaagctgggttgttttttgttctggcccctcagtttgttgagagcctattttaaagatttccagtggatttaacaaaatgaacaaaatttagaggactcatttatttcccccaaccaagtcagtgccatagtgggacccttacataaatttgtcactgtgtttaaatttgatgtagtgaatgaaaataatcatctgaagccagtataaaataggcattaaacattgttgtccaagctagagtgcagtggctctccaccagcatgatcatttaacacacaaaaacctgaaacacctgggcttaatcctgcctcagccttccgagtagctgggactacaggcacatgccactatgccttgttaaattaagatttgtagctcttcttcccattccctgcacccttctgagagagcttatactgaaagttctgcattttgtgtccttgattttgcacaggaaggcaaaagatcacagttgaggaaaaaaagtgcatgtacccactttgaaaatctgtttccatttttaaattcctgtagttatagggaataagttgttctagtagaccaaaagaagattaatgtttttagttatacacggatgcattgatattgtggtagacagttgatactggctttatcgtaatttttttttctttttatggagaatggggtctcactatgttatccaagctggtctcgaactcctgcgctcaagctgtcctctcgcctctgcttctctgttgtatcttttttatttaggcatcctttcttttgctttctagtacttggtcttttgtatatgagtacgttcagcttttctggggttttttttttgttgtttttgagacagtctcactcttttccccaggctggagtgcagtggcgcgatctgcagcctctccctcccaggttcaagtgattctcctgtatcatcctcccgagtagctgggattacaggcgtgtgccactatgcgtggctaatttttgtgatgttagtagagatggggttttaccatgttagcagcactggtcttgaactcctgaccttaggtgatccacccttctcagcctcccaaagtgctgggattacgggcgtgagccactgtgcccagtctagcttttttggtcttgtttttttgtttctgagacaggattttgtgttttttttctgtctcagacagctctgttgcccagactggagtgcagtggcatgatcacagctcactgcagccttgacttgttgggctcaagtgatcctcccacctcagtcttctgagtagctaggaccccaggcatgcaccaccatgcctagctaacattttcgaagagacgggggtctccctttgttgttcaggctggtctcagtcaaactcctgggctcaagcgatccctgtctttgcctcccagggtgttaggattacaggcatgagccacgtacctagtggtcttctgctgttcaaatggaatcccaaaccttacccttctgtgttatttccatgtttatatgagaaaggggatatagaagatatagtagtccctagacttaatgggtgtactgacttatgccatagactaaacttaagagaaactgttagtttgaaaatgttgaaggcagtaatgtattaacattggttctatttattgtcttttttttttaacttgtgattattagacattggttatatcattggtaagatggagctgtaccatcttaaaaatattctaataaactatattttcatagtagataattcatattgttatgcacaagtcatggaacagtgaactacatacttgttggaaataaaacgttcatattgaattgtgcagactatatgttaagagcaaacgtctttctacttacagaagtacgctcttcagggtcagaatttcaatcacgaggtcaggagatcgagacccatcctggttaacgcagtgaaatcccgtctctactaaaaaatacaaaaaattagcctggcatggtggcgggcacctgaggcaggagaatggcgtgaacctgggaggtggagcttgcagtgaccccagattgcgccactgcactgcagcctggagactccgtctcaaaaaaaaaaaaaatttcaatagttaaaaatggatgctgagtttaaaaaaaaaaaaaaaggttgagttgagagaataaggagattagaaaacaaaaaaggtacttagccccatgagagtttttttggtttgttttcaggtagaaaatagagttagtggattggggaggaaggatggttcaggaagaacaaagaatttaagacagttgagggcctctgaaagtggtcttggaagttcaacaaataacgtgaatgttgagctctctctggtctaagctcttaaactatgagaatatctaattatagctatttcggtttgtaagagattggcttttatgtaaataaaaaattttgtatcaatgtgtttgcatatatatttttacgaactctagctaagatgattgtctcagcatatgttcaggcatgttctctctcctaatggaatatattatttatgtgaattgtgatggagtgtgcctttaaaaatagggtgaaagtaactgaaagcagtggactcatttgcttgttttcttaaattaagcttatgtgactcacccattttctgtcttggtgtaggaacttagtgatttggcccgtgaccctccagcacaatgttctgcaggtccagttggggatgatagtaagtaacttgcaagttgatttttatgcctaatttttttttaagcttgtgcatttttagataaccagagttttttttctttttctagtgtttcattggcaagccacaattatgggacctgtaagtattaagaatttttaaatttagttttaagtgaaaatccagcattgatttggttgtaatttttaacttggtctgtaggtttattttatcatatagttaattctattttggatattccatagttgtactgcatttgaaagaaaaaacataatgagttagtcatttgttacgtgtactttgtgtctatccctgtgttcacgttctagagtatagccatctctatgacctaccaaacatctctgtatctcagttcagtttttctacatagcactgtgtaaagcattgtcatggaacttcctgttatttatagagacaaagttactggctctgatctgccatgcgttgtgttactcagagatcttattctgttactgcagctgccaataatctagcttaattgtattttgatatttgattctttatagaacttcagtttatgcaaaatttgaatatatttaggcagaaagtgatattttgaatatagcaaaattcctttctatcctgggtagataagcaactatatgctggataattgaatattcagaattatggataccatctaagaatttcagagaattagagcgcactaaaacatcctggggtaagactgtatcttacacaaatatttaactttttttttttttttaacttgctaaggcgcttaaggatttgttttctaagttacatgtgtatcttcctgaaaactgtcttccctttttggtggttttataagcaacataaagagcaataatgtactaggtgagataatggtcagtaagtaatatttagaattctaaaggaaaaaatgctcttagagttagtagatgagtcgaatcaacaagtatttatttagtaattctgattctaactttagtcatttttctgtctcaaatgtgagtacatactgtgtgccaggtaataaggatacaaattgaacataataaacatccctgtcgatcttatagggaacttacactgtattagaggagacagatacctaaaacaagtgctgaagtgtgacaagatggaaaataagtgattggtgaatgaagtgctgagtaggataaattaatgggaaattgtagcagggaggattaatttagagtaattaaaatgttagtgccctaaaggtagaaaaactaaatcaaagtaagacatggcaggggtgcaaatattaagtttaatactttgaaacgtcctggatcattttaaaacaaagtaacatttaaaacagtaaaaatagtcctgtaataacgaaatgcacaatcctggctttgtagttattaaaagtacttacttttatctaatttggtagcaatattgtttaattttaatacacgcagttaaatgttgagttacccagtttggcccacacgatatttttgaaagttggcagtcttcaaataaaagccttctgagtaggcccacattccataagcagtaatggcttgggatggaatgacagctgcctcccttttttagatgggatatgtgtttaccacagtgcctactaggtcaattccatattatctgcctagtgttttgtaaagcagttgcttttgcaacctctagaattttcccattttggattaccagttttcaaagaatgctataaaatgccttaaaataaagctcatctttgattcagagggtagttgatagtttcattataaaaattgtcaatactaagaaagcacagaagcgttggtaattaaaacttctaattggatggtgtgcagaataaactaactctttaaaactagttggtttttctgcttgacagtttagactttgttattttgaacaacacactagtttttcccaaaaggcaaggaacatacctatagacaatcaaaaggaaacatgaatgatgagtgtatggtagtaatttttttagagaatggtgttgcttattctgacagattttttagcagtttacttaatttgctgttattttgagaaaacatttaccttttttcattttttaaatatatatttcaggtgatggctattccttgctgaactttttcagcaaccttttaatataatgactagcagttttctgcttttacaaacagaagcatgtgattttcagaaccatttaaatattaacctgattaaccacaactgctgggttttgctttggtagcagtactcactgaaatatgttttcagttaaaaaggttagttctcactgttggttgggtaaatttcaagaaggagtcaaagattataaaaatccacccaaagtacgggtattgtcttgtacataagtaagcacataatttagatgccagctttaaatagttaactatatgcttactgtggagtgcaccaatgaaacaactcattttgttcttttggcttctcaatacttctttgtgacaaagcatcactgtataagataaatagtagcttattttgtgagtatggttgctctatgtagcaagcagttgtgacctaaagcaacccataaattacagatttagtgggagaactggacagttaacaacgtcacttttgctttggactactacttaggtcccttaaagtggtgccagtgccacagaactgaagattcctgactgtagggaatataccatctaattttgagtttcaatagagtaactttgattttagtgagttgttgggaaatcctttagatcattagttatgcagcaaaattgcttggctttaataatcatatgtactggcttattctttctgaaggtaagctacttcggaagcacaactattgactaaaaactaaaccttcgaaagaaatgacagcattgctagttttttgtgtgcgtgggtttttttggggaggggggcgtggggtactgtattaaggttagtttccaacaagaattgatgtaattagaagaaattgacttccttacctattgcctctgatatttacttgcttaaatttttttttattggaaatccagaaaaagtggatttagagaacaacactaactcccacctaatctatgacagagatgtagaagagagtacctgtgaaaaatgtgaaagtatctgaaaaatgtaacctttggcagcctgagcatagtcaaccagaaaaactatctgaattaaaataattggtccataggtactattttatttggtccataaggattattttttcaacttttttttcaagtgtattattatgtcatttcccacgtaggttactgatacctgaagactttttccacctttaaccttactcgttgaggagctttgtagtctaataaaagagaaatataagtaaatgttagatatatgggtggataatggtaactatgtgcttaaagaggtataaaagaagggtagggagcagataagacaaaggaagggctatattataaggaagaatattccaagtagggaagagaaaaagatatgttatccatataatattttatgtgcagtagagaacatgttctatagaagagacagaagatgaaactagatgggcacccagatcataaagcaccgtatgtacttaggagttggaattatcttaaaaactatcatagatttcaagcaggggagtaacatttttaaaagaccactttatcattaggatggagggataatcattagtaagctattgccataatctaggctgaagataacatcatgaactaagatggtagtgacagtgggcataaaggagaagctaattcaagaaattttaaagatcttacttgataactatcttgattctgagataagagaggaagaagttgatgatgagatcctggtttatggctttcagttatggcttgctattaataaacaggaaaaaagggattgagacaagtttcagttttggacgcatgacatgagatatccaagtagagatatccaagtagaaatatcagtaggcatttgaatatatgccctggaatgaataactgaccagagatatattttgcaactcaaatttttatgggtcagcagttaagagtagaaaatcaacctataagaataccagcatttttagctgggtgtagtggcacatgcctgtaattccagcttctttggaggctgaggcccgagaatttacttgaacctgggaggtggaggttgcagtgagccgagatcacaccactgcactccagcctgggcgacagcaccactttaaaaaaaaaaaaaaaagaataccaacgttttattgccacagaagagctgaggcactgtgagggagcaactttgcactgatgagagcaaaagaagtagaaggtttctgaaaaaatctaacataaattctggacttgtacgatttgagtcgatttgctgatcacagtgttccttattctttggggattttgtttctttttggtgtagtttgctgctgattcataatagaatttaaatatcatagggtctcaattttttatattgcctagtttcattatctctgaacctcgtagttcttcctcttttggcatggcagaactttagtgttaaattgtaacattgaaatattttgccttctttataaagttcttttttcgaacaaacgaaacgaaatttggctttgcctaaatcccatcagcagattgcctttattcagaagcagtcatagacagcatttgattttatgaaaattgaaatgaaagcttacaaagaacttctggaattaggttattaaaacttcaatgtttggggccgggcatggtggctcacgactgtaatcccaacactttgggaggccaaggtgggtggatcactggaactcagcagtttgagaccagcctctcaactaaaaagacaacaaaaactccgtctctactaaaaagacaaaaaaaattagccaactgtggtggttcactcctgtagttccagctactcgggagggtgaggtgggagaatcacttgatcccaggaggcagagggttgcagtgagccaagatcgtgccactgcactccagtctgggcgacagagcaagaccctgtctcaaaaaaaacaaaaacaactttagtgtttgggattacctttaaattgttaattttacacagaaaaaacatatcttgtatagtattggatcaggtgaaagtatatgctatttgaagcatctattcaaaattaatataactatttaataaagacatgttaatctaataaactcaggtcacattctaagtgacctgagtgtttttctagttccatattttgtagaaaatatgaaaaaggactgggcacggtggctgatacctgtaatcccagcactttgggaggctgaggcaggcggatcacctggggtcaggagttaagagttcagccaacatggtgaagccccatctctactaaaaataaaaaattagctgggcacgttggtgcacacctgtaatccaagctactgaggcagctgaagcaggagaatctcttgaacctggggaggcggcgcttgcagtgagctgaggttgcaccattttactcgagcttgggcaacaaacagcaagatgatattctgcgtcttgtttgtcccccttcccgttcccattccccccgccctccacccctacaaaaaaaaagggggaagacttgggagatggagaaggactcactttaaataagctctggctgggtacagtagctcacacctataatcagcacattttgggaggccgagatgggtggatcacaaggtcaggaggccgcaagactagcctggccaacatggtgaaactcagtctctactaaaaatacaaaaattagctgggtgtggtggtgcatatgtgtaatcccagctacttgggaggctgaggcaggagagttgcttgaacccaggaggcagaggtcgcagtgagctgagatcgtgccactgcgcttaagcctgagcgacagagtgagactccgtctcaaataaataaaagctcttccatttactagttgtatatttctttgaacctgattcttcattaataaattgacctttcttctttgaactcgtgtcccttgttcatatttcatgatacctataacatttcattgcagttactttacatgtctatcagtgtaagctcatcaagataaaaaaaattgttctttggatcccttaacacacatacagtatatagcaaggggttagattaattgaattaatgtttatttattttacagaagggtaggaattagatgagctgtgttagtgtcaggcctgttttttatgtgcctgacatccagaatgggcatagtgaaaggctcatatatagctgtatatacaaagcctttctaatagaggggagtcagtgttggtaaaaacccagttcatgtaagttgtaaaacatgtcttcggattggttctttgcatacccagaagcagttaggcattccacattttaactttaaattcctgagtaggtcagtatctttgatcattaagtggtcttcaaaagacttgtgtttgaatcttggttctatcatttaccatttgtacactagactaagttctttaagcctcatttttctcatgcataaaataggggcaatgcatgtattttctggtattgattaaaatgagaagcttaggcttttctctgttctcctcttgaaggtggtgtgtgtgtgttacctggaatagctaacatttggtttgccagtgggcagaatggactgttgtgaagccatttgtacacatctggctattggaagaaataatctacatgtgtaaaattttgtttacagattattctgaaacatgattatgtaggctttattgctgtgttgtacttttgagaattgagatctagaatacttgcgtttctggataactttttaaaaaaacattttggtgacgtgtaaaatgactaggtaaattagggtttattactgtataagttttaagtttttttctattactatagactgaattttcatggaatagattatttattgcagtgtaaataggtgatttgggttcattattagagaaatgcttggaaacaaatgttacggaatatttagcaataatattttaaatttgagttaagcatacttttctttttacagaatgacagcccatatcaaggcggtgtattctttttgacaattcattttcctacagactaccccttcaaaccacctaaggcaagtattttccctcaaaatctgttagtatagatttatgctttatttcaaaggaatagagcattcttggaagatagggttctgtgtaggctgtatatatatgttgaattgcactcatgtatagatgctgactcttaacctttggtttaaagagctagacctcagtttgagctttgtaaataggaataaggtttgccttttctttaatgttgcaagattcagaccatgtggaagcttccgccctcatctgtattattgttacacagattctgatttttgggcttttgttgtcttgtaagcatcaaatgtccaacttcaatttatatttgcacgtattgttacagcatatgcttattatgcttatagttttgtatacgtaagtgtaaatttgtgaaaacttagagttgcttagtgcactggtttataggtattaaaagcatattatccttcacttttcagtcattaacataaattcaacctgtatgaataactagaaaaggtaatatacaaaggtcataaacatgtcactataacaatctctagtaatgttataggtgcaatgtgatggtttccatttttgtgattcaagtttatgttttatgtacggtggaaatgcagactcaggtgtacctgtgtaacttaatgaaactttaaatgagatggtctacaaattttggttacatccaaaagttagggcttttataaatgaatgtgttaaatacctttaaattgccctttgattcatgatatggtagggccacagtaacctttagaactttacatcatatgagtaatgaaatttttatccaaaagtttaggtttctgttgtaaaaagaggaggcagggggttgtggtcagattgtaaaaatcagtttctataatatttagaacttctatgctaatagatgacatttttaacattgtggcttgattattttaagttttgctttaaaagatgtttgtttttatttgaataaaatacttaaaagtttttgttttaggttgcatttacaacaagaatttatcatccaaatattaacagtaatggcagcatttgtctcgatattctaagatcacagtggtcgcctgctttaacaatttctaaaggtaaatatttctagtgaaataagctgttctcattgtctaataaagcttcattcttagatctacttatctgagtatttttattatggcagctttttggtaagagatggggaagcaataaagttacttttataatttttgttcttttagtggtgttgattaaagatactttgtgagaagttgttaaaattcaaattgtggtgagtaggcattatttgcctaatgagttaccttcatctcatcttataatagcaaaatttattttaatagacttctgtatttttcaatcccaaaccacttggacatctcacactaacttgcggcctttttaccaagaatggtatgatatacctaaacttaatagagcttttgaatcctgaggtttccactctaggaaaattctgattttgctttcctgggttaatttttagacaaatcttcagtcatgttttatgtaaccatgataggttgtttctacctaatgacagtctaaaattatataatcttcgaaagatctgtagatcaattctggtctcttaataggcatctgttacgttatatgtaacaagttttccggtctccgcatgaatatcccaggtgaagttgtaataattaacactatttcaccattaattgttttttgattttatgagttcagtaagtacaaaaaagctttttcaaaaggcaaggcattgtataaaagtttcatatgtgtatatactgcacttgaatctcatggagagagactgtagcagtagcatttcccaaactttattgagtagaatcacttaagggagaaaaagaaacaacttaggcagatgctgccataattcgagtgtttttaaaattttacacctgtttttcaccttcttggatgctttctaatttcttttcaaatcatgctacatacctaaatatcagtttccaagtttttctactactgctgggagtgtacagtaacactgaaaactgtttttgtaagggcagattgaattggtattgttttgtcgttaaagcaacttacttttttggcagccatactttgctaacttattaaactagcagtcacaactgaagctaccttttttctgtgagttattgtatagccaagtctcctatattaggtaattttatattctgctgtatttggggtttgaaattaaatttgctgtagtcaataaatatgtgacagtgttgtcttttttatactattgctttttttaaaaaaaaatcggtcagaaccatttcaagcatttatatcttaacattttataacagcaccaccatatatggtgactggcacatagcaggcactcaaagtgaatgcgatctatgttccttaatgcttgacatcttatacatcagtatgttgaactggttaaggtaaaaactagagctgatgactcacttagtactaaagagattttggcattgtatttaactagtactcttgggaatatggtttcttgcttacaagttcaaggagacatttagtggagcacttgagggtttttctcagaaattgccaagacaacggctaagaatggatttttcatcatgcctaatggctatgaatatggcatgagtgttacctgcatattcttgctaaagtcccccccccccagccacagagtaccaagaaactcaagttctaatatcatttatgcctatttaaaatatatatattaatatggcatcagttgcctatcttagaaactatttttatggctagtctgcagtgaatttcatgccacaaaaccctgtttttagcacttcttacttaccaggagcttgtcttctgtgaaacaaaatctctgtaaaactgtgtctcattgagataaagatacaaactaataaaagtcttttgaggattgagttttgtaatacacggtttagaaaaatttatttatccaaactcctgaaactgggtaacagatgtttttgttttcttgcagttcttttatccatttgttcactgctatgtgatccaaacccagatgaccccctagtgccagagattgcacggatctataaaacagacagagataagtaagtatgttaaaaagttattataaaagtggttttacttaatgagttaggcttatactttgcttgtgacagtgccaagaagacttgatatttagtaagataatagttaaaatatggagaaagctattgaaatgtggttatttaaaaaaacttaactaggctttagcttatgtgacagtgaatgctcccctctaaaatgttttattgttgttttttttttcctagcgtgttaaacagtatcactttattctcaacttttggggaagaaagcaaatttttctttaccccaagcatgtttttccaaaaatgttagtactattgtaaaaatttggtctaaatttctcaaatatttgaattatatttatgttcaacttaaccattataactttcatatgttataattaatgctaagtgtacttgttcaattaggtacaataggttagcaagagagtggacagagaaatacgctatgttgtagggtaagaggatctgcactctatggtgcgcttattatggtactgccagcacttgagtgctgcatgcgttaaggcactgtattaactaacaaaaggtaacaaatatggcagtcttctgaaaactgtacatttaactgcttggtctctgtttaacgtgaaagtaaatatctggtagccgttactgcttgaaagtattgcatggcaaagcagttacaatagcactagtaagaaatgggaatttatgtagtatcttttttttttttcaaactatcatggtgtttaaattttagcttgagactttgtaccaatcctatacagaatgtggtggtttagttcaaattttgccgggagatagtaatgtaagggaaaaacacttttaagcctaagcatctaaactaaatgttcattactgacaagcatgcattagcgtcagctgtactttgtggctccctgtatgctaaataaagcctttgttttaaagtgctggctttttgagagagtatccttaggagatgacaatgaattggtagaaagaactttttaaaaagtttaggaaagttgttggaccatatttggttcttggtttgaaataaagctagttaatatttaaacaatataaaaattctcctgtgcatatatatatatatatattcatttcttaaggttatcactgttttttgttgttgtaagtagtctatggcatgagtataatccagggggaagctgatagtatttatcaatgttagtagtcttcctgagtaataaccttgcttgtgtgtgaattacctgttgatctttttaaacgaagatgcccttgttgtactcaacaggtctcagtggtgcttattagcctcagttaccacacttattaaaagtaacacgtgattctgatgaacacaaccactcacacacacaccccttttgaaaattactgccctttgtcattctgcccagtgtcatcttccccttctgcctctacctaagtcccaaagccattttttcttgtaatatccaggaccaagtaatttcccaaactctaggattcagataaaattgttctagtaaaagcctagttctggccttggtggaaatttctgtggatagatagaatgtgtatactattttaacatttgtccataatgaactgtaaaaatttcttcacgttaaaattagagcatgagctcggtggtagagaaagaaagggtcttttgatttttgttagcctcccaattttcagtgctgctttcttagttgtttttaaaatactactttcagagcatcaggctctcatttcccacattgctttgagtaccagtgctatttctcccttgttggcttttattctaatcatagtcattagagatgacttcatgatgagtctggagatgataaaatggaaatctttcccttccatttaaagtattaggaattctttattttaacttttaaaaataacatctttatttacaggtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagacactttggtcttactcggtaattccagctaacatgaaatccacacttgagcttaatgtgtgtgagctcgatttttaattttatacagtttatgaataaggtggttctcaaaatgtttcttgagataacaatctcagcatcatttaggaaattctttataatataagttgtcaggccccatcccagtcctgagtcaaactggcatggagcccagtcacctatattaaaacaccctccaagtgattctg

SEQ ID NO: 14821 - DNA, 4329 bp, Human
taaatcatgctgctataaagacacatgcacacatatgtttattgcggcattattcacaatagcaaagacttggaaccaacccaaatgtccaacagtgatagactgcattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacactgcatattctcactcataggtgggaattgaacaatgagatcacatggacacaggaaagggaacatcacactctggggactgttgtggggtgggggagggcggagggacagcattgggagatatacctaatgctagatgacgagttagtgggtgcagcgcaccagcatggcacatgtatacatatgtaactaacctgcacaatgtgcacatgtaccctaaaacttaaagtataataataaaaaaaataaaaaacacaatataccaaaagcctataagatacagcaaaagcagtactaaaagggaagtttatagctataagtgcctacatcaaaaagaggaaaaacttcaaataaacaacctaatgatgcatcttaaagacctaggaaagcaagagcaaaccaaaccccaaactagtagaagaaaagagatattaaaagtcagaacagaaataagtggaattgaaatgaagaaaacagtacaaaagattaatgaaacaaagttggttttttgaaaagtcagacaaaattgacaaatctttagccagactatgagaaaaagagagaagatacaaataaacaaaatgagacatgaaaaaggaggcattacaactgataccatatgatcaactatatgctaataagttggaaaatctagacaaaatgggcaaattcctagacacatgtaacccaccaagatggaaccatgaagaaatccaaaacctgaacagttcaataacaagtaaagagactgaagccataaataaaagtctcccagtaagaaaagccaatggcttcactgctgaattctaccatttagagaagagataataccaatcctactcaaacgattccaacaaatagaggaggagggaatgcttccaaactcattctttaaggccagtattactctgatagcaaaaccagaaaaagacatttaaaaagcaaagaaaactgtgggccaaatatctctaatgaatattgatacaaaaatcctcaacaaagtactagtaaacccaattcgacaatacattaaaaacatcgttcatcatgaccaagtgagatttatccctgggatgcaagaatggtatgacatacacaaatcagtcaatataatacatcacatcaacagaatgaaagacaaaaactatatgatcatgtcaattaatactgaaaaagcatttgataaaattcaatattgcttcatgataaaaaccctcaaaacactgggtatagaaagaacatacctcaacataataaaagccatatatgatgaactcacagctagtatcacactgaatggggaaaaactgaaagcctttcctctaagatctggaacacaacaaaggatgcccactttccccactgttattcaacatggtactggaagtcctagctagagcaattagacaagagaaagaaataaagggcatccaaattggaaaggaagaagtcagattatccttgtttgcagatgatatgatcttatatttggaagaaccttactccacaaaattcttagtccacaaagaactgataaacaaattcagtaaagctgtggcatacaatatgaacacataaaaatcggtagcatttctatatgccaagaatgaagaatctgaaaaaaatttaaaaagtaatcctgtttacaatagtcacaaatacaattatgtatctagcaattaacttaaccaaagaagtgaaagagctctataatgaaaactataaaagactgagaaaggcttttccggcagtgacgacctacccacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggattaaaaaaaaaaagactgagaaagaaattgaagaggacaccaaaaatatggaagaatatatcatgttcatggattggaagaatcaatattgttaaaatgtccataactacccaaagcaatctacagattcaatgtaattcctatcaaaataccaaggacattcttcacagaaacggaaaaacaaccctaacatttatatgaaaccccaaaagacccagaatggccaaaactatcctaagcaaaaagaacaaaactggaggaatcacattacctgacttcaaattatactacagagctacagtaaccaaaagagcatggtattggcataaaagcagacatatagaccatatggaacagaatagagaacccagaaacaaatccacatgcttatagtgaactcattttcaacaaaggtaacaagaacatacactggggaaaagacagtttcttcaataaatggtgctgggaaaaatggataccataagcagaagaatgaaactagaccccatatgtctcaccatatacagaagtcaaatcaatattggctgatgacttatacctaaggcttcaaactatgaaactactgcaggaaaacattggggggaaactctccagaacattggtctgtgcaaaaatttcttgagcaataccccataagcacaggcaatcaaagcaaaaatggacaaatgggatcacatcaagtttaaaagcttttgcacagcaaaggatacaatcaacaaagtgaagagacaacccacagaataggagaaaatatttgcaaactacccatctgacaagggattagtaaccagagtatataaggaagtcaaacaactctacaagaaaaaaactctaataatccaatcaaaaatgaatgaaagatttaaatagacacttcaaatgggaaacacacagccacatgaaaaggtgctcaacaccattgatcatcagagaaatgcaaatcaaaactacaatgagatatcatgtcaccccagttaaaatggcttgtatccaaaagacaggcaataacaaatgctggtgagggtgtggagaaaagggaactctcatacactgttgttgggaatgtaaattagtacaaccactatacagaacagtttggaggttcctcaaaaaactaaaaatggagctaccatatgactcagcaatcccactgctggttatagaactaaaagaaagtaaatcattatatcgaagagatatctgcactcccatgtttgttgcagcactattcacaatagccaagattttgaaacaacctaagagtccatcaacagatgaatgggtaaagaaaatgtcactattcagccataaaaaagaatgtgattctgttatttgcaacaacatggatgtaactggagatcattatgttaagtgaaataagccaggcacaaaaagactaacattgcatgttttcatttatttgtgggatctaaaaatcaaaacaattgaacttatggagagtagaaggatggttactagaggctaggaagggtagaggtgtggtggggcatggggaggtagggatggttaatggacacaaaaattagaataaataagacctagtatttgatagcacaacaaagtgactatagtctaataataacttaattgaacatttaaaaataactaaaataatataattagattgtttgctgcacaaaggataaatgcttgaggtgatggataccccattctccatgatgtgattattattcattgcatgcttgtatcaaaacatctcatgtaccccataaatatatccacctagtatgtactgacaaaaattaaaaatataaaattaaaacatttaaaaaaattttaaacttttccaagcttactttaaaaatattactcagtacaactaacaaagtaatacaaagtaacacatatatagagaaaaaagtttaaccatttccacctgcttgcttctccattcctcgcttctctgacaatgtcacttccttattcatacttcaaatc

SEQ ID NO: 14822 - DNA, 7661 bp, Human
agatgacattgtaagaatttttaaacgagtgctttcagtttgaggttttttctgcccattagattataatttgtgaaactgtttcctctgtagtttttgcttcttgacaaaagagaagcaaatttttccttaccttttccttttccaagtctgcagtgtctaattcctaccccgcttcctacaaaacacatcctaacccttggaaactcataagcttgtttctcttagcaataaaaacctaaggaatctgaaatatattcataataaagttataaagcactcacgaagtttaatgtctgcaagtctccctacagagtacccccatatgtgcatcttgacagaagaccatgtccaaagccaaggcgcttttaagtgacagtattctccataaaatcacaaagagtaacacaaggctgggtgtcgtggctcacgcctgtaatcccaggcgcctcgcgaggcagatggatcacctgaggtcaggagttcgagaccagcctggccaacatggtgaaacgtcttctactaaaaatacaaaaagtagccgggtatggtagcgcaagcctgtaattccagctacttcggaggctgaggcatgagaattgcttgaacccgggaggcagcggttgcagttagtggggatagcagccactgcactccagcctgggcgacacagtgagactccgtctcaaaaaaacaaaaaaaattaaaaacaaaaaaaaagcaacacgatagaaacaactccttcttataggcctgcctgagttttatttcctgccctccccaatcacccaccctaggtgctttgacaggcaattcgcgctgtctggcacgcagaagcagacgccaaaataaaaacaaaaacaaattttaaaaaaaaatttgttaaaaagaaggggttagactgggcccaaagttctcccctctcccccaaagatccacgaagtgaccatttctccgcgcccctgggtccccactctctcccgtaaaaagccagctcacgcaccctgcagcgctgccaagatccccacgatgcctgtccccgcacccagttcgatcaccttcttgcctcggaaatccacattttgactctcgaaataattgcacaggctcagggcctacgggagaaaagacagagaaaaagacagtcgtgaggatggctccatatgggagaggcggagtccgggatctggacctcccacggaccctcacccggcgcagcccattcctcaccgcgtcccacacgcgcgccgccaccccgaggcgggacccaaagttctgcgtgatggtcagcacatgcccacagaaacagaactggctcttctccgagtaagagtctgcaaagagcccgacctcccgcgggaacaccgattccgactcagattcgggatctgggccggggtccgccatccggcccgccaagggagtgcctgggcaccgcggccggcgctcagatcccggatccggagcggggtagaggctgggggccgcgagccgtcgtggtgtccctgtggaacgagccccgcctccctgagtttgccctccttcctccagttcgatttcctggaggtggaatgaggagctgcccctcccgccccggccccgagcgcacactcgacgaaacccacacgggaccacaagagtcagaccgggcggactggtccgagaccaggagtaaggggacaggagcgaggactgatgccactgtagaaggcgaggtctctagacccctctcacctgtggggtgcacaggtgcctgcaaccaggatggtaacccagaccaggcagaagcaagctaagagaaaacgttgggtccctgggcctggcctcgccctcccagttggaggctaacggtgcggaggttccctccagcactcgctccttacagccctccccacctagcccagcccagcccagcccagcccagctgaatttgctcttgggtctttaaggggcgggaactgccaccaacgcgcatggctgcgtcattaacttgcgcctctggcctgcgcctccacgtggatttggtagagaaaccccggactgggatcatggcagccgagactcggaacgtggccggagcagaggccccaccgccccagaagcgctactaccggcaacgtgctcactccaaccccatggcggaccacacgctgcgctagtgaggagtgggcagagggagagagaggagggcgggattctcaaagcagccgggagagcagttgtgctgcaactgctgggaggatttggggtagacccgggaggatcagatgggtgacgtcagtttttgggggtgggaccgggagattcgaccgagagaggagttggcgggttgagagtgggcgtggcgttcgggcctaagtctgggtagcggtgctaagtttgggaagagaaataaattgttactgagactgaagtgatagaggcagaatgtcgtttccatcttttgcttttgtttgttggatttaataaaaaggcaaacatatacacaatcctgcccgcaccttaccttaccttccctccccgcagagcacaaacacaaagtaggatcccagtgcattaggcagccagtctcgggagaaggggaacttgtgccccagaaagggcagttacccggccagggtcacatcaaccgccagaagtggagttgggcaggtcagcgtttatgggcctcatgatggtcctatgattcacactgggagttaagggtggtttccattgtccctcttagaggccacagggcccagtgttacagaatttttgagaaaccctcctcccttttacctcccaccctcacccacccacacactctcacagtaccacttctgcaatggtgtgaccaaccttctcatgcttcttatgtcttctttccaatagccctgtgaagccagaggagatggactggtctgagctatacccagagttcttcgctccactcactcaaaatcagagccacgatgacccaaaggataagaaagaaaagagagctcaggcccaagtggagtttgcagacataggctgtggctatggtggcctgttaggtaacactcaggccctctttttggggtgagaagaggcctagtagcttctgctgcctcagcaacttttgtggggggtcataattggcctttcccctttcgtccagacactggtgacatcagcatggagaggctccacctaccctctactctgggtctgtgacctttgccctggagagtggagggggctgcctcaaatgcttcttaaaacctgggttgtcctttctggcgtcaatccctacatgagccatttcatctgccaggttccgggtcagtgagctggtcagcacaagcatcagagattagccgttgtggccagtgatcctgaactgtcttttctcagagattctaccatctcccctcccctttgcccctccctcgccagatctcattccttctgccccactctcctgttttttgggttcctcttgtattgtctgtattgtcccacccatgcatgccaagccactccctatttttagatcttcccaaacagataacagcctgatagagaagaagagcatggtacatagaggcagaaaaccttggtttaaggtccagttctgcctgggcacagtggctcacacctgtaatcccaacactttgggaggctgaggcaggtggaccacttgaggccaggagttcaagaccagctactcaggaggctgaggcaggagaattacttgaacctgggaggcagagattgcagtgagccaagattgtgccactgcactccagcctgggtgacagagcaagactccatctcaaataaataagttccagttctgccccttcttaactctatgatcttcggcatatctgaccctcagtttccttatcttcacaatttaccacagagtgttataaggatgaaataacacaatgtgtgaaaacactgtggaaaactctaaagcaatggcaaatatacatgtatcctcagccctcccattctggtcctggtgacaattttcatttctccccccgcctcttgagcataaaactatccatatatgtatctctgtcctctcttgccgttctggactttggtagttgcaggttgaggcttcctttcctgtgttgacccctttgcacttcctacaagtatatggttgatgattccattgctatttctgtgtgcagtggaactgtcaccgctgttcccagacacacttattctgggtctggagatccgggtgaaggtctcagactatgtacaagaccggattcgggccctacgcgcagctcctgcaggtggcttccagaacatcgcctgtctccgtagcaatgccatgaagcaccttcctaacttcttctacaagggccaggtggggaggggccctggtgggttaggctggtaggcaggtgggggcatggaggccaggctctcacaaccctgttggtgtgtgtctgtctcacagctgacaaagatgttcttcctcttccccgacccacatttcaagcggacaaagcacaagtggcgaatcatcagtcccaccctgctagcagaatatgcctacgtgctaagagttggggtgagttgggatcggagggatgatggggtgagtggcctactcaggggcccttcactaagaattcagtgggggtgcatttagggactcacaccaccacttccttcatctggctgctgacgttgcatgcagcctcctgtctagggtgattttgcctatgcaggggctggtgtataccataaccgatgtgctggagctacacgactggatgtgcactcatttcgaagagcacccactgtttgagcgtgtgcctctggaggacctggtgagtaggggacctagaggaggtggaggccctttccagagtggttctgtatttggacttaactcagtgccaggaggatgggataggtgtctaagggccaggggcagtctgaacagtgggcaaggacttattggacccttccttctcccagagtgaagaccccgttgtgggacatctaggcacctcaactgaggaggggaagaaagttctacgtaatggagggaagaatttcccagccatcttccgaagaatacaagatcccgtcctccaggcagtgacctcccaaaccagcctgcctggtcactgactgcttactctaccttagctggacctcgtctcccagggattagagaaaagagcaggagtcctgggtcttcccagttgagactgctggagctgagacacagtactctcttaaagaaggtggggagctgcccagggcagaacccactggtgttcatgactacccctggctcctctcaccttgtccctccactgccaacagaaaacaaagcagctgactgagatggtcaaaggactttggaccataggggatctttggaaggctgtggggtcttgctcttccttagcactcctttctccttgtgagatctctcctcagctggaatgaggaatgtagtccatctaaactgcttgctaggctcaattaccacttctgtttgctttgtggatcctgggataacatgtatatgtgtacacatgcctattctgccatttctcaggaaagggtggagtatgtatcatatgccttctaccatcctcctgtcctctccctgcgtaagacttgacctggggaatctgtgttccctaagtgttgtctctggagagtccttgggaaggtgtgggggtggagaccctctcctttttcacattgaccttcaattccagaacttcagagctagctgactggcacagagcctgatagagttgcagtggggaatgagggagtaaggagcagagaggtaaactgtgggagattcttttattttaattttttttagagacaggccctctctctgttgcctaggctggagtgcagtggtacaatcataactcactgcagccttgacctcccgggctcatgtaatccacctcagcctctcaaggcactacaggcatacgccaccatgcctggctaatttttgtattttttgtagagacagttccactatgttgcccaggctggtctcagactcctgagctcaagcagtctgcccaccttagcctcccaaagtgttgggattacagtcatgagctgccgtgcccagcctaatttttaaacttcttctgtagagacagtcttgctatgttgctcaagcttgtctcaacctcctggcctcatgccatcctcctgcctcagcctcccaaagtgctgggattataggcatgagccaccacaggattctgaggctaaaagtagaaaggagctgctaaccagaaagccccccagaggagaccgagtcagctggggaattagaacatccacatccatttagctcctctaacaccccacagacaatctctgaacttaactaatgtacaaaaagtttcatttctgcttctcaagccccaaattcccatgtctggaaggagggggcttgtatacccaagagacccccttatcctcaagaaagaaagatggaggttctaggagccattttagcccattaacccacctgccatctgcccagtatatgttaggtacaggaggagggggaggtgtggctagtgcaggaaaataatgcagagaagatacaacccactaagccaagaatgtggggacagttacagctgtgcctcccctgcttcccttcctggaggagctgaaagatggggaattcctgaggatgggcctaaaggggctgggctcactggtagaagtgggaatatcagagactgactagtgtagcttggtcacctagtccctactaaaaagccttatagcctttcctaggatgagactttgaggctcctagacaaaggcactctcccaggaggaaaatcttaggccctccctcccatgagggtcattgcaacatgagacccaagggagttgtgaagtcagccccagccccgcctactgttcctgggtgctaatccccagcacagaccactcaggaggagggattggctgaggagcttggagagggggcgtcatcacctcacccaaaggttaaataggggttgagatatgatgctcaggagaagcgctttctttcgcgagcaccctgaaccagaccatgacccagaccctcaagtacgcctccagagtgttccatcgcgtccgctgggcgcccgagttgggcgcctccctaggctaccgagagtaccactcagcacgccggagcttggcagacatcccaggcccctctacgcccagctttctggccgaacttttctgcaagggggggctgtcgaggctacacgagctgcaggtaggaagggacgcctttcccgagacagagtgctggggaaactggttttgacagcgtcagaaaggactgactagtgcagagcaaatgtgggacagccagagagaacggatgcccatgaaataaggaaaaggcgagttgaggctgggggcggtgtggctacactcgggcagagcccgtcccgactcttagcagagggcgctgcgaaagcgccttctcgctgtcctgaggtgtggagatcctgcagataaagtacaagtgcgcgggagggggaggccggagtgggcagtaccctccgcctgcttgcggcttaaagctacatgggttccttttcattcactgaggactcgtcctgagatggacagtccagacatggaac

SEQ ID NO: 14823 - DNA, 7661 bp, Human; identical to SEQ ID NO: 14822

SEQ ID NO: 14824 - DNA, 7661 bp, Human; identical to SEQ ID NO: 14822

SEQ ID NO: 14825 - DNA, 7661 bp, Human; identical to SEQ ID NO: 14822

SEQ ID NO: 14826 - DNA, 115508 bp, Human; identical to SEQ ID NO: 11800

SEQ ID NO: 14827 - DNA, 115508 bp, Human; identical to SEQ ID NO: 11800

SEQ ID NO: 14828 - DNA, 113876 bp, Human
cagcgatgcgagggcaaagcgctctcggcggtgcggtgtgagccacctcccggcgctgcctgtctcctccagcagctccccaagggataggctctgcccttggtggtcgaccctcaggccctcggctctcccagggcgactctgacgaggggtagggggtggtccccgggaggacccagaggaaaggcggggacaagaagggaggggaaggggaaagaggaagaggcatcatccctagcccaaccgctcccgatctccacaagagtgctcgtgaccctaaacttaacgtgaggcgcaaaagcgcccccactttcccgccttgcgcggccaggcaggcggctggagttgatggctcaccccgcgccccctgccccatccccatccgagatagggacgaggagcacgctgcagggaaagcagcgagcgccgggagaggggcgggcagaagcgctgacaaatcagcggtgggggcggagagccgaggagaaggagaaggaggaggactaggaggaggaggacggcgacgaccagaaggggcccaagagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacaggttagcgggtttgcctcccactcccccagcctcgcgtcgccggctcacagcggcctcctctggggacagtcccccccgggtgccgcctccgcccttcctgtgcgctccttttccttcttctttcctattaaatattatttgggaattgtttaaattttttttttaaaaaaagagagaggcggggaggagtcggagttgtggagaagcagagggactcaggtaagtacctgtggatctaaacgggcgtctttggaaatcctggagaacgccggatgggagacgaatggtcgtgggcaccgggagggggtggtgctgccatgaggacccgctgggccaggtctctgggaggtgagtacttgtccctttggggagcctaaggaaagagacttgacctggctttcgtcctgcttctgatattcccttctccacaagggctgagagattaggctgcttctccgggatccgcttttccccgggaaacgcgaggatgctccatggagcgtgagcatccaacttttctctcacataaaatctgtctgcccgctctcttggtttttctctgtaaagtaagcaagctgcgtttggcaaataatgaaatggaagtgcagggaggccaagtcaacaggtggtaacgggttaacaagtgctggcgcggggtccgctagggtggaggctgagaacgccccctcgggtggctggcgcggggttggagacggcccgcgagtgtgagcggcgcctgctcagggtagatagctgagggcgggggtggatgttggatggattagaaccatcacacttgggcccgctgtttgcctgaggttgaaccacaccccgagtgagcagttagttctgttgcctacgcctttccaccatcaacctgttagccttcttctgggattcatgttaaggatacccctgaccctaagcctccagcttccatgcttctaactcatactgttaccctttagaccccgggaatttaaaaaaggggttaatcttttcatgcaactccacttctgaaatgcagtaataacaactcagaggattcatcctaatccgtggttaggtggctagacttttactagccaagatggatgggagatgctaaatttttaatgccagagctaaaaatgtctgctttgtccaatggttaaatgagtgtacacttaaaagagtctcacactttggagggtttctcatgatttttcagtgttttttgtttatttttccccgaaagttctcattcaaagtgtattttatgttttccagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggtaggtaaaccccaaatgtcagtttggtgcttgttcatgagtgatgggttaggataatcaatactctaaatgctggtagttctctctcttgattcatttttgcatcattgcttgtcaaaaaggtggactgagtcagaggtatgtgtaggtaggtgaatgtgaacgtgtgtatttgagctaatagtaaaaaatgcgactgtttgcttttccagatttttaattttgccctaatatttatgactttttaaaaatgaatgtttctgtacctacataattctatttcagagaacagttttaaaaactcatagtcttttaaaaaataatcaagaatattcttaagaatcaaaatcattgatggatctgtgatttcttttaccatcatgaaaaatgtttgtcaattttaatccattctgatttttaaaatatgactttgatatgcccctgtgatgtgtataaagagacctatttgtggccctaaaatggaaagaacagattagtctttgatagagttacttcatgtgatcatttggtctctgtgaacactgaggacagagaaaagtgcttgagggctgctactaatctctcagaaacatttgtatagttcatccatcaaatgacacacatactaaaagaataaagaaattgatgcttattacctacttgttcctaaagttccaccttggggtatacacccaaactctgactctcttttctgtaacttgaactgtattcaattgagtgttattttacaaaccactttgaattccttggaaaagaatagacacacactctcatccacaggcatagacacacacactcaacacagacacattgcccattcttcctctcttctttctcctctgagctttttcacattctctggtggcaactatagcagtaagagtcacaggatgaacagtcaggtggaggatgaccacattgagttgcctagctgaaacatgtgctccgtctatgtctgcaaagtgaaagaaagctacactatctcttcaacatagatcagtgggggaaattttatacttgggatgatttatatgaatgcatctcatcaaagttcacaacacatttttttttcagttttttattttcagtttttagagtcagggccttgctctgtcgcccaggctggactgcagtgatgctatcatagctcactgcatccttgaattcctgggctcaagtcatgcccccacctcagcctcctgagtagccaggattataggcatgtgccactgcctcattatttagacttttcttatgttgacttaatcttcccacaaatcttcaattaaattactttttttctaccttaaaacatattttcagaaagtcattgaaatagggtgttacaagaggaaaaaattgatgagttaattttaaatattttatgaagtgtgaattatacctttttagatggaatttggaatactgaatcagtgacatgcagtttatcaatatctttccgtttgtcctcagatttccaagttctgcaagcacaagtttctttgacttagttaccttttaactgttcattgaaatcattttcaatgtctctcatggcatttaacacatagcacattctataaattttttattggttacattctgagttctaattgagagttgaacttacacacagaatttaagataaaaaatgaccatgtgaagacacaatagtatagtccagggattggcaaaattttgggtaaggaatcagatagcacgtattttaagccatgagatctatgtcttggccaggtgccgtggctcaggtctttaatcccagcactttgagagcccgaggctggtggatcacttgagcccaggggtttgagaccagcctgggccacatggtgaaaccctgtgtctacaaacaacgcaaaaattagccgggtatggtagcatgcatgtgtattgccagctacccaggaggctgaggtaggaggatggcttgagccatacagctcactgcagaggttgcagtgagctgagatcgagccactgcactccagcctgggtggcagagtgataccctgtctaaaaaaaagaaaaaaaaatctatgtctcaattctgctgttgaagtgtgaaggtagtcataaacaataactagtgtggctgtgtcccaataaaacttcatttatcaaaacaggtggtgggctggaattgtcttgtatgttgtagcttgctgactactgatagagtggaaagaacatgcactaatcacacaaaccaaagttttagttgagactacatcacttatcacctttagggtcttggggaagcgtacttaacatctctgagcatcacttccctgattagtaaaaaatatgatttagaaaactgcaactaccttgcagtttttgtgggaatgtcataataagacaggacatatgaataattgagcacacttttatatataggaaccatggttattattatcaaataaactctccaacggaataattactttgccaacacgttttccatttattcttttatccttcattacataactagtttgaaagattggaggcgaccaaagaccattttataatttcacttatggctgaagatgtttggtagaagcctcataagaaaagtaatctcattcctttataagaatatacttttaacaactactttttaactcattgaagaactaccttaatgatcagtgttatttttatgggttttgttccctccatttttgttatctgcgtacaccaattttcaatcaacatacttcaatttaatagacaaaaatttcttcaaatgactcagaaattaattagatctaaatccaaaagcagaaagatttaattatctttatataatgctcagtaatataaatgcaataaatacaagaaaatgatgatctttgagtgtcttccaatgccactctgctcaataagcagcagtggccatcagtgaaattgatagcaaattctcaagtcaaaatgtgcttcacctcactaagctgacaaagtcaacataacatgcacaacagggataactgagttctcaaaactctcaggtattacttctgaccttcttctccactctgtgctcttttgaggttgggaagacaagatagggtgtgtgtgggacacctccgctcagggaagccatcagctctggtgtccctacagcatttataccttgctagtcacataaccacttggcacctattttgtaggtgtacgttatcaattacagattactcataaattaaaggctaaccatcaattacagattattagtaaataattatgacctcaaagaacaactgattggtttgatacatggtaaccttatgaggactctcatttatctcgtttttttaagttatatacctatctctttggggttgcactacaaaaatataaaatatgttgcataagatatttataaaaaataattaattataagttctagtggtgtggtttagtggcattcttttttttttctttttttctgagatagggtctcaatctgtcacttcactccaggctgaagtgcagtggtgtgatctcggctcactgcaacctccgcctcctgggttcaagttattctcctgactcagcctcctgagtagctgaaattacaggcatgcaccaccatgcccggctaatttttgtatttttagtagagatggggtttcaccatgttagccaggatggtctcgaactcctgatctcatcatccccgacctcggcctcccaaaatgctgggattacaggcgtgagccattgcacccggcctagtggcattcttttttaaaaataaatttaattgtgtatatttagggtatgcaacatgatgctatcagatacattagacactaaaaaattactatattgaagcaaattaatatattcataatctctcatagttaccttttttgttgtttttgtggcaagggcagctaaaatccacttatttatcatgaatctcaaatatagtacaattttatcacctacagtcctcatacattagatctgtacactttttcatcttacacatctgctacttgcttggatcctatggcctatatgtccctattttctacctacttttccacccctattaaccctgttttttacgtagtctctgtatatttgaattttgtttcaagcttccacatatatgtgagataatgtaatatttttctttctgtgtttggcttatttcacttagcataattttgtctgggttcatccatgttgtaaatggtaggatcttgtttttttagggctgactgatattccattgtatctatgtaccacaatctttttatctacctatctatcagtagacactttagttgtggctattatgtttttctttttttcttttttggagacagggtcttgctgtcacccaggctgcaatggagtggtgttatcatagctcactgtaacctcaaacttctgggctcaagagatcctcctgccttggcctcccaagtagctgggactacaggcatacattaccatgcctggctaatttttaatattttttgtagatatagcatctcactctgttgcccagactggtctcaaactcctaattcaaatttagaatagagtatgacaattctgtaaaatataaaaaacatgtccactccgtataggaagttatacaatgagaagaagacaaacactatttacattactcttgataagttttttacaaagaaataaaacactttaatttctaatgttttaaattctggtttgctaaataaataaatattagttttagtgtttttaaaattccttatatagttataagtgatcttcctgcctcagcctcccaaagcactgggattccaagcaagagccactgtgttggggcccttggaaacagatatgctgaaatcttttcttgtggatctacacccagaagagggattgctgggtcatatgctactctatttttaatttttcttttatttttagtgaatatgtaataattgtatataattgtgggatccagaattatatttccatacatgtatacaatgtgtgataatcaaattagggtaattaacatatccattacctgaaacatttatcattcctttgtggtgggaacagtaaaaattaaaaattctctcttctagatttttgaacatatgcaataaactattgttaagtatatcaccctacagtactacagaatgctagaactcattcctcatatttggctccaatttcatattctttaaccaacctctccatatcctcccctccctcttaccgttgtcagcctctaataatcataattctactctctacttctatctcattgtctttgatttagaatatgtttcataatttaaccaaaggtcaaattcttaggtactgctaaggcaaagaacaaagatcgcattccagctgttagacatttcttactactagtcatttttaagacaacatggggtgcaggtggtgaggatgagagatagagattgaaacatattctcttaaatatcagctgttctcactctgcatagttccagcacaaacaaattccaggtactatggttagttaaataacaccagccactaacaacacaattcaaatttctgttaccacagtataccgaaagtcattgcataaagtacaaactttgctgctaactcttcagccttcaaatcattacataaataacagaaacccattataatcagtgacaaaaccacagcacttctttcaaagctttttggagattggttgcttcacatctgttatgcagttcatacagacagcaatgcccggacttgtgtggccacattgtctcccagtggtgagcccatgtgatgtttcacgaaaatgcgcaatcaaaagaggaaactggccagcaaagatgaaagagtagcaaacaaaggaagtgaaacattctggaagtaaaatttgaatcaaacataagttgatgtatacaggaagtagctaccctgaggatgttgtcactgctgcaattcaggagactctaaatatgcagtcagaggaacgtagtgaggtgaaggtatccgtataatggggaaagaggttgtgataaagagtgaaggtgtcccagaggaagcgatgctgaaaaatacaccttatgttaaatacactgtcagtatatcatgacattaaagtgcaaatgataacattttgtaaactgatccaaacttaaaaaggagtatgataattctgtaaaacataaaaatcatgccgattccataaattatacagtgtgaattacactgaaaaatccaacattagagaggatatgaatacaattttttacaagcataattttaataatacacataataattatttgtattcaagtttagtaatgttcaaggtttggaagaaattctgatcctgtgtagagaccctagtttgaatgtgcttatagcctattattacatgtgtaatgttacataaattacttaactcggatttttaatttcatcagctatttaaaatgggcataatataactatattaaatggctgttatgaagattaaataagatgatatgtaaaatgtgttttttgtttgtttgtttgtttgtctgtttgtttttttgagacagagtcttgctctgttacccaggctggagtgcagtggcacaatcttggctcactgcaagttctgcctcccgagttcatgccattctcctgcctcagcccctcccaagtagctgggactacaggcacccgccaccacgcctggctaattttttgtatttttggtagagatggggtttcaccatattagccaggatggtctcgatctcctgacctcgtgatctgcccacctcggcctcccaaattgctgggattacaggcatgagccactgcgcccagcctaaaatgttttttttacataatgggtgttcagcacatgttaaagccttctctccatccttcttcccttttgtttcatgggttgactgatctgtctctagtgctgtacttttaaagcttctacagttctgaattcaaaattatcttctcactgggccccggtgttatctcattcttttttctcctctgtaagttgacatgtgatgtgggaacaaaggggataaagtcattattttgtgctaaaatcgtaattggagaggacctcctgttagctgggctttcttctatttattgtggtggttactggagttccttcttctagttttaggatatatatatatatttttttctttccctgaagatataataatatatatacttctgaagattgagatttttaaattagttgtattgaaaactagctaatcagcaatttaaggctagcttgagacttatgtcttgaatttgtttttgtaggctccaaaaccaaggagggagtggtgcatggtgtggcaacaggtaagctccattgtgcttatatccaaagatgatatttaaagtatctagtgattagtgtggcccagtattcaagattcctatgaaattgtaaaacaatcactgagcattctaagaacatatcagtcttattgaaactgaattctttataaagtatttttaaataggtaaatattgattataaataaaaaatatacttgccaagaataatgagggctttgaattgataagctatgtttaatttatagtaagtgggcatttaaatattctgaccaaaaatgtattgacaaactgctgacaaaaataaaatgtgaatattgccataattttaaaaaaagtaaaatttctgttgattacagtaaaatattttgaccttaaattatgttgattacaatattcctttgataattcagagtgcatttcaggaaacacccttggacagtcagtaaattgtttattgtatttatctttgtattgttatggtatagctatttgtacaaatattattgtgcaattattacatttctgattatattattcatttggcctaaatttaccgagaatttgaacaagtcaattaggtttacaatcaagaaatatcaaaaatgatgaaaaggatgataatcatcatcagatgttgaggaagatgaggatgagagtgccagaaatagagaaatcaaaggagaaccaaaatttaacaaattaaaagcccacagacttgctgtaattaagttttctgttgtaagtactccacgtttcctggcagatgtggtgaagcaaaagatataatcagaaatataatttatatgatcggaaagcattaaacacaatagtgcctatacaaataaaatgttcctatcactgacttctaaaatggaaatgaggacaatgatatgggaatcttaatacagtgttgtggatatgactaaaaacacaggagtcagatcttcttggttcaacttcctgcttactccttaccagctgtgtgttttttgcaagattcttcacctctgtgtgatttagcttcctcatctataaaataattcagtgaattaatgtacacaaaacatctggaaaacaaaagcaaacaatatgtattttataagtgttacttatagttttatagtgaactttcttgtgcaacatttttacaactagtggagaaaaatatttctttaaatgaatacttttgatttaaaaatcagagtgtaaaaataaaacagactcctttgaaactagttctgttagaagttaattgtgcacctttaatgggctctgttgcaatccaacagagaagtagttaagtaagtggactatgatgccttctagggacctcctataaatatgatattgtgaagcatgattataataagaactagataacagacaggtggagactccactatctgaagagggtcaacctagatgaatggtgttccatttagtagttgaggaagaacccatgaggtttagaaagcagacaagcatgtggcaagttctggagtcagtggtaaaaattaaagaacccaactattactgtcacctgatgatctaatggagactgtggagatgggctgcatttttttagtcttttccagaatgccaaaatgtaaacacatatctgtgtgtgtgtgtgtgtgtgtgtgtgtgtgcgtgtgtgtgagagagagagagagactgaagtttgtacaattagacattttataaaatgttttctgaaggacagtggctcacaatcttaagtttctaacattgtacaatgttgggagactttgtatactttattttctctttagcgtattaaggaatctgagatgtcctacagtaaagaaatttgcattacatagttaaaatcagggttattcaaactttttgattattgaaaactttcttcattagttactagggttgaatgaaactagtgttccacagaaaactatgggaaatgttgctaggcagtaaggacatggtgatttcagcatgtgcaatatttacagcgattgcacccatggaccaccctggcagtagtgaaataaccaaaaatgctgtcataactagtatggctatgagaaacacattgggataaatcggctgctatcataatcattcctctcccacatcagataaatgaattaactttttgaatagggttatttaatataaagtgcttaagtctaattatgagaagaaataagataattacacttcaatggttaaagagagggagaataatttgcatattatgcctgatgtaaaatgtttattatgggtacatattaagtgctaactaattgttaattgttcttgctacaagtcttaatgcagggaaacaagaaattattacatagtacctaatattatcttctaatattaaagaaacaatttcccctaaattcatcccattagctttttttttttcggtggggcaggggagaaatacagacttcagtaaacttgggctgggaactttctacctacaaagttcaaataaaataaattatcctagttagataatatcaatgaaaaatccaccaacttaaatcctggctgtttgatctcaggaaattatttcagttatcaacttaatgcatcatattatagaaatatatgaaaatgtgtttaattaaacttactgaatgatatgttttttaaggtactttaaaaataaactatgatataaagttacctatttttcatgcaagtatagtataaagaaatttctaacactggagattttctgaaggttttgattcttataaatttattacatcataatgaacaaaactaattttcaacatattatgatttaaatttccttagtaaattgttttaaatttattttctttaaatccatatttacatatgtatatttaaatatacatatttacttgtataacaattcaaaaccatatattaattttataattttgtttaatgtcaaaggttagatttggctatatctattctaaaagttggtatcacatttcctttttggaattttatttttaaagtagctaaagtcaaatataaacctattatttatattaatgcagacattagaggtagacactaaattcgttttagtatattctaaattatttattatctactatgaaataatataaagaaaaataaagcagaatccctgatttcaaagaactcaattgccgaaaaacagttaccatttattagacccaaaatgtactaatatgagtgtgtctcttttccttttgttttgtcacccgtcatttggaatgtcagtgagtagagagatagtgtgaaaggccctcaaggggaaaaatagaggttaaaggtcagcagagaccctactagagaaatcagttctacagaaatgtttttaaatgtgtcgattattgctacatgtacactctgtcattttgtaatgtagccattttatttatgattataataataaaacaacaaaattataataatgtgtagagtacattttactgtgcagtgtattgcattaaaactagattaaaatttatacatatataaaaggctatctagatattataaaatttatggctggatctgtaaaaaattcaaaacctatttttaatctcgctttgagattttataacaagaaaatgttcgtttcaagcaaaattttcaattcacgtccttgaaaaggaaaaaaatgacaacttgaaacacataattgactatttttaaaggatcaacatttcagaaatgttttaaaacataagattttcagtacagcttttcgctggcatttaaatcgaactttgaattgtaaatagctcttgctcttaaggagacatcagccatatccttagaagtggcacggagttgttaggtagttgtacaaaattctagcctaaaagacaaatagggagcaacactactgtggaccgtttctggtcttgggctgtgtggctatgtcaggcttgcccacattgcctgtactaaggagaaagcctcttgtccttacagacccccttagcttacatagtctatttgaaaacaaattgctttgtccacaccatttaaatattggcttcaggccaggcgcggtggctcacgcctgttatcccagcactttgggaggctgaggcgggcagatcacgaggtcaggagatcgagaccatcctggctaacacggtgaaaccctgtctctactaaaaatataaaaaaattagccgggtgtggtggcgcgcacctgtagtcccagctgctggggaggctgaggcaggagaatggcctgaacccgggagtcggagtttgcagtgagccgacatcgtgccactgcactccagcctgggtgacagagcaagactccgtctcaaaataaataaataaataaataaataagtaaatattggcttcttcaactggtgagatgaaacctatacaatagtcatgtgaatagcactaaacagctgacatggtgtaactcctctcagactgaggcttatctggggagtacaaagcatgtcaagaaaatgtgccttcatttccttagatgagtgtccccatcctccactctcctccactgttctcctctctgcttctatgatatcaacttttttttttctttagattccacatgagtgagatcatgtggttgtttgcctttctgtttctggcttatttaactgaacaagaaagtttttgacatgaaattaaacttctgcttgtaaactcaattcaaactatttacactgtcttctcaaaaatgttaacttattttaataaatctactgaatgaccgtatctcattttgttttatgaaaagaaattgtaagggtgctcaatagcctcttcattttcatactgtctagctcctgtgctcctattaaaattactgcaaatttagctttttaagaaccctttgtttcactacctgaagttctataaaaagatccaagttccttcacaaccgtttcttatgctgttattcgtacatatgtgataataccacgtctgaacacgtagataataagtaggggctgggtgcggtggatcatgcctataatcctagcactttgggaggctaaggcgggtggatcacctgaggttaggagttcgagaccggcctggccaacatgatgaaaccctgtttctactaaaaatacaaataataataataataataattagccaggtgtggttgtgggcacctgtaatcccagctactcgggagactgaggcaggagaatagcttgaactcaggaggcggaggttgctgtgagctgagattgtgccattgcattccagcctgaacaacaagaatgaaactccatctcaaataaataaataaatagaagtatgtattgtgttgcttagaaggtgtggtggaaattaacttgctgagtgagatcaaaggattggcactgaattgaaataaagaaatattcatgctgagtctggttcaaatataactgcacctgtaagaattgctttctgtaaactttccatagtataaaccaaatccaaatcactcatggctttacattcctgatcgttaaacttgaagcactttttaatactgcatgactttagccaaaatatcttagccaagattcaatgtttggttgaaccacactcacttggacatcttggtggcttttgtttcttctgaccactcagttatctatggcatgtgtagatacaggtgtatggaagccgatggctagtggaagtggaatgattttaagtcactgttattctaccaccctttaatctgttgttgctctttatttgtaccagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaaggtatggctgtgtacgttttgtgttacatttataagctggtgagattacggttcattttcatgtgaggcctggaggcaggagcaagatacttactgtggggaacggctacctgaccctccccttgtgaaaaagtgctacctttatattggtcttgcttgtttcaggcattaacccagataaatgccatgcaaattttataattattatgattgtttcaatttctggaagaaagttaatgaaacaaaaaatgtagtaaaatgccaaaggaacagtgacatttcagaaagaatgagggctttcatgttaattgtaagtcttggaatttctcttccttggagtaacaaatccctttgtgcctaatttcctaatttccaaaataaagttcttttacttatttctttatagtgacatcatctcttattaaatggcatatctgcatattacataacagttcattgccaaatacatatttgtgggaaatgagagacttaaaatacataccaaccagagatatagttttgaggtagattttaaaattctgagaagaattttgactgaatttttttgacaaacatgggacacgaataagattataccaaagatattataactttcattttaaatatggaactaatacagtatgaggtgtcaacaacgttgaagtttcacaaacatcaccactacaacagcaaaataatttttgctttttccctgccacaatgacctccttgctatttcttgaataaatcaagcatacccttgccctgacacgttcttggggaggcctgccctaatctatataaaattggagccattcttctcacctctggtattcccagtctccctactttttttccttctttctttctttttctttttctttctttctttccttctttctctcttttctttctttctttactttcctttcctttctttcttttcccttccttccttccttcttcccttccttcctttctccctttctttctttctcttttttctttcttgcttccttccttccttctttccttttctttcttttcccttccttcctccctctctccctcccttccttcctccctttctttctttctcttttttctttcttgcttccttccttccttctttccttttctttctttttcctttctttgccaaagtgttattcacctttaaatataatacataatgtgcttactttaatgtatgatttttattttatttctcccttctagaatgtaggcaccatgagagtgaaatatatttattttgttcattgatatttcacaagtgtctgggagagtttccaacttacagtagacaattaacaaacatttattaaattaaggagggaaggaagtgagtaagcacaacaactttcatttctgggtcttttataatcatatgcttagtataagaacagtgctattcagctatccaaaagttacaatcaaaatgattttggatgaatatcttgaaaattgtgagaaagaagttttatttgctggcaaactattactgggttgtttccacttcatgtaatcctaagtagcagccttaccttgatagcccattaaaactctgataataaaaaggcagaacaaaaatatctgtgatatatttagatttactacatgtacttacatgtctagtgtctggtgcaatggatgctaatgatggcaaatccttactgggcttctagtgaagttcttcagctaatgtttgaatgcatggttggtcatggtggtacccctttgtacaaaatatgcttttcaaataatcttattagggataataattatattaattcctggtttccatctaaaattttaattctatttatagcttcgtaagatttcacaagttaagagggacctcagattaaattagtacacaggcaattaatcagttttgtgtctccgacccttttcacgggctaatagaagctatagaccctcttagcttcagaaaaatgcgcactcacatacgcacatcaaagagcttaatgggaagtccattgacagaccctctgttcagatcaatcttctgattgtagagatgaggaaacagaaatctacagaggaagtgggtagtccaagattgcacagtcatttggaatagactggacaccagtagtacttttccagccactatatcacttccccaagcacttcctcaaaacttaccttcctttgggtctttatacattcagttatggacaactagatttaactagaggattttattgcttcagaatattaagcaacagggaaacatgtaccgtcttttattcacctgcatttaaggcatacaatataaattgcaaatggagcatgaaagtgcttaatcttttacaaaactgggtttgctttccacccatctaaaaatacttctatttattttaatatttaaagcagaaatctaagtgatgtgacaaaattaatcatttggagatatttcccttataggtagtatagtttcttactgatttctaatatgaaaatgaagccatagaacctagaaattgcagcatagttgtggaaataaacattggactgagagtgaaaatggctagtcttcctctctgctcatacaccacctgactggataaccttttgcagatctcctaaaagtctttctcataaaatgaggaagctctactagaaaattgttgaagtctaatttagcaataaagttctgagtttctataataattcaaagaatactctaataaatgtctgcaattgtggtcacatctatgggatgctaaaaaatctggatggtttcaatgaaagtatttaatttgttcattatgaactttgaaataatttatttcattttttaaactttgatcaaaatgaccctggtaaatagaaataagcaaactctttttgcttgaaatgcttattaatgactgcattgagacactcattcatcattcaagaaagaatgtttgctcacactgtgccagaaacttggaggaagagggatgtgacaagtaggggtactggatgtctagcttgtagaagtggattaatggctctgcttttaagatcaggaacactgaaagggagtaatggcaccggttttcacctttcatgccctttgagggtatctggtccatcaccctctagttgatgagggagggaaagttccctctcccttcacaaataggtggaaattaaatgacataattctgaacaaccaataaatcgagagtaaatcaaagcagatacctgttttgttaatttgatcatatgaatgtagctgcccttagtaataatttctaagtataagactagttaaaggacaaatgagttatcttgaattataagattttgttttacagaacaatattaactcttgtgtttagtacattagaataatagatcttttgatccatatttttactcatgtgcacataagaagttatcagtcatacaattcatttcttgaagttcatacctttcattggcagagtagaaacaggttaaaagtgcacaggcagaaattttaagtgcaaagcaacagtgatgttatatagagaaaatttatatttcctacttctattgaagaagaaagatctgcttgttctaagaatattgtacaaagaaagtgacttgaatcagcgttattctgtaatgctactatgcgtgcagtgtggagtagccactagaacacttggtctatcccagctcctcaacagtgtcttgcttgtggctggtgctcaaataaatccttgctgaactaatgagcatctctttcatgccacatggaatgctctaaaagagttggatcctgaagtttttatatttttgtaattttctggagttttagagagcaaaagtcctgaataaactgtgaagccactgcctgacaaataatacagcagtcagcttcgttatcatatcccattgagacacgacttatctacatgatgattaatagttttcacgcaagaaataagcttgaaatgtctgttgccttggatacttaaaacatccaggttcagcgatgttatttattgttgttcaaaatcagaatgaagttcctaagcaatgccattttggaaaaattacatcaatatattatgaacaactttttttaaatcttgatttcaaatggattgacacgtgtatattctgtaataatcctgacttaattcataaaaggatagctagccagttgtgtgctagatgaataaaaaaaaagcaggttttaaaatgtcaggtttgacattgtgaatataatatctaagtatccttttactcatttcctttgacttactatggctgtcatgttgggcttcatgaaaatttatttttaaacacttgagtgttatggaccctctgattaaatgattaatcagatgatgtatgttgccatcagctgaatcatttaatgttgatttcacaaacaagcacaggtcacaggcaacatttcagatttctttgaagaagcacacacaggtcacaggcataatcttaaaataattttataacaaggtagtaataagagatgtcaggactggagaaatattttaatttatagtaagctttccccttaagtgtctaataattgttaatataatacattgcctcaaataattaaaagtttggttcttgtccttgtgcttgacttcagaagataaccagatgactattaggtatatttagacctaaattaaaagctttgagacacaatgaattgcctgatttgtatttgtgtttcgagtggcatatactattactggcactataatcttagattaaagcatactgtgattattaaagaaaaatttaagattgatttgtttctaaaggtatgtaacagtgacattttgcaatgtggtatgtaaaagttggtatttctcactcatatgagagcccactaatggtacataaactgtccccacttagaaacacaattattatggcctttctttgtatctgacaaaatttcactgggttcaagatggatgaatagtgaattctaatgacccttaatcctgtaaggttctaggtgggaaagtactctgtaattatgtataaaattataaggaaaataggcttactgctatgttttcattaaaaatcattaactgagtacttaatatgtgccagacactcagctgggcaccatgagaaatacaaaactgagtaacatatgggtggctcctgccttcaagaaatgggcagttcaggccgggagactgacatatttaccctgggaaaaagggagcagctgtggtctctgagaacaatatggtttgttacaagtatatatccatcatggaaaaaaagagatttatcttagaaatgagagaggctgatgctctcaataaatatcatacattaaattgtgtttttgtcagtagactgaaattacctcacatacacgcacagatagtagccatgatattttagctgcttagatatagagacaaatacttccacccaaatcttaggatcagtggttaatagtctgtaagcattacaatcccacaacatatgcatgactatacatccaattttaatattcaaagaactgattgcgatgatagttttgtttgtcaaagaaatgtattataggatgagtgggatagaactgcatcacgttacaccaacaaataggtttaaatcatatttgtgcacttcccttgttccttcataaatgtttaacatagcttaaaattctgtggactgcaacgtgagagcaatgaccacacttctgtgaacccatttttactgtgcatgtgctaacgtctattgttagtattccttcacttgcaaagatggcatgataattttgctggtttcattaatgagatactgttaaatgtaggatgacttcaaacttagttgtattgtaaaattatttttaattgtatacatttaagttgtacagcatgatgttttgagatacttatctttatttatatatatatataatatacacacgtatataaaagtgattcctacattgaagcaaattaacatacccatcatcatatggttatctttgcttttttactatcagtgcctaaaatctactttcttgaaaaattaccagtatgcactacaatattattaacaataatcttcatgttgtacattagatctttagacttactcatcttacatgacttaggtttgtttttacctctactaccatctgagccatatttccactttgtaatttgataataaacttggaaaaatagcacttatatgtttaggtgacgggcataaataggataagatgtgtttatatattattccatatatcttgtctccaactacaatgataaacaacctgtttgtccctaaaaagtaagaaataacttgacttttctgccccttcaagcataggctgttagcttttaagttttagggagacattgatgatgctatttgctttatcaagaggaaattgtcaaaagaggtcttttggttctcaaactattcaaagtatttaaaaatcaggacaaaatatgtttacgtgatattcaagggtacagaaatgaggtaaatgagatgccaattgtatttgtcatgcaaatatataattacgtgtatgagagttagatgatacatctcatcaatttaattgttcttctacaaggagaaaatgaacaatttgtcaactcgtatatgaagtaatttttataagaaattttattaaaacttttaacaacatttggatttttaagttgcaatttaaatatccccttctaccaggtgattctggaatcactaagcagttacttgtgaaaattccaaagtagcatttaattcttattaatgtcatagtgaatactaatgcaaagaatactgagccagaaattatgcttgttgaataaatagattatttattgaacaagtaagtgaaaaaatggaaataaagaacggatatatattttatcttcctgcttagatgtgggactgtcctacttttctctggtgttcacaacaacaatatgataaatctaattggaattcagttcataggaatgaattcagttacattatggattgtgatgaataatgtacacttttaatttaatgaaatcaaatagattttaactatctatgcttacaatggggtgacataagtctgacaatccttaatatcaagtcatctccaattcacatgtatacacactttttttctatttggctattgggaatcctcacaaaaatcgaaaattgccctttcagtgtacgttacggtatttcatgccacacagattttctgaggttgtacatacagctttgccttgaggttccaatttttgctcagtggattgagtatatattatttgctatatatcagaagaggcatgtgcttcctacttatgtcacgtaactttgggattaatgtaattgtcctacaaagcatagatagatagaaatacttcatccttaatttctaatattatgacatatctaaagtaggcacctttaaaagataatctccactaaatacgaatgactgcttatagtggcaattcatctttcatggtagtcctcctacaaaggtatactaacatttatgagtttgaaacaaaggcaattcacaagtgttctgctagagatggtctatatctgctgtttgatccagcatgatggccagctggccctcctgtgcatgacggctcgtggtttaactgcaccattttgtttggtcatatacagggaaaacatggcatggtgtggagggcatgggcttgaattcagggaacagagagttggtcttctctctctcactctactggatgatgtcatctcccctctctaagcatgagttttcttatctgtgaaataaaaatgttgaattaaatgagttcaaaatgctttcagtctgtgtttaatagcttgaatcttaagacaatgtattcaattatgcgttgccagatccctggcaactcatgtaacctttctaaaccatagctactcatctgtaactggccagccaactgcccagggttggagtgtgaatgaaataagataatgcagacaaaagatttttaaaaattgtagtgcattatacagttgtaatattttgccaagaacttacattttctctaagaagtgtgtcgatacatgatcacagaaaatcttttccatattcctttgtagtttgatgatattaagtaagtaaattgtataacacaaagagggaaaagcatcactgaacatgccgttttatttagctaaataaaatgtaatcactattagttttcctctgatttccccaaagtcatgtgattccattgagtattatgcacatggtataattagaatggattctctgctcaaataattttgggaaacatttaaattaacaaagtttaaaagtatctctgttaagctgaagcaaatctcaaaggccttaatattgtatgtaagaggaatagttaccatctttcctaatgcctctttgacgccaaacccatggagaatagttctaggtgttcagtaaaacacagatttgggatgccacaggttaattggaactgtcccctgcaatctttttctctttttcttaataatggctgattgcaggtcctagatgaaagacatttagagagattatcaggactcagcatcccatatcagaatccattcttttatagtcattttctgttacatttcttgggacaacaccaaagaaatgaccatcttcattcacataggctttgtaccaaatgctgacaaagatccttggtgacctagatgggggcaggtctaagtagattgcagctgtaaaattggctgatgaatgatctcagccccttttactcacactcaaaggcaggacagtccattaaggggaaggagggcagagtttttccttaggccaattccctatgccagaactttttagaatggaagcatttccagaggagaaacaaccccaagcacagttcaaagccccctcctcccaagttcatttgaaagtgggatggtttatctgcaaagggggaaaagatgagggatagggacgggaatatccctacccttcagagagtctggtttcatcctgcacttttactgcacagccacaaatgccttggggtgaatctacaatatgatacatcatatggtctaaacgtgcctggctgatcctctctaatacttcaggggtctaaaagggataacatgctctcctgttactcaccgactctgtccgccatatttcacccagccagccactgccttcacttccgtccgaggcctaatctgagcccatgggaaacctaagaacccctaccacaactgcctcaactcttgggaatcagggtgtatgggggtgacaggaagtgagcatacattctccaacttgatatgtcagcccccacgtctgtatgaatgtttgctcacactgtgactgccggccttgctcctcaggctgcatcctaccagggagtaagacccaagtccttcctgctttcagacaacaccaagcctcatgagtccccactcagaggaaggaccagagacaaactctaatgttccactaatacttcccttcttattactttccttgaaaatcccttctccctctttctttttatacttcgctaatgaaaggtaatgaaagggtctggcacttggaatttagaattgatacatggtttttaacccgcggacgtattccacaataacccttgcatcttctactaagatgtgggctaggaagggaccagccagttcccagggtcacagtgcctcagctgatgtttcatattttcagcaactttatgttagagatgtccatcaatcagaacaatatggttagagaataaactaataaaagtcatttttgaggacatgttggaagtctatcaaaagcattgaaattatgcatgctctgaccagtcgcatgtctaagaatttaaatatgatcataagtttaaatatgaagatgtttatcacagaattgattataaaacaaaattgaaaaaaatagtgctagaagtttgatcatagggacctcattaaatgcattatggttgatccatgcagtggtttgctgaacagccattaaaatgttgtagaataattattaatggtgtggaaggatgctattgttgcagtatgtgaaaagaacaaattacaaagcagtttgtgcagcataatatttttattttttaaaaacctgtatgtggcttatgtacatataaagacgtggaataaatgcacaaggtactcagtttttctcagtgaagcccattttgcattttgggctgggtaattcttcgctgtggagaactctcattcattgtaggatgtttacaagccctgggccttacctctttaacgccagtaggcacccccagcatggcaacaagcacaaaatggtctctctcatattgcccttgaggaaattttgcaactaagtaactattactgggtcctagattacagtctggattattgcgttcctttcttatttttattttctccaattccctttaataagcatgtactggattcataaaaaaacaacataaatggtaattacaatattccgcactggttaaaacttatgtaaataagcattctgctgctttagccacaattgcaatttatgctccttctctttcttaagttcccagttcccacgtacattcattcgactgattcaaaagtcattttagcttgatagactcttaaaagttagagttatcatttctgctatttattctttcaattatccatttgtccacccatccatctgatccattttgttgatgcatgctgtgtataaaatactacaccagcctggtgcggtggctcacgcctgtaattccaggactttgggaggccaaggcgggtggatcacctgaagtcaggtgtttgagaccagcctggccaacgtggaaaaaccctgtctctactaaaaatacaaaaattagccaggcatggtggcagacgactctaatcccagctacttaggaggctgaaccaggagaatcgctcgaacccaggagatggagtttgcagtgagctgagatcatgccaatacactccagcctgggtgacagagcaagactccgtctcaaaaacaaacaaaaaaaatacaatgccaagcatcataaaaaatatagtgatatataagacctatttgttgtgctctaggcattgacatctagctgtcaaccattaatatgtgtaggagtctatctatcaatattatggactgtgcttgaagacttcttccccaatctttttctcttcccattaagtttgaagtgaggttttctgagtgaagtatcatagtacatacagtctcattatttttcaaaaatctctggttatagtacatttctttcctttatcccctttgttcccaactatcaaaccattttggatatccagtattggtatccagtattattaaaaagcaaaacagagaactattaacaaaaaaatttgtaggagtaattggttgtatggtatccagtactattagatagtaaatcagaaaattattaacaaaaattttagacgaataatggattgtcttgcccaagtgaattgagtgatttagttgttctttcatttttagcaagtacagctgatcatttgaggccttactcattgtttgattttgcaaattcttactattataaatgttttgggctctgagaaagctgttgtcttaatctgtttgtgctgttataacaaaatacatgagactgggtaatttacaaacaacagaaatttatttctcatagctctggaggctgggaactccaagatcaaggcatttgtcttcaggttcagtatctggcgagggccggttctctactcccaagatggtgtcttgtcactgtatcctccagagggccaaatgctgtgttctcacatggtagagagatagaaagggccaactcactccctcaaggcctttcataatgttaccaattccacttgtcagggctctgcccccgtgactttattacctctgcaaggccccaccacttaatactatcacgttggttattacgatttatcacatgaatttcgaccatactagttgccatcctttcattttcatatatccttaaaactttgcctttctcattttaatgtactttatccacagtatgccaacttttcgatacttttgttaacctgtctgacgatatataggaaactgtaaaagtgcagtttttgatacactctttagctgcccgtttacttctactgtcgttagagaaccccatccatagtgcatgtgtttattttgtgtatgaacaaagactttatatatagtttgggtcatttttattcattagtgcttcccttataatctctgaataccattttattagtacatactgctattcttaatagtaactagcatgcctgatcatcccaaatgtctaggttcacattttaaaataagttatatctttgggcttaacagtttattgaaaggtaacaaggattgagtcatagttgtatgtttttggaagtagaattcaactgtaaatagaaattggttgtttagatctcactatatatgaaaaaatgaaggctttaggagaaaatctccccaaagtacccatttttcatgtgataaatatcatgaaatgatttgagaaaaaaatgtatatttgttacagctaacaaatatttgtgttttttattcttcatggagagaatgaaatttcttctcttctttacacatttctttttcttattagaaactaattggtgcctttataaaaattaactgcagagcactaacgtgtatatataagtattatgtagggtgtagggtatgttcagggtatggtgtgtgtgtgtgtgtgtgtgtgtgtgtgtgtgtagctgtgtgtgtatataatgaaatatatggtagtgttgtttcagaaatctgcttggtcttcccagagttcattcatcttataaattcatctacattgatctctatttttggaatccatgaaatgttttttggcagtacttcctttaatatagtgtgctggaaatctggaaatttctagccagattagttacaaaaaattagccagtggttttgcactctctatagaatcaaggcccaaggcctactcttgttactcagggccttgttttatctggcctctttcttttcagccatatagctctcaaatactcaacaaaattcttcattctaggtagacaagtatcttcaaaatacttcccaattatctaataactgtcttaccactaagaaggcttttatgtctcctgtctgaattttatccatgcaaaaaagtccagcccaagcctccagaactccaaaaagttatccctaactgctgaaacacagtaatttcactatgtgaaatttcactttggtctcctagcatttgcagatataccatacatatccttgatccttttcctttcataccttttatatctaacccttaagctaataattttacctacactgtaattcaaaatgtatccccagtcttaccatgtctcccttctctactgttaccaccctaggctaggccttcatcatttctcacctggactccttccctaacctctgaactgatctgcctgcttccacttagacacccaacctagtccattcttgagcagtcggaataattcttttaagaaagaaaccagatcacatccccctctgctcccaaccatccagtgacctcttatcatacatagaatgaaatgcaaatctttactgtgttttaaaggccctacattatctggccctcagtaacttcttacttcctatcccttttctccttgtatgccaccctccaactacactctaactacactgtctttttccctgttcttcagacctgccaaccatattttcactgctcaattaatatgtagaaaatgaattgtttgttaaatgtagactgtttccttcttaaagcaaagataaatgacattgtcttcaaaaacaactaactgcccagaattcctgattttaattttaaaaagacaaactgcaagaatgtgttaaacagtaaggaaacaattcactacttcagaattctatatgatttcactgcacgttagtaattttgtatattatagaatatgagggtattctaataaacttaactctatgctgtatacttatcatgatagctcattttcttatatgtttataacagcactacttattgtacatggatacgtgggaaataaattaattttctccttaagaacaaagcaaccatttcactcatgagataaatcttgaagatttaaaaactacttataattaattatacattattcatataatgttaagtattttcttagtaaaccacataatttagaatggcaattggacagatgggcagaaccacatgcatccactattaggcagttggtgagcataagatgccagaaagaagattaggaatatcaaggcagggagcttccgatcgctcttgaaaacattgacccttcactcctcactctccacgatgcatttcctttgaaaagtaatgccttccaaaacaaagttctctgttttatatctaaacttactcaatagtttctcatggttattgatatataaaaaataaagtaaaatgtttaggcagaccaaaagaagaatttccccctccctctgccttttatgccaaggtgacagctatgaaatgtacagtacgtttcctctgcaaggaatgtagcagtgttccattgcaagaagatgagagggagagaaaggttgcacgctgaggaatatagtgtcatttgtcactgcctagactcatcagctgtgtggaactctgagaggcaccaggcttctttatttatttcttcagaaacttcagcaaaaaagatttcattaggagcagagaaaaatgtgaaaaacgaattagcttttgtgatggggagtagtcatctctgaatattgatcaagattaagagggttgtcttcgtaacttcttttatccatagtctatactgatttaactagaaaactaatttcaggtggtatttcgggtgtggcagatctttatagtaaatgaagaatctagtcaaatctactgaaaaactctgcttactttaatgtttgatctggttgaaaccattttagcttaacaatccttcctctgaaacagggaatcaattgatatcctacagcaaaattatgtggaagggccattagcttcacatccaatgcaaattttgcctgtgtttactcttccccaatccaaaatatatcagatcctagatgccagtgaaatcgtttgagctagatggcttgagggtcatagcttttttcatttcctgttctcagacctcttataattgatagaataaaatcagaagagccctagagctgtcccacctattctgcctcacaaaagtagaagtaatggcaaccactatcatagggatcatgctcacctttttcttaccagacaaatttggatattagcttgaaattaataccttccttaaaatgttggaatttggttatatgcgaaattttgctctatttattcattatattttgtatggaattatttttgccctatattttcacttaagtgttctctacccaagattttaattgaacccaaatcagccagacacacagacatggattttgctgccaccaaggttaattcttcttttaaagttaacttttaaaatttggtaaaatatagctttgaaaatttgcattcgtctagtgtttgttatgtatttcccccttttgtttgattatatgtctatatttttcttgtagaaattgatttttaacctgctttttatgttagcttttatgagcttctgtctgaattctgaatatgtctttcttaatgtcttctaaatgtttctttctggattattaaaagatttattaggcttttaataattatatttgttaccttagggaatgtgtttgaaaatattttaaatggaattgccagttaacacagcattgaactttttcttgttagagatacattgttttctaggcattttattgggagagaagttagtatgatataatgtctttggctgatattaactcttctaagatgcattgtttctgagaacaccattgtctgatttcattcagggaaatttcacacaagccagtagagtcaatacttttttcaagacctgttaattgatatatataaaaacttgccattgtttacatgcccatttcagatcctttatgtgacctaagctagaaatgcattttaacagcatttgtttttccaaaaatatttatttatttatttattatagagacagcgtctctctatgttgcccaggctggcctcgaactcctgggctcaagcaattctcctgcctcggcctcccaacagtgctgggatacaggtgtgagccattgtgccaggcccttgtttttattttttttaaacattgtattttgaaaggggtttgaaggtgatccctagatagcaaccagtaatgattcgagcagcaaaacaatctaaaaagtaattttataagaaaatgcagaacataaatgagcccataaaaaattatattaggttctatttacattactaccttctttcacatgtaatatttcactaacatttaatgaatttctgtgcagtgccatataccattatgaattctaggatagaagaatgagtgagaaatgttcttaggccttaggaagaaggaacaagcatctctgtgtaatagttatttcaactcttcttttacacctcattcccatattaaatctcagaaaagctaaagtaatagctatcccagatctattttagactccagacacttacttcaatgtcttgttctccttatcagactggaatcattccaaacctcttaacttctgggcaaccatgataatgcgacagaaaggacactaaatctgtcgcaaatttatcttgatattctatccagtcttacttggtactgaaggtcacaagtaaaataaggtggttgttttttgtttgtttttttttttttgacagaagagaaaagaacactgtgagcacagagtgaatgtctaacattgattcttgagtagcaggaattctctatgcgagaggatctctatgcaaaaagatctcatattctagcacaatttaaggatctctatgcaaagatatcccatattttagcattatcaataagctatggggtaatatattgtatgtggtgtggcttgaattctagaaatttgatttctagaaatggtccctgtagttaaggatatataatgtggccgtctccagttttctatgaggaataggaaaatactatcattattagctgtgtgaccatggacaacttgcttcgttcttcagttgcatcatctgtataaaataagaataagaaaatttacatctgcaaggtgtgatggagatcacatgggataattgtggtcccagagcctggcacaaaagggcttaatatttataatcctccccatttctccgtatactctaaaggaagtttattgcttatcaaattgtgccgtggttagttgtacagcttccctgccaaattgtaaactccaacactaatgtgacgttacattttatatagtgctatgattttcaaattgtttgcataatttcaaatacacagtaaattgctttttattagtataattattgctattgtcaatattattattacaacagcttcacagtaagatgggcagaaaaaaatttaatttccattttacaaatgcacttttgaggctcacagaagtcaaatagaccaaagtcacagggctagtgagggacccagaagaaacaaattgtaattcactgattccaagttcagtggttgccttactgcatcataaaggctattacacaatccaggtgtatcatatgattcttgtctatatattcatacatatcagaaaaagtgttctactcaaaattgctagcaatcaacagatactgatagtcattagtacttaaatctttatcaaatgaaatattaatacccatgaaagagaggacaatgaaaggtttgtatcatttgtatgtcacaagtcaacttttttcaatcactcattattagtttaactgtaaaaaattatttacatttagcgtgaaactttcctgtattctcaacatatttccttcggtagaaaagcaaacctccagttctctgttctttgcttggatacttgccagtttgtaactcagctatcaaacagtaaagctcacaaaacacttattaaaatgactaaaatccaaaacaccaagagcacagcatgctggtgagatgtggagcaacaagaactttcattcattcactaatgctggcaatacaaaatggtacagtaactttggaagataggttgacaatttcttacgaagctaaactatacttaacatatatatttgtccattttcacagtgctaaaaagaagttcccgagactgggaaatttataaaggaaagaggtttatttaattgactcacagctcagcatggctgaggaggcctcagaaagcttataatcatggtggaaggagaaggggaagcaaggcacctacttcacaaggtgacaggaaggagaatgaatgcaggaggaactaccaaacacataaaaccattagctctcgtgagaactcactcgttatcatgagaacagcatgggggaaacagctctcatgatctagttacctccacctggtctctcccttgacatgtggggattatggggattataattcaagatgagatttgggtggggacacaaagcctaaccatatcaccatatgatccaaaatcatgctacatgatattcacccaaaggaaatgtaaactgtgtccacaccaaaacctgcacatgcacgtttatagcagctttattcataattgccaaaacttggaagcaaccaagatgttcctcaataggtgaatgaacaaaaagactggcacatgtactcaatggaatattattcagtgataaaaagaaatgagctatcaagccacaaaaacacatggagaaaacttaggtacgtaagccagtttgaaaggttgcattctatatgattccaatatatgacattctgaaagagacaaaattctggagacagtaaaaagatcagtgattgcctggggctctgagaaagtgcagagggatgaatgggtgaagcacatggcatgtttaggacagtgaaactattctctatgatactgtcatggtggatacatgaccttatacctttgttaaaactcagaattttacaatacagagtgaattctaatataaactatggactttagttgtaataaggtatcaatgttatttcataagttttaataatgtaccacactaatgcaaaattataataataggggaattgggggaagggtaatggagtatatgggaatgcactgtaatctcagtacaattattccacaaacctaaaacttctttcaaaaatacaagctattggtcaggtgtgatggcttataccagtaatctcagcactttgggaagtcaagaccctcagatcacttgaggccaggagttcgagaccagcctggccaacatggtgaaatcctgtctctactaaaaatacaaaaaaaaaaaaagaaagaaagaaaagaaagaaagaacagaagaaatgaaagaaaggaaagaaagaaagaagaaaagaaagaaagagaaagagagaaagaaagaaggaaagaaagaaacagaaagagagaaagaaagaaagaaaaagaaagaaagaaagaaagaaagaaaagaaagacagatgcggttgctcatgcttgtaatcacaactactcgggagactgaggcatgagaatcgcctgaactcagaaggtggaggttgcagtagggtgagattacgccactgcactccagcctgggtgacagagcaaggctctgtctcaaaaaaaaaaaaaaaaagctattaaaaatatgtaaagctcagtctagatacagtaccagaatagtaggaactttatttcacctgtcctacaaattatggttgtgtgccacttgggtaaaactcagaatccaaatatgtgaatgtaagatttatggggaaattatttgtatttcaaaataatccttaatgaatgcactccttctaaagtagccattaataaagcagttaatgtttcatttaattatagattaatgtacataagatatgccaggaatgcaattaggaactgggaagggggtgttattctaataacttccacatagcattgtgagacattttctgctttcttcaaatttcatttaattacattttaaacaaatatttttgtgagcctattatatagtccttcgctagcactgaggagacatgctttgtgaccttggtgatttcacattcaaatttccctttcacctacactcttccttgttttttcatgcctgtgtagattgtaaattcttcctcagattaagacattttattcacctttgtaacatccacagtatctagcacaatcagtgccttcaaaaacaattggcctcaagaattgattgactcaatgagtgactgaaagactaaattaataagtacacatctatttgtacttccctgcttacttataaggtatgacaatgaaatactgagacagttatacattacttacggactcaatctcatttctttacaatctctattcttcttttttgagtataatgttattttacaattccactaacttgtcactctttattataaattcatatctccatttcacctgagaataataaaggcaaggaagtattttaaatgatcttgttttttataactagcattcattgagcaaatcaaagtatgaaaataatataggtgtcagtgattattataaagttgtatgcacaaaacattccaatgattggggccaatacagagaaaacatctcaatatttggaattttgcttttctgtaaatactttgatatgtacttacatcatatcaattataactcctgctgaaaacaaacagtgcacacaaatttggtagttggaggagactttataaagggactaattacgaaggtttagaccgggttaggaaaaacacacggaatagtgcaatactttaggatggcaacagcgagcaccgttataaccactaggccaaaatgaactaaatgaacagggagattaccatttatcagaaaaagagggagaaaggaaggagagatgaccaagcaagtcctatgtgaagacggctgcctgacttgagctgtgtgatctttggactgataccacctgcctgcactggcctagcagggcgagaatagtcaatatctggaaaatggatcacctgaccttactttcctccctccctgtttcctctttgtggtgtttccactggccaaactcacagcgtagacaaaaggagtgcattgatgtagcagtggttctaatccagggccaattgtgctcccagggaacattagtggttatcacagctcaggggaggaagggagaggagtggagtgctactatgattcactgagggatttttttaaacatctacaatgcacaggacatccttccacaacaaagtatccagttaaaaaatgtcattactgccaaggttgaaaaaccgtggtgtagtcagtacaattcatcttctccaggcacagtgcaggagtggggtggagtgtctgaaggggaagaaggaagaaaccagcacaccccacaaaagtaaccaatgcaaataccaaataggaaaagacagcacttaaaatacaaaagtctcaggaatatatctgatagtgttttatggaatttattaaaatttagcctggagtgagtaatatttagcaagccaggtttgtctttagagaaatccttgtggggtttatacaaggatttattaacaaagggcacacacaatactcatattacagtcagtctggttatgtaaaacatgggcaagaatgtaataggacaatgtgatgtattcacaaaggattttaggactacacagataatcctctaatgctttcacttacgtactatgaaaggctatagtttgcatagtgatatagccacgtaagatagtaaacttgacattcatgcagctatacatgtttgcacacaccaggatgcatgccctttctacctggttgattttttattcttttattaatctctaatttattccccagaacactctccataaaaactttctcacaacttaaatctttaatctattgtgtggatttctgactcattctccaagcttttcctcttccctccgcaatgccttatagtcttatgactatttatccctttgcctacatttctagccagatctcttgcctgatacacactctcatatttctctttgcacgctacacatttttatttagatatcacactactactttgatttcaacaggtctcagtttaacttaatttttccttcaagcaaggagtcccttcatatcagttatcaccattggcaccagaatttttcttatgacttcccatgacctacaatataaaccatataaatcactgatgcctccatagttccctccctctcaaatttagccataagatgattttaggatccttgttttttccaatctctctttcattctctcccccatctcttccattatgaaggtttggataggacacaactcatgcctagattagtgcaatagatgctgagcctgtgcagcggtagtttagctttctctcctggttaactttaactgccacatatatcacttcacacgtcatttttcattcaaacgtatttaactggctcttcattcataagaagctggaatttgtcgtttgactgatattttaaagattttatattttttctccatcctcgttctaatgttgtatcttgtgtcatttgttcattcataaacttaagacttagctaaccactgagcatccaggaaattcagtatctatcatgtgaattctctaatactggttgatccattgtcaccagagcatagcaggcttctcctgcctttatgtatgtttgtcatatagttcatgcctaaaattctttcttaaatcttaaattcctaagatacacacttttgcccaagatcacagtaatctctgccataatctctgctggaatctgttcactgtgttgctcctgctaaacttcttacagatgactttttttctttttggtttccctggtatctagtataatttcttatataggtactcaataaatgtttcctgttgatctctacacctactctgtacaataccatagtgactagacacatgttgctatcaagcatttcaaaagtagctagcctgagttgagatataggggtaaaatacacaacagatttcaagacatattatgaaaaaaacccataaaatttctcagtaatttttttatagattacatgtagaaactataacattttgaataagttgtatcaaataaaatataaaattcacccggttctttttaatttgttaaatgtggtggctagaaaatttaaaattacataattggctcacagaataattataatggatggtattgctttagatcaagtttgtctaacccgtggcccatgggccacaagcggcccaggatggttttgaatgagatccaacacaaatgtgtgaacttccttaaaacattatgaattttttgtttgttttgtttttgtttttttctcatcagctatcatgagtgttagtgtattttatgcatggctcaagacaattaattcttcttcaaatatggcccagggaagccaaaagactggacaaccctgctttagatagtaaagcatatgagtagttaatgtgtactataagcagtgtgatctgatagactatttaatgttgtttgatggtacattattcaagtcgattattatgtctacctatgcagtttaacgacggtaatgagagagggcagcttgattacaggtcttatcttttgactaacttgctaggccacctgagaaggacccaaattatctgaatgcttaactcaactaatttgtattcacttgaagaatttcaaggatgtttatatgccatcaacttgctttaaattttttctctcagtgaaaatttttcttaaaatgagtatgtggtattcaaatttatccttgttttctatgattatcttttcatagcactgtggtttccaggaacctttttttttttgagatgcattctacatgtaactattgcacagtttgcatgtagtaaggttcattattcttctacttttccaaacacctggcatgtttacttgaggttggtacaccttgtatcccagattttgctgtttttaacctaaatattgaatattttgattaaacattatggaaagtttaaatgggtcaagaaaaatagcttttcttcccatgaagaacaatacggcataggagttaagagcatagatttaaagtcagaaaacctgtgctgcctacttgtgcaaagtcacttacatgctgtacttctgtttcttcatctgtaagttctacccctaggtatttacttaagattaatggaagcatatgttcatacaatgacttgtacagaattattcacgatagcattactcttaatagctctaactggtaacaacacaataatcaatcaacaattgtgctgtattcatacagcagaatactacttagcaacaaaaatggaatggactactgataacctcaacaacatggatgaatctcaaaactatcatgctgtgtgatgccaggcacaaatcagtacatactataattccagaaaagacaaatgtcatccatagtaacaacaagatccatgcttgctggaggtagaggcatcagttcagtcattcaggaagctgattccaagatggtgttagaattacaaccatccacaagagatttattgcaggcaatagctatgaaaggtagaaagagaacaggagaaaaaccaggcaaggaaaaaccacaatgtagttgtgatatcacttcaaagggaggcagaaggaaggagaattgggtaggaatagccacagattacagtgcagttacaagaaagtcttggcttccaacaaaggttacttgttgaggagtcatgcattaggcagacatgtctgggctgtagtttccttgctgctcccagtcattggctggaggccagtctgggttcctgtgctgtggtggatcccattgctgctgcagcaggaggccaatagcactcctggcagctaattggagagaaaagatccaagaggtgtaccttcatggctacccccatggggctggggtggaggtggaggagaaggagaaggaattaactagaaaaaggcacaaaggaaaattggggaaaataatgaagatatatgatttctcaattgtggtggtcgttacatgggtttattaatgcatcaaaactcaagaaatgtacatttaaaatgagtgcatatgattgtaagtgaattatacctcaatatagttaattttttaaaaatcatagatttctttatatttaatgcatgaacataaacctaagacactcctccactccaaaacttaattaccttgtgatcagcagagcagaaggtactttgtgatatataggtagagaagatgaagtcttgtgacatttaacaagggacaggaaaatggaccttgtcctaagttaccaaactgcaaaaatatcacctacaaaggctattcataacatacattttcaagggggttacaatatttgcctactataaaattttggatctgtaaaggggttaaattatttgtgcaggggaataaacatcaaagaaacattaagaggtccagagaagtaaaataggaagggtcttttggctagaggagatatttaactttcagaacatgtggaattaagttgtattgattatgatctgatcttcttccccctaaatttgatcctcttcctgtaatctattgtttccatcatcttcaactcttccctttccctctcccttgtccctcagttctagtcaatcacaaagtcctacagtttcactttctgtataccttatttctggaattcatctctagacttcaaaatatatatatatatatttttttttttgagatggagtctcgctctgttgcccaggctggagtgccgtggtgcaatctcagctcacagcagcctctgccacccaggttcaagcgattctcctagttcagcctcctgagtagctgggattacaggcatctgccaccacgcctggttaatttttgtattttcagtagagatggggtttcgccatgttggccaggctgatctcgaactcctgacctcaggtgatccacccgcgtcagcctcccaaagtgctggaattacaggtgtgagccactgcttccagcccaaaatatcttaagtagataattgcacgactaatctctgcttttctctcccagcagccttccaaattcatgtctcacagctgacagagttgttcctgccttcagattcatgacctggctctgtgttccagctcaggctttctctctcatatcacctcttgcctctctgttgcccccatattttcccctctggttggttggtgctcctttggaaccctctgcatatcttttcaagaatattatgacttattatgcctataaactttgtttaattatttatttctaaaatttgacagggaactttccgaaggcaggtattgtgtctttctcatttaaaagcaaattctcgcctggcatggtggctcatgcctgtaatcccacactttgggaggctaaggtggacagatcacttgagcctaggagttcatgaccagcctgggcaacacagttagaccaaaaaaaaaatatatacgaaaattagcctggcatggtggcacacccccgtagtctcagctagtctggtagctgaggtgagaggatcacttgagcctggatggttgaggttgcagtgagctgtgattgtatcactgcactccagcctgggcaaaaaagtaagatcctgtctcaaaaaaaaaaaaaaaaaaaattagtgaatcctcagtgtttaaaaagtccataaacatactaaacatagaagacctccaaatgaaattaatcaattattatttagtgggttgcttctcttttgttttaatatagttttaacaaagagtaaaagttatgatctttttatatgtaaaataaataatgccgggtttgacataaattttaggaaaactagagacgctacttcctaaaaattttctttctataatcttcctaaatatttttccataaagtacaaaataatagaaaaaaattaagagattgagtatcctttcaggaagtgatatgacaaatagggttcgagaactatttgaattctcaccacttttcataagggcagatctcaagttaaatttttctattcgaatttaaatgactttcactggaataccattacagaaaagcttctgtgtttagatggcaatatggagtttcttttcttggaatattaattgaaggagaagtcttaattttttaagtctatatctccgtatatatttgaacctattttatatgttagtccttctctttagtaaccttcatccacagtgaacaagatttacccttacctttaagcagtagcggctactttatgtgaagtgaacagctgctttttttatctgcatctagacatcaagtagtccagagtcctttctaacaccctagcaatagaagtaagaatattttgaccattccatgacttgatgatacttctagtaataatactgtattattaaaaacaaacaaacctttgtgcagtggtaattgaagcagttccttgggaacatgtattaagtactttttagcagttaagtccactctctgtaggttaaggaatatttaaataaaataatgtggcaaatgagttcaagatgataaatgcgatgagaactaaaacagctttaattttatgtgggaaataaatagaggaaaagtacattacagggctcctggacttatttctttcttcaaagtgtttctcctagcgaatattattactattttttctcttaagtaaaaaatacacaaagtatgaatctacacaggataataatattgaagttaaggatgatgtctcctccttcactctccaaaatactatttacttggcttcatggaaatctctctcactccaattccaccgtgtcaactgaggtcttctgttctttctctccctatagcatattcctgttacataaatcctaaactgtgtcgtgttagtcacacactgtaacctctagataagcgcctgtccagaggttctcaatcagagccttgcaaatatgtattaaatcaatgggtcatcttcagtgtctcagtgggcccttggatatgttttgcagactgctgtgagtatgtagggatgtccagtatcgagggaagtgtggatggctttcattggttcttatagggctgaagaacacatagagcagtaagcacttctactgtagggagagatcgagcttctcccatccccactgctggcaccaccaccaccctacaccccattttgagttctgaaagtgaatccttgagaaagaacacacaaaacaaccatcataatagtgggcacagctgtgggtggtagaataacattcccaagcttcttttcctacacatgattaatattaattcagcaaacatttattcagctcctacttttaaacaggcactattctaggtactaaagacatagaggcaaagcatacaagactctgcctttgtgaaacaattaagaaataagtaaaaagaaaagaaacagaaaaggcaatttggatagtgtcaggtgctataaagaaaacaaaatgccattttaataaataataataatacaatgttttcatactatgtgctagacactatgctagtaggtatttatagacataacctcaattaatcctcaaaatggcatgttgatatcaataccccaagtttacatatgagacttaagatgtctgagtatattcccccaggtaacaattaatatgcacaataaaactttttgctcattcatttattaacctatgttgattgagtacctattttgtgtcaggcatcattttaaggcacctggatatagttatgaacaaacaaataaaaatctctgccctcaaataattaatatctcacagaggttaggcaaaatataatcagaaaataagtataacgtataggatgccagatcatgaaagaagctatgaatggcatcaagaagctggaaaaggcaaggagacagattttctcctagagtctccaaaacagaacacagtcctgccgacaccttaactttaggctagtgagacccctattggacttcagacttacaatcccacaatgtaataaatttgtggtaattcagtaggggaacaatagaaaactaatacgatatcaaaacaaattatatcatagaacaagaaaatgtaattgtgacaaataatacctacaaaaatgttgtaaatgctaggcaaataatgtgtttaaagcacttaggccaatgttcaacgtaaagtaattcatgctataatatcatcatcatcattaccaatatttaggggctctaacaaatgatgtacgtgtaagcagatgtaagaaaatttccttgctgaagaggaggtattaatagagtatataacaatagataacaaattccaaataaaggcaaactaaatgttttattggattaaatttaattttaaaaactacaagaggccgggcgcggtggctcacgcctgtaatcccagcactttggaaggctgaggtgggtggatcacgaggtcaggagatcgagaccatcctggccaacatggtgaaacgctgtctctactaaaaatacaaaaattagctgggcctggtggcgcgtgcctgtaatctcagctatttgggaggctgaggcaagagaatcacttgaacaaccaaggagtcggaggttgcagtgagccaagattgtgccactgcactccagcctggcaacagagtgagatcccgtctcaacaacaacaacaacaacaacaacaacaacaacaaaactgtgagatccatggtgggcttttaagaggaaaatgcaagctaaggtttgtttagactctgagtactgcatgtgtaaaaataaaggcatgatgaaaagatcaagagattagagtgatactttttatctactagtgtcagagtcatgaccaggggattggctatgagaatacataagctgtgccaggagtaatccaaggagattgtttcaatttggaagagtgtccacagaatgattctcatactagacgttgggctattgtaaagaaagttggtaggtactccatcgctaggatcatatcagggagaaattgaacaggatggccctaatgaccctgttgtacccctagcttatggattaggcaagtcacttctactcgtataccctgtttccccatttgtaaataagaggatgtgttactctaaggatctctaagattctttgcagttgttaaattgcatagctctccactgattccatggtggaaatttgctattctattacaaatattctaaatgtatgagatatcagacatactcatttaaaaaacaaaatacaaaaaataagtattctacaaataaacacagataatgtttaaattctatatgtctttgtttctcttcagaagcatccaaaatacaaaccatctaagaggcaagaaaatgtcgtgatgttcctagtgcaagttaaaaagatttgctttcctcaagtcggaaagcccttctcatttttgaggtttttttcttcttttttttttcaagtgaaagcattttggaggagtcaatatccatctttaaaggtagccaggtcacatgtatacatatgtaactaacctgcacaatgtgcacatgtaccctaaaacttaaagtataatttaaaaaaaaagaatttaaataaaaaaagaaaatcagagagaaaaaaaaaaaagatgcatgtgcaccctgatactaccatccatagtgatacggtttggctttgtgtccccacccaaatctcatcttgaattgtaacccccatgtgttgagggagggaccttatgggaggtgattggatcatgggggtagtttctccatgctgttctcatgatagtgaatgagttctcataagatctaatggtttaaaatcatggcacttccttttgctctctctttctcctgccatgtgaggtgtgccttgcttccccttccccttctgctatgattgtaagtttcctgaggcctcctcagctatgcagaactgtgagtcaattaaacttctttctttataaaaaaaaaaaaaaaaaaaaaaaggtagccaggtaaaaattacttgtttccaggacattttcacctgaaagaagcattgtcatataacatagaagcaagaaatccagtagtgggggttatttaaaaatagctggaaaatttcaatcagcatgagtttgaagcaacaatttatcatcaccttttatggtgggtggggttaagaacatttcagcgggcaaagtggtggtgatggggaagagacaccaggggaggtgattcccattgcattgctttgtaaacagaggcacaggttcttcatttttgtcacacaaaatcacagctatgcagaatttattaatttattcttctgagacaagaaaaaagccaccaaaggaaaccaacagcttgctcctctcacactgggggaaccatatgagagacttatctatccctgactttaattttgacctgaggagagctcctcttaaggaaaacaaattaattcaatgactatactacttaatcattgacctttatttaataagagatttttccataggatatgctgagctgtctcacttacatcagttgtgtctcctgaggtgggtgacaggagaccacaaatattgcatagcacacaaatcgttaatagcagctgtataccaaaccattacctaaatatgtagagtacaattcattctcactaatgtcagagagcatgctataaaatggtgaatccggacagctgaagatactgaataataacctctattttgaacaagtttacagtgttccaatcagtaattaaattgatacctgatgaatatatgtgtgtgtatgtattcatagcagagatggttttcctgagataaggattttgttattcggataggctgctgctggaattgtccttctacccttgtttctttgtccttagtcatcactcatacctctttccactcttctgccatcacttttgtcaccaaagtcatggtcctttccccgccgattgctgctgcaggtctagggcaccaagacttaggcagcactcaccatgtgccaagaactggaccacaggtaccatccagcattgctcatggagactctgtccctttctgtaggacaccctccttttagctagcaacccctccaccacctagagcctctggacctctcattttaatattaagaactaggaaaacttaccgctgagaataactagtacaactagaactggtagagaaatctgggtctcttgggaatggatttttaggctttattgattagaggtgtattaataatgcagtgttatagtttcatgacataacgaataaaaaagttcattttggacttgcctttcagctccctaggagctaaaagacgtatttaatgtaacttgtgtggtggaaataagttcttttttcaggcaaaagatgtgcaaacccatctggggaagaaacattaaaaactaaggagacagtgtcctagataactatgttcttttcctgttttagtctaaaataatgattagttttcttatatatcttcatttgtcttggttccttttagcccaatttaataatattattgcagatattgatgaaaacctttaccttcctcttaattcatcaaagtacttgataaaatttatacatagtacattaattgggaggtttttatgagattaattaatataatgaactgatgttgaaattatttaaaacctgaattattattgtattaagtaggacacttaatacagttaatcagttctgtctttattcatttgtgagaatttttggcaagctattgtgaatattcagggaagggaatgtatttttagcaggaatcttatacctcctacatagaaatgaagcatttactgaaacatccatgaaacaaaatgtttctgaatgtgtactatacacttgttataagccccttttcttctgtagctatattttggagaaaaatctttgctttgacaaaaaaaattatgttgacttacacatatattttataactaagcagtgtttggtttgtgataaaggatacaaaaatataaaaatgttcagcacacgtaagtaaggccttgttgacaatgtgagttatgctactggatactcaaaaggaacattcagtgttctcaggtggtctctagactgtctcaagcctaggaagatattttataagcaaaggaataagagaaggaagattcagatttaatccaagtgaagaattcagttttgtgtgccttatcctgttattttgagaggcagccaaaagatgctggtcagcaaggagaattgtaagttgggcagccaactctgatttctcaacctcttagctgttttcttaaactcagaatttttaatgaatttaaatgtccatatcaggtagactttggggatgcttttaccagtgattttcagaatgttactttctggcatttcttttcacgtagcattatattaaaaatgaattcattcatccaccttcccttgtccttactaattttccctcctactcccttcccccttgttcttgccatggggacatgcaaacactggtggttgatgtctgagcaaggctgctgacagggggaggaaggagatgtcaagcagaggtcaatggcagtgtgcccagcagcctaggaagtaggagggaaaagagagagagacagagatggtggatgaaagagaaagccaggatgattatggtggttatgatacttgtcatgctgaacacccaattgagcacccaataagcacataataatttaatcatcctctggcttggatggcagtgttctatcagtgttgacttcctggttgtgacagttttacagtgttagtgtagaagagaatccttgctttagagaggtacttactgaagtacttagggttaatgcaccattgtgctggaaaaagatacgcacacacacgcacacacacacacacacacactcacacacacgcacaaatacatccatgtgttaggcagagggagcaaatgaggtaaaatgttaataattaggaattctgggtgaagtggatagagggactctttgactgttcttgaaacttctctatacatttgatctgtttcaaattcttcagaaaatcaaactacaaaaacttaattcatttagtgaacatctactgaacatctgtatattaaatagtgttaaatgaatgtcaattaaaatgctcaaacacagtagaggttgattctcattcacataagtccatggtaggtgtttttggcaggtgggtgagtttctcccttagggagattgaggaacccagactcctcccaagttgcagccccaccgtcttctgaggggatgcatccatacccacttcgaagtagcatacattatttcctttctcattcctttggataccagccacaatttattcaaggtagacagaaaattgtagtatatagccatatgccctgacaaagaagggagaacagattttggtggacaactagcaaactctgatacaatctgttattaagcactgtgtgtggatagatgctaactagaaggagattatcttcccttcagcaaatataaactgaatgccgtttatttggttgaaactaagctagatcatgggagtatagaaattttataagaagacatagtcacttctgtcagtgagctcaagaagaattagtatgcggaatgtaatcatacctacagggggcttgtgccacttaagtaaaatgaaacattattttgagtacaatttagcaataaatgtactacgagatcattaaaaatcatgtttgaatgttattgtgtcaaggatgggaaaaagacttttgggttgtagacttgataattatagttaaaaacagtttttattcttgtttagtcttattttttatgtttaaacatatttatacttgctaacatttatacttgctaagtaaagactgtttttacaaccatgacaagaacaaaacatattagtaatgcaaatgccacatttcctacaatcaactaatcacactaacatatttgcatggaagaatcactgggattgatctggccacgtgtgtagtcatgcccaaaatgtgaagtccatctgttttgcaattttttttaaccactgttatccaaatgctccttggattttttttattagtggatatattttggaggtcagacaccctcttggctagatcatcacctttataacaaatatatatactattctcatggaaatatatttagacattgccctactgggaatttttttcaagtaattaatgtacagcttgtgcaacagcttgatcttggcttcatggaaataattcactcttagcagcatctaatgccacaaagcatttatggatgtcagctcagaacttacttttatttatctctgagttacttttttttttttttttttttgagacagagtctcactctgtctttggcttgtccctaacctcttaacagacttaatattaagctccatttcactcagtcgttctgttgtcatataaatgagacattctacaagcatagtttttagtttctgccagagcatcatacaacattgtgagctatgatgaagataaagacctagagaagatatttaatatgaagttcattatctaatatttggtatgtgtggcaaaatagcaatctactgcttggttctgctgtaatctatttacccacccatcccatctttctttcaatttaaaaggataatgattttagtcacgattatacataaacccattaccataggcaataaacaatggggcaaaccattggtcccatagttggagtgtggtctgaagtgtgttttggtggagagagatctatgtctggagatagctaacatggatttggatcccagatctgctcctacctgttgctgtgcctgtgaccaaatcatgtgatctctctggtttcagtttacttgtgaataaagtaaataccttcatcaacacctgtttttgaatacaatgtttttctgtaatttttgcttcttataatgttataatgatcatccttacatctaaatcttggtttacattttcatcaattcttttggaaagattggagaagtaaattttggagatgtatgtcggctattaaaaatgtttaattttttaattaaaaattaaaacgttgaaaaatcctgatgcaaaataaatgcattatgcttagtgaactcttctcatttcgaagtttattcaccttcttgtttttgcaagtttcctgaaaaatgcatataaagtcactaagttagcagaactttataaaattatataactatatataatcttttgatatcagtgaagccagctgatcctatagaaataatgtaggaattataatcactagcacataatttaagagtcctgtggtcttattcatgttatttaccctctctgaatcttacatatagtaagagggttattatacataatatgtgtacatgtatacaggtaagtaagtatatatgcttatgtgtaaaagcagagttattgtgagagtcaaatggaaatgtgaaagtactttgtagttttttattactattattaatttttaataaaatggtaacattcatttaataatcattagttttaacttcagattgtactggatttcctctagtatttcttaagattagtgaataaagtatttctcctaataaatatattgactactgtctttcgatcaaacatattaggtatatttttacagtagcatcaggcagtgaaaatttgaagctctttatagaggactgatttatgatgaaaaggaataacatgaacaaatggaattatatgaagcttccccagaaatatctaagaggggccaattttaagaaatatctgacttctttttcatggacatttcaaaataaacctaactcatatggtacagtttttaagagggaaaagaaaaaaccatctgagaatctctggaattctgccgaaagtatcacttggcattttattctaccttctggatgcagttgattgacagtagtgttatgatgccaggggtatagtgactagaaaaagaaaaccagggaattcagtgttcttgctcatgaagaacagcttggttctttaaaaacaatgagattttgccaccccatctcacaaacctatgatttgtgagaacaatcccttttgtgttgcaagacttttacatttctcttcccacactatattagaagaataaacattgcttcataagtaccgattgatagtctcatttcatatttttaaaatagagttactttaaggttaaatttttcatgtagattaaaatgactaagtaaccattcacatatttcaaataaaatatatttttactacaaaaggaaaataactagattcttaagtgttatagtcaagtgtaattgagtaatatgaattctaaatgaatttctaagatctgctcagctttcactactttaggaaggaacaacttaagaaaaattttaataaagatatctcttcacacacatggcagtgttgtacttagagaacatgacccaaaattttttatgactgcatattgaattcctgatactcttgggaagctccaaaagcaccagtggagtttccagatgtaactgtggctgcagacccgccagtcccggtgttggaagggatcattataggctcttgtgtgcagactcatcttcagacccagaggaattaaataacttgcccaaagtcgcacaactttctcatggtaggttgggcactagaataaatattgctttttcttaagagttttagcctccgtattatgaaatcttctatgttctgctgatgatatctcccttcttcatctgttttctatttttaagcaatggaaatacaaacttgcaactccccatttccaacacaacttagaaaaaacaatatttaaagaaaaaattacaggcatctcatctcctttacctgacagatgcttgatagtaatggcctctagatagggatgacatctaatataaatgtgtcctttcaagtcaagctttctctgttcattagtagaaatattgtatatcaagtgtgcaaaaattttcttcaacagggagctttgtttccctccttttattataacaatctgagctttgtggtcccagggtctcctagtgcctgtctttaggtctgtttattcacatgaagaaagcatgtcatatagtattatctaagactcaggctgcttatgcatgatgacagaagggttcccaggcacaaacattcatccatgcattcatccatccacctattcatccattgatttggctgataattattgactactgttgagttgccctcagatttagtttctgtccttctgccatggggaaatatggggttaagccacaacatactcttctcttctttttctgcaccttcttagtatatttagttccattttgtctagccctgcctctgacttctttgttgtacttcaggttttttatcattgaaagttatttctggatcatagatcattctcttggtcactttgcttgttcacttataaaattaattcagaaaaaatgacccacagtaattactgtaaatcacagaccataaactataatactgtatattgtattatagtacagaaatatttatactttaaaatgttttaaatatagatattataaaaagatatgtctcatataagtaatataaatacttttttattacctcttctctccctattctccaggccagtgttttaaaaatccatctttatatgtccatcctggaaaaaactcatgatcataaatgagtttctcaatagagtttataagcccacagttgaaacacaattgtcttagcatccatttagttgtcatacttttaagatttaatggcaaatattatgttttgtttcttcaaaagaaatattttaaaattttagtaaaggcagttagagaaggtagagataatggactgtttaatcctacttttcatcccacaagtgaacaaaaaaatgataaaacatttttcccaaaatgtagctttaactatacttaaatttggactaaaatgggagatatcttttctactattgaaaagccgtgtctgtagattaatgctaaaatcgggtgtaaaagcaaaatttgtttggcttgattgccaatggcccattcatttggctacagaaacaatagcacatagcaacagataatgatgtgagatcacctagctcaagtaagagtgtctgatccgtcaaaaatatatacatcaagattcaaaagaaatgtgtgttttctcaagtcatctctgtaaaaatacattaaatagaggaatagaagtttgactttgaaaatacattgcagacccaatccgtctttcctattttctggtgaaaagtatcaaatatgtggaacctggaactgctattctccttcttaaaaatctttcttaatattctattgataactggtgcaagcctaactttttgtcttacccgattcttctcacaccaaagtgataggaccttcaggtagcctttggatagaagataaataataatttaactattgatggaagttagtattagaattagacttggaagtctatggaataaaatgattctacaacaatttgtacttcagacattagtataacaaaacatgtttgcccgtgcatgcggaaacaaccaatttcatgtggatgcttatattcacaaaggagtaaccacctggggtttcccactgttgctccagagaaaactagcagcaggagaacttctctgaaggtatcaagacatctttaaaaaacacttgttaagtgttggttcagctaaagcagggagttttcagttagtaatggcttttaaaaattaaaacaagtttagcatgtaggtcattaaccttgaatcactgtcatgattattattaaccatctgttctcaaatcgaaagatatttttcttttctagatcacatttattctcacattgctcaatttcactatatatcaagacatgaaaactgtaaaaatcacaccttctacattattatttttattgaaaaattcctaatgaaacagtgcgctctgggatagagaaaggaactaactgacattttgcttcttaacttgtttttatgcaagttctaagtggtttctggccatgtacataaaagacaaatatctggaaaaaaaactagcagaagtcagttatttggctctatctactttgagaattatgttatataaatgttaggaaattttttgtaatattcttatttagaaatgaaatataaaaagttttaaaaatatctaaggacagtatacagtcctaaagtaaagctgttaggtaaatgctacacaatcctcttattacagagtcacttacctgagaatataagaagagggcctcttgtttaagagtaaatgtgagctgcaatcaggattctgcactcatttggacacttagttttgtttttccatgactggtgttgcctgttactgagacacctacctgtcatgtgaccacagcttatgttacaatgtgtctagtcagacttagagatgtgtgaaagagcagtacctagacgggaaactatgggtctataaaggttttgccttcttgggcggagttcaaactaggaagccacaaaacttccagttgcattttcacagattaatgaaatatattttacacttttcctgaaagatattttatttgtgcaaaccttgttacaaagtacagccagttgattaatcgatgaagtgatttgtagtggattcttatattttgtgtaagggtatatgtgaggccctatatatgaggctttctatataatgaagtataattcagttcagcatttcaattcagcaatcacttattgggcctctactcagttgccttcagggctttataatttaattgataaagggaggttaattaattaattataacaacagatcgcttaatagtgtaactactaatttaattaatgacaaataacaatacattaaaagaaatgcattaataaaaataatatattggtgttatagacaataattttctgattaactttattattattatttcaatagcttttggggagcaggtggtttttggttatatggagaagttgtttaggtatgatttctgagattttggtacactcataacctgagcagcatacactgcacccaatgtgtagtctttcattcctcaccttcctcccacccttcccctcaagtctccagagtccattatatcattcttatgcctttgcatcctttagtttaggtggcagttataaatgagaacatgtaatgtttggttttccactcctgagttacttcacttagaataatggtctccaactctatctacgtagctacaaatgccattattttgttcctttttatggctgagtagtattccatagcatccacacacacccccctatgctttatatatatatgtaaatatatcacattttctttatccactcattggttgatgggtatttaggctggttccatatttttgcaattgtgaattgtgcagctataaacatgcatgtgcaagtgtctttttcatataatgacttcttttcctctgggtagatacctaggagtgggatcgctggaacaaatgattgttctacttttagttctttaaggaatctccataacttttccatggtggttgtactagtttacattcctaccagcagtgtaaaaaaatgttccctttttaccacttccatgccaacgtttatttttttattttttaattatggcaattcttgcaggagtaaggtggtatcacattgtggttttgatttgcatttccctggtcattaaagatgttgagcattttttcatatgtttgttggctgtttgtctatcttcttttgagaattgtctattcatgtccttagcccactttttgataggattatttgttttttcttactgatttgtttgagttccttgtagattctggatattagtcctttgtcagatggatagtttgcagatatttctcccattctgtgggttgtctgtttactctgatgattatttcttttgctgtgcagaagctttatagttttaggtcccatctatttatcttttttgttgttgttgcatttgcttttggtttcttggtcatgaactctttgcttaagccagtgtctagaagagttttaccaatgttatcttctataatttttaaggttttgggtcttagatttaagtctttgatccatcttgagtggatttttgtataagttgagagatgaggatccagcttcattcttctacatgtggcttgccaattatcccaacaccatttgttgaataggatgtcctttccccaccttatgtttttgtttgctttgttgaagatcagttggctgtaagtatttagctttatttctggattttctattctgctccattgatctacatgtctatttttatagtagtaccatgctgttttcctaactatagtcttgtagtatagtttgaagttgggtaatctagtgcctccagatttgttattttttgcttagtcttgctttggctgtatgggctgttgttttgttccatgtgaattttaagattttttttcttgttctttgaagaatgatggtggcattttgatgggagtcgcattgaatttatagattgtttttggcagtgtgctcattttcacaatattgattctgccaatccatgaataagggatgtgttttcattagtttctgttgtctgtgatttctttcagcaatattttgtagttttcctgtagagatcttccacctctttggttaggtatattcctaagcattttttttttttgcagctgttgtaaaaaggctcaagttcttaatttgattctcagttttgttgctgttggtgtatagcactggtactgatttgtgtacattgattttgtatctggaaactttactgaattaacttatcagatctaggagctttttggatgagtctttaggttttctaggtatacaaacatatcatcggcaaagagcaacagtttgacttcctctttagcagtttggatgctctttatttctttctcttgtctgattgctctggctaggatttccagtactatgttgaatagaagtggtgaaagcaggcattcttgtcttattccagttctcgggggaaatgctttcaaattttcccccgttcaatataatgttggctgtgggtttgtcataagtggcttttattaccttaaggtgtgtatcttatatgccagttttgctgagggttttaatcataaagcaatactgaattttgtcaaatgctttttctgcatctattgagtttatcatatgatttttgtttttactcctgcttatatggtgtatcacatttattgacttgcatatgttaaagcaaccctgcatccccggtatgaaacccacctgatcatggtggattatctttttgatatgctgctggattcatttagctagtattttattgaggatttttacatctctgttcatcagggatattggtctgtagttttctttttttgttatgtccttttctggttttgatattagggtaatactggcttcatagaatgatttagggaggattccctctgtctctatcttttggaacagtttcaatagaatttgtaccaatttttctttgaatttctgatagcattcacctgtgaatccatctggtcctagactttttttgtttcctgacattttttctattattgtttcactctcactatgcattattggtctgttaataatttctatttcttcctgttttaatctaggaggtttgtatatatgcaggaatttgtccatctcttcttggttttctagtttgtgtacgtaaatgtgttcacagtagtcttgaataatcttttttatttctgtggtatcagttgtagtatctcccatttcatttctaattgagcttgtttagatcttttttcttgttttcttggttaatcttgccaatggtctattgattttgtttatcttttcaaagaagcaggtttttgtttcatttatcttttgtattgtattttgtgtttcaattttatttatttatttatttatttttatttttattttttgagatggagtctcactcttgttacccaggctggaatgcaacagtatgatcttggctcactgcaacatctgccttccaggttcaagtgattctcttgcctcagctgcccgagtagctgggactacaggtgcctgccaccacacctggctaatttttgtatttttagtagagacggggtttcaccatgttggccaggcaggtctcaaactcctgacttatggtgatccgcctgccttggcctcccaaagtgctgcgattacaggtgtgagccaccacactaagactcaattttatttatttctattctgatctttgttatttcttttcttctgctgggtttgggtttgctttgtcttgtttttccagttcctagaggtgtaagctcagattgtctatttgtgctctttcagactttttgatgtagatatttaatgctatgaactttgctcttaacatggcttttgctgtatcccagaggttgtgataggttttgtcattattattgttgaattcaaatatttttaaaattttcatctttcttgatttcattgttgacccaaagatcattcaggagcagattattcgatttccatgtatttgtatagttttgagggtttcttttggagttaatttttaattttattccactgtggtctgagagaatacttgatataattttgattttcttaaatttattgagacttgttcatatggtctgtcttggagaatattccatgtgttgatgaaaaggatgtagttgttgggtaggattttttgtaaatatctgttaagtccatttgttctagggtatagtttaagtccatgtttctttgttgactttctgtcttgatgacctgtctagtgctgtcagtggagtactgaagtcccccactattattgtgttgctgtctatctcatgtcttaggtctagtagtgattgctttataaatttgggagcccaagtgttagatgcatatacacttaagattgtaaatttttcctgttgaactaattattttatcattatataatgtctctctttgtcttttttaattgttgttgctttaaaatcttttttgtctgatataagaattgctattctttctcactttgagtttccatttgcatggaatatctttttccacccctttaccttaagtttatgtgagtccttacgtgttaggtgagtctcttgaagacagcagatacttggttgatggatttttatccattctgccattctgtatcttttaagtggagcatttaggccatttacattcaacattagtattgaggtatgaggtactgttctattcatcatgatagttgttgcctcaataccttcttgttgttgctgttgttaattgtgttattattttatgggtcctgttaaatttatgctttaaggaggttctattttgatgtattcaagttactgtttcaagatttagagctccttttagcatttctcagtgctggcttggtagtggcaaattcagcatttgtttgtctgaaaaagactttatctctctttcatttatgaagcttagtttcactggatacaaaattcttggctgataattattttgtttaagaggctaaatatagggcccaatctcttctggctagcagggtttatgctgagaaatctgctattaatctgctatgttttcttttataggatacctgatgcttttgcctcacagctcttaagattctttccttcatcttgactttagacaacctgatggctgtgtgcccaggtggtaatctttttgcattgaatttcccaggtgttctttgtgcttcttatatttggatatctagatctctagcaagactaggaagtttttcttgattattccctcaaataagtccttaatgaccccactatataacatgaaatatctgttgttggtactgaggtgctggccacaaacaattctgtgtgtcctgaaaactcttcagaatattcgtcatctttagcacttgttatcttagtgtttgggcttggcttagagtgatacatctcataacagggcaacagaaagaaccaggaaccaagatttatataacataagtcagtaaaactagaggcaccagaggtttacatttacattaggttacattttctaacaggtagcaaagcacatgaatgaagttcagtggaaggccttcctcaggaatccagtaaaaaccaaacatacacacacacacacggacatccgtgaggcaggaagggaggtccactatagtacagacaagcatcctggaaggccatcaaggagtaggtgggtttcagttgcctcaggaatgtggcatggacccaaactaagtgagtacagatacttgtcattgaggagaagattcaaaatagcatcctaggtgtaaaaactgaggcacctggggcaggggaactaggtctctggaatgttggcttaaaagcacccctctcaggaaaggcctcatatgccatgcagggggttatatatgtgttgtgggacacagatggcaaggagataattctatgcaccaggctccactactaacaggtaaacagaccaacattaacagagacttaggtaaaaaggtaggtgcccagtggtcagttctcaggcacttccaagatgcacctaacagaaatgtaacttggtgtctattgtgtcctaggtctaacaactgaagagaagtgaattagtacctcttgtggacagagaaacaggggcagagacccattacaaagctgtctcagataggcatttgaagctgtttaagtatgtagaggcttaagtcaggctggttctgaaatgtgagagagggttaagcttcatgggaaatcagcagggtagtttgctattttttattataaccaatctcacaatagtttgggacatcaaatatcaaattgttgggaatatttatccatattagtctttttgccactaatatttaaaaatagtttacaatatacaacaaaaagttgtaaaatttccatctccacttaatcgatcttatgtaacccatacaatacatcaaatgtcctttccccactttatgtttttatttgctttgtcaaagatcacttggctgttagcatttgggtttatttctaggttctctattctgttttattggtctgtgtgcctatttttataccagtgccatgctgttttggtgactatggccttatagtatagtttgaaagcaggtaatgtgatgcctccagatttttctttttgcttaatcttgctttggctatgtgggctcttttttggttccatatgaattttaggattgttttttctagttctgtgaagaatgatggtggtattttgatgggaattgcatttaattgtagatttctcttggcagtattacccaggcttttcttattttggcaccctgtgctgctgtctccttttccttctttctgcttctcttaaccaactgttacctacacttcaatactttctgagggcaattcatcctccagtaagtctccctgaatcttctcttccttccctggcttattatatatccttcctcttggttcccatagcacctatgcacacttctgtcattgcacttgccaatttgttttataatgatctgctcatctgtctcctcacttagactatgagctcactgagagcaatggctgttgcattcaccttatatcctcaacaccattctgaaggcaagagaaagaatacccagaggtggagctgggaagctggttgtccaagtagtgaatgactctagtttgaattgaactctatagccagtgggcaatgtggatgtgttgacagttttttaacaggggactagtgaaaacacattttgggtttagaaaaaattgcaagtctgatgacatacataggagaagagattagagataggaatttcacttcagaaatttaaccacaagagcaagtgacagatcacggaagtctgaaccagactataaatgtgagaatagagaaaaaagttaacaatttgggtgtgaaagggcgagggagagaggtgtgaagaatgactaagtgtggatctgtttttaaggattgaatggaaatttgagcattttagctaatcaggcctaatattgagcaaagcaaaactcttgcaaattgttatttcaagtgtgggctgagaaaatgaaaaaatataaattctcacgttataacctcttccgtgtgtctgatttgatagaatccagccccattgcctccaaattccattgcatcttagaccagcaaacacaagtgaattctacttaaccccagaattctgtatgaaaatcttactgcctttttttttctaatcatgtgtcaaagtgtgggaagaacttttatttatgttttaataaattgtcagtataaccatttttacttgaaaatattataatttttcaagtaaacaaattgtttctctaagttgaaaattttatgatggaataaaagtatttttcctcaaaacacatagaaattttacaacaatattttagagttaactaaatgtttctttagtagtttagtcacttaaaaagtgatatgattatgaaaatacttaaactttgtcttttaactatttctaataatgctattggtataatttcatatttttatactgatcttttctccaaactttagtaaaacatacttctgtaaacccctgcccacaaaactgaagtccacatttacttctgaatgactgataagtttgtaaaagtatgcatgaatttcgttattaaattaaagtttttattatattttatgcacaatggtataaattattaaattaattttcaagcttatagaacattgataaagattgtcattagaaaaccctgagttgattgttatacattacataacctttcattggtggattagtgaatatgttatagggtgaccatgaatccaaagaatcaaagctggctacagcaaacagagggtcaaaaggatatggaactatgcatgatccagcaaaacactcaatatctgttttcctggaatgttaaaagacaaagaagaaaacttggggaacactagatgcatatagttctggttctttaagaataaaaatatgggccgggcccggtggctcatgcctgtaatcccagcactttgtgggaggccaaggcgggtggatcacaaggttaggagttcaagaccagccaggccaacatagtgaaaccctgtctctactaaaaatacaaaaaaaaattacaaaaaaaatacaaaaaaaaaaatagccaggtgtggtgacaggcacctgtattcccagctacttgggaggctgaggcaggagaatcacttgaacccgggaggcagaggttgcagtgagccaagatagtgccactgtgctccagcctgggtgacatagtgagactctgtctcaaaaaaaaaaaaaagaataaaaacaagaatggtcagagtcctagtaccttgtccagtgtagtgctgccttgagattgcattgcaatctgtctgagagatagtaaaagaaagtgataccttccttagccctgtttctctttagactatgctttcccctctccaagttaatatctctcagtctaaagcctgggaaaaggtgccaattttgtttttctttcttcctcacacctcctagaagttacactgggacactattacttttttccaggctttggccatgtgtattgttttggagagtcaacttccttttttctttcattctgcaaatagttttgagctgtcactctgtactaggtgctataaaacttacaggtgcattttacatgcctatttcctataggccacgatttaacaaaatgttcataaatgagaattaggagtgcatgtattgaatcaccacacattaactgaacagctttcattggccagagactatattgacagtggagattcaaagataaactagagaaatctcatgcttaaataactttctataataaattatataagagaagtaggttcagggatcttgggagctcagaagcaggatgagttaaacaaaagttggattttgcctttagcttggtttcattatcctgaaggaagagcctgaaatatagtgtagggtgcaagtagtatatgtgggtggcaatctcgggaaacaggagcatgtgatgaataaggagaaaaagccaatataaaggtactgcattgagggcaatgagggctctaattctctgcaccttctcaagcattgtgcagattggttttctggattatcagcctgaaggacaaaacgaagaaacagccattagctcctgtctcccattgtctgagagctgccactaggatattaacttcctgaaattctgcagaaatctcctcttactttggcactggagatgcccatacgcagaaagcaaaaaggcacagcatatttaaggaagctcataagaaacagtgcatccagaagtggcgagaattggaggaatggacatgagactctaagaaccagcgcctttgatgttccttttgatctgttatgtagctcttcttgtacacaggtgagcaaaggcatgctggacaaatggattcacatgtgctaaagcatggggcaaaaaccacatattaattcaggaaaagacaagatgcgtggccctctctgtctctgtctaagggtgaattaaagaggggatatatgtacagagtggcagggcaggacttgagataagaaggctaggtgggtgctctcatgctagtagcattatagtacaggtgatgagaagctcctgaagaatcatcttaacatttgtattttagagcaacagtattgagttctgacttagagacagcaaaactaaagacagaaagactattttgattattaatgatgtagatataagaatatcgtcaatgtgaactaaagcatgaagctacttatgatatatcattaaaaggatttaactgattggagacaaacgagagggatggggaaaagaattcatttgtttttagttgctctttttttcctacttattcctttgttccgagtgtgaataaactttgtaaacttttatactaaaacattctgctcattcatacttatttctttgatgaaacaaggaaacccttgtatagttataaacgtgtgaatcaatttaaatattaggaaatttttttaaataaagctagttttctgaaggggaaaaacttggttcaattttttgctggcaatctgctttgtgatttttgaacatgatatctacatctagactcatgttttgctagctggaattttttttcaaattaacgctaccattattatatgctttactatttagcttttgcagccttggaaatctatgattaatacaaataattctctatggcaattttaaaaatacatgtaaaagccttcaatctacattgctactgtgtcgtagcacaaaaaaagaaaatgtgatcaaattttaataaaatctacaatttattcccttctaaatacagtcctagctcaggagaaaggaagctatttgtatttttcagaatcaaatttccctaaatgaatatagagaaagaattataactgaaatattgttgaaacagtggtcatctcaaatctgaaggtcattccaaaaaagtttctgagttttcattgcctcaatctaaaagttggcctttttggtaatagatgaaagtaaaataattgaaagggtctgttgcagttttggaatatcttgaaaatatagtagagtgaagccttcttcccttaaataaaagacaagttgctgattgttttctttctagccagataagaataatgccttctttctcttgttagtcttaacacctcacttgttactatgtgtcagaaaggcgagacaccataaatggagatactactgatggaggtcatctgacatggggctggtaggcagtgggaagactggtatggacacaggtggcttaggggttgggggatgatatggaactaaggaaatgataattagcagaacccagtgtgcatgtgtgtgcattcgtgtgtccgtgtatgtgtgtactgtagcacaatgcaagaaagaaaaaacaaggcagacttttcataatttcagggataaataaatcctttatcacttcatgtagaatattggctacttggaggtatatctaaacgtaaatatataactatataactacatgctaattaaaaacatacaaagaagaagtgcctaaagaattacaacagaaagtggcatagtgattattagagttaatataatataaataaggccaggcatggtggctcatgcctataatcccagcacttttggaggtcaagttgcagggatcacttgaggacaggggatagagacaagcctagccaacatggtgaaacccatctctactaaaaatacagaaattagctgggtgtggtgatgggcgctggtaatcccagctactcaagaaactgaagcaggagaattgcttgaacccggaagctggggctgcagtgagccaagatcgcgcactgcactccagactgggtgacagagaaagacccggtctcaaaaaattaaaaaatagtataaataatatttcaaaacacaagtctgttaagataaaaggtacagaggaatggtgagatgacttttttatttgtgtgataagggactgttttctgtgattgtgagaaagaccaggagttaagaaaaagtggccatcaataaatcagccacttatggggaagaaccataaaccactctcagatgaaatacaaatgcagtcattatttaatattattggaatatttgtattagtttttggtatgtgctgctagtgctggtacattttagtagtcaattaatattttgttaatcttaatttctaactaaattccagagtgaaatggaaataataatgaaaaaattttatttacaaaacagattttgtttttttctgttaagaatgatacacagttgtccttcagtagccataggggattggtttcaggacctcccttgggtactaaaatctgcagatgcctaagcccctgttataaaatggcttagtatttgtatataacctatgcacatcctctcatatactttcaatcaggggtccccaaccccagggccatgaccagtactggtccatagcctgttaggctgttcgataccaggctgcacagcaagagctgagctcctcctcctgtcagctcagtggtggcattagattgccataggagcacgaaccctattgtgaactgcacatgtgagggatctaggttgtgcgctccttatgagaatctaatgataaatgtaatgtgcttgaatcatcccaaaaccattccccttcccctcaccatccctgtccgtggaaacatttcttccagaaaaccagtccctggtgccagaaaggttggggactgctgctttaaataatctctagattactgataatgcccaatacaatgtaaattctatgtaaatagtttttatactatattgtttagagaataatgaaaagaaaaagtctacatgttcagtttaagtgttgataagtgtgtagagaaaagggaacccttgtacattgttggtggaaatatagattggtgcagtcattatggacaatagtacggaggttcctaaagaaattaaaattagaattacctaagacccagcaatccctcctctggatgtacccaaaggaaataaaatcatcacctcataaagatatctgcactgctatattcattgcagcattatttacagtagccaagatatggaaaccacctaggtatgtgttggtgcatgaatggataaaagaaactgtggtatatgtatatacaatggaatattattcagccttaaaaaaggagaagaccctgtcatttgccacaacatgcatggacctggaggatattaagctgtgggaaataagtccaacacacatccacacacaaaattgcataatctcacttatatgtggaatctaaaaagaaaaagttcaaatataaagttagaataaaacagtggttaccggccggatgtggtagctcacgcctgtaatcctagccctttgggaagccgaggtgggtgaatcacctgaggtcaggagttcaagaccagcctgaccaacatggtgaaatcctgtttctactaaaagtacaaaaattagccgggcatagtggcaggtgcctgtaatcccagctactcaggcagttgagaaaggagaatcacttgaactcaggaggcataggttgcagtgagccgagatggcgccacttcactccagcctgggcaaaagagcaaaactctgtctcaaaataaaaaaacaaaaaacacagtccacacactggttaccatgagtgaggtggcagggaggagattgggagatgtagatctaaggatacaaagtagcagatatgtaggaggaactaaaaagctgacatgcaggatgacaactatagttagtaatagtgtattgtattcaggatttttgctaattgagtagattatagctgctcttgccacaggggaaaaagtgggtaactacgtgagatagacaatggatgtgttaatttttgtcactataataaccttttcaccatatacattcatcttataacagcatgttgtttactgtaaatatatacaataaaatttatttttaaatatctgagtatgatttgatgatttgtgaaaatagagtgaattataataattttaaatgtaagttaatgttattagaaaagaaacagaaagaacataccacacagaaagtctgtctgaaggatctttgttttctccaccaatacaagtgttcattgattcagaggtggattatgagatatgaccataaaacaaaaatttcaagggaaatatattttattcaatgaaaaattctcaacacaactgttatatgccagtaaacactatatcttttaaataacaggtcatatctattatatttaaaattcaaggagagactacattagagatgctattagatcaacttctaatttcaaagatttctaagatatggaacagttactccttatacaaattaaaaaagcaaatgctgaagaaattcagctacatggatacaccatgaggtggaaagatgctccataactcttagttaaactgcactaattacacataaaaggaaaatgtttcatttcattgtaatttggaaaccaaagaaagaaaagactgaatttttacatactgttaaagagattgcgtatctgttctaagtttaagacagaggcaaaatgtattttattcatttgtcctgcaccgtttagaaataaaattcaacttccttttaattttttttaagaataaaaaactcagtctaaggaaagtcttaaagttttcattttaagtgatccactgttctagaagtttaatattttgtttaaaatgtttatgttctgtattccaccaagtctagttttaaaacaaaacaaacaacaacaaaatacttctctaacttggagtttaaggtgaaagaaaccaattacgtggtttggaaatgtcacacttttcatctcttttttaaaaaaatttttaattcaggacagaaattgtatggatttagtgtaagtcttgggatctcacaagtgtcagtatttcactctcctccatatcttgatagcaataacttgaaataggatctcagtagctcaagcaatactgggctctgagagttggttaaaaattatttggctgagcgcctgttgctgagggaagaactaatctcgagcatatttttggagccaaataccaaattgtttgtgcttagcaacacagcaccaggcttgcccttcagaatgattctagaccaaatgccagaaatgctctggttctgactacagagttctattcacaaatgacaggaggcaagaggtcctcctcactttcagaagaaaggtcctttgctttcttagtcaatggtaggaaaaccattgtggttttcattgcattacataatttttaaggtgattacttcaataagaagtgctctgtgtatatgtgtgtttatagacgcattttttaaacactggagaatttctgaaagtagtacaaaccttgtaatgtcaagtagatgtgggaaaaagggagtttacaacattctctcctgacattgctctcctttggcatctgcatttttaaaatgttaaaaatgtttaaaaacgtgtgcttaacacttaatttggtgatagttgctgttaccaaggcaactctgtaactccacccagataaaaataaatcttgaagatgagtttctgtgtctctgagcaaatatttttgtgaatagtagaagcagagaaagttaaagatacctgagcttttgatctttactagttttatagatatgtttatagttatacatttttattcatacattttagataaataactttgtaaagcaattgattcttcttgtaaaaatcaagtatattcttaatagactgataaactttctttttttgagacagagtcttgctctattgcccaggctggaatacagtgccatgatcttggctcactgcaacctacctctgcctcctgggttcaagcaattctcctgcctcagcctcttgagtagctgagattacaggtgcatggtaccacaccccactaatttttgtattcttagtagagatggggttttgccattttggccaggctctgagaaactttttaaggtctcttttgcagccagctatttgtctaccttatttcattcttaatctcactagccaatattttttctgtttaagtgctttcagcaaatattaaatgcttgtgccttcagtcttatcctgtggaaacactggtaatgacaaaaacacatatttcaacctaatatacaatagaaacagaatgccagttattcatggaggagaagaatagacttctgtatttaaaataacattttgctctgtgttttaaaatcattcttccttcatcaattgtaagcatcttgactataatttatacacctaaagataaataattcagtagcaatgataactgaaaacaggacacatacaatgaactagctaaattaccatacattctcatccatttcaaaaatagctctgtacttttttcagattttgttagaagaatattcaatacaaatttttattcaatgaacacttcagatgtcaagattgttacccacatggacaacagtaacctaggtaaagattctgcagccaggcgtggtggctcacacctgtaatcccagcactttgggaggctgaggcgggcagatcacgaggtcagatcgagaccatcctggctaacatggtgaaaccccatctctactaaaaatacaaaaaattagccaggtgtggtgtcatgtgcttgtagtcccagctgctcgggaggctaaggcaggagaatcgcttgaacccgggaggtggaggttgcggtgagccgagattgcaccactgcactccagcctgggtgacagagcgagactctgtctcaaaaaaaaaaaaaaaaattttatacctgggctctgtgctcaccagcagaaggggtaacatggcttcttaggacaaccttacttgaccatttacttctttgacactaggggtattcttagatcagcaggtccttccctccacttatgcacatgaggctcacagagagtctgggaggcagggaatttatgattggaaacagtatactttttatctaagaaattattaatgtcactgcattcaagtgattaacaccatcaatatcttcaagactaaggggattacatgatgtgtaaaattagaaaactgtcatctactagtggctaggcactttaattatattaagcatgcaacaagagaactcttcaaatgaatccatctctcctctgtattatttccaacccttggatccccatctgtttctgcagacaacagctatgctgctgaatgtcttaatggtttgctgccccaactagcttcaagatactgcaggtcaagcatagcatcttactcttccctgcatctccagcacctctcagaatgttggtcacatagaagatgtttgctgaggagttgaataagaatatgtacaagggacacaattagcattgtttaaaaaagatgtaacaagatagggtaaaggaaagctttggaggataaatctttagaacaatcaataatatcttctcctctgttggttagttgcccttcaatctcagccactgaatcaaatacaacataattactattctgatatgttcttgaatcgaatatccaataataagatattcggatgcatagccatgtctaatatcaaagcccatgcttttcgctattattgtactccatacattagcttccaaatttatttgcaatccaaatattaaaagcaagtcataagcttagtatcgccaatgtgatactaagtatccacttactaaactttattttcaaaatgtggttttatctcagtttaatgaacacggcatgttttaatttacactttcatattatatagtaagggcgtggttacagatatgttaatttcctgtgctgcttcacaatgatggaacataatagcaaatgaaactgttaatttgcagatacccataggcctttggtgtctgaatagaaataaacacacctacaactgagagaggaagcatgtgaagcattccagtgaacagaggccatttattcagtcacagacacaggagaaaaacaacaattaaaaaaaaatctctgatgaaaagttcataaaaagttcactcagtttaagcatatgtcctataactacttaaaatagagttcttcttaaatatcattctttgctgtttttagatttcttctgcctgtatcaaattaatagaacacagcatacttttaatttgctctggtttcttagtggggcatttattaaacacattaaaacaatagtctcagggttttactgctgatgttaaagttctgctttcctacttaccaactgtgtcatcttaaggcacatactttgcctctctctcaaatctcccaaatggagaatgataagaatacgtacctcaattaaagaagctataacaagtagaatgtttggaaaagtgccgggtacaccataagcccactatgagtattggattgtattacctctgaaagctgcagaatggaattctcaaagttatatgtccctaaaatcctcttaagtgacagaaatggagaaattagcagtctgtctaagagagcttttctagagtctgggcatatgtttttaggacaagacagttcagcttcagcttaaaatgagagagcacgtctgtgtccttactcctgggtgccaggtttcttgtccccatcttaagacaaataattttggtggagaagaggcagtctctttgatttcgctctaaaaaccttttctggaggaggtagacactctccacccccgttttgagactcatgcagctgaggatgactggctgagtacaagcaattgttccttctaagcagtttcaattcttataacttgtggagatattcttaagtccaggggattttgtgtatggtggatttttattacaaagtcctgtacttcataggaacaaaataattcaaagtcaggaaccagatcaaagccacaactcagatatggcaccttgagaagttcatttgtatttcacttgcataaaaaccctcaccactgctatctgattttcacaaatcattcaacagctatccatgaagcacccactgtgtgtctggtctctgtgtcagtccctggcttcatgtgtctttccttctgtaccctgactccccaactcatgaacacatgaagtaaaaaaatgaaaatctttttctgacctctcttcaaaatcacttttttcaaaacaaacacctctcacctgctcatcctccagccagtaaatcacaggggcctagagatgtcacttacaaatattttctgattctgtccctcccttcaagcttgccaacattatcacagtttagggcctgctcatctttcccccaatctccaattagatctctccacaatgcaattctgcacattccctgttacaacccttcaattatttcccagcccatccaaaataaaatctaagcctcttactaacacattcaggaactctgtggcctacggttttctacagactaattttccagcagttgacttccagtgcaagtgaaaacctagtgtcatgcctgcatgatagataaatttgaagctgaagagcccaaatgtatagaccatgccatgaaaggtttatagtcatgacacagtggccctatagtacagtgcttgaagctggctctctactgtcagacagaccacttgccagccatgagacctggggcaaaatgccttaatttttatgtgcctcaagttctcatgtgagatgagaataaaaattacccctatttcataagatttgataaagtgtttagcataatacctcataacaattgcaattcagtggtggttattattataaagaaaagatgattaactttatcttaatgtttaacttgttctgatagttattgatctatagctttgatatggaggtttgagaatgacctggaaagaattggccacaatgattgaagatagtgatacaagaataaaagatgactgcaaaatgtaaacctgcaataacagaaagaatgaagtcactggtctcatgggaactgatatgggagaaaaaaacagatcaaaaggctattcatgttttgggcctctttgtcaaaatggaaatgagaaactggggaataaaaattaaagcaattctagcatctggttttaacataattcttatccctaaaaagaatctataagaaactcccaaaatgacaggcagccgtgggtagcattgcatttcaagtaatcttttaattgttaaaatttaagtttccaacatgaacataaaattttcaacctaaaagaaatgagttccaaatctgagacaagtgaaaaaggataaagcctactagggggtaaattccatctctttagagatctagtacccaatttagcaatgtccaatcaagcctttaactactacatttgaacacctcatcatttcaaaatgttacttaatgatgccaattaactgtacaatgtctctgcatagcacatagccctaaaatgatttgtgcaatgttactgtcagtaaaactgaactacagggaatgctcatattctatgtcattatatacagaaatgcaatatcaataaagtgatatctgttggtattagaaaaaagtgaaaattttcatatctttctattttcttttttcctcaatgggatgctcttgttaaagatagctctgcatagtaaggtttgtataaacattatttagctaaagttaaaaggggtaacatactggttctagcacagatattaaaacaaattagtttgtaggtagggcagcaatcaattatattactaaccatagctttggtccttttatcctttcccatttgattttacacagtgggatgttaaaggttgaatgtctttggtatctataaacttaattgaaagctgttatttgtttgtttaagtctgttgatttttataatcataattttactcctatagatttcttgtaggagtactatatgaatttatgttgcactgaattttgttatgttatacaaattaataggcttttatttatggaaagctactattgatctgtcatttcttaaaaaattactaaaaagtgttaaaactttaaatgttggagagtttatattttaaaagttacatgctagaaaaacatgatgtctgagtatattagaagttatagataattcatctgtcaactataaaactctccaacactgcctttctttaatgaataatatgaaatttagcagtgaaaatgtgacaatgtacaatcctaaataaatcaacaaatttagagatgtacctctaaaaccattgtaaattcaacagtgtaattttccattggactttcacttattcattcattaaacaaatgtttgtgagtgcctgcaatgtatgagacattgtactgaagctaggcagtgtgagttatcatatgggattatcctttaaatacttctgagggcaaaaaaaaaaaaaaaaagaagagaaaaggtgtgaggaaagataaagggttaattcattaaaaaataacacttgaggactgttttctttgcaaggcataaagttatcaccctttcaaacagtagatatttcacatttaggatgcgagactccagttccaacaaagctcattgcacagctgctaccctgattaaactgctacatgaactctgagcaatgtagcatggtagccgcatgcttctgcttgcatgatggttaattccttccattctcattagtgattttctgagctttgaaattctgatggtacctaggatataaagcatatttatctaactgaaaaacagataattagatgtaacataaaatatgaatggctttgtcactttattgtagcagagaatgaatgtgggataaattaaagctgatgctagaacatatgcctattttttagctggaaaatttcaagatttatgtactttgggcttgagaaagaaatggagtttattttttatgcactgacatctctttttttttttttttggaagagctctcttaggaatgaatggtatgtaaatacagtaggaatgtaattatagattttcctgacccagttcctaaataatagatatcatttcagaagtgccccaatacctgaccttttgctccaagccatatcaaagcacacatctagtctacttttcactctcattcctagccactatgacaatactattcagataaaacttctagtcctctacttatgtgactcataccaacttgaccttacgatagtgactgggggtgcatatctaggttcatgctgtttgtccattattatggttttgtgagaaaaggcaaaatttctaggtaaagtgttatgaggacgaataatccaccaggcaaccaactgaccctttcatttgccatcttgtcacttcaaacagctctccagaacctgcagccagcacagaccaaagtcaggtttgtctcctcttctgttgatgaacaaaggttgattccatatcgtggctattgtgaatagtggcagtaaacatggcagtattgtatgaaaatatcacagatagcccttaaatatgtgcaactatgatgatctatcaaaattaaaaattaaaatttatttttaaaagttcagttagaaagcttgtagttcctggcaaactactacctttctcggcaaaagaatttgatatctcttaaatattttctgcctaatgctgatagattgtatttacatattccattaatgcaataaataaaattacaccaaaacatcagcattatttatttccaggggcatctctcaaaataaattcctccaaaattcacaaaaccaaaaccaatgtgaaattgtactcagggatgcaaatgtagcccagtgaagcatttgcccacttgtttggtattattgaagcacaattagaaaaatgtgcaatgtatgcccaaaaattctataataagggccaggcgcggtggctcacacctgtaatctcagcattttgggaggccaaggtgggcaaatcatgaggtcaggagatcgagaccatcctagctaacaccatgaaacccagtctttactaaaaatacaaaaaattggcccagacgtggtggcgggatcctgtagtcccagctactcgggaggctgaggcaggagaatggcatgaacccaggaggcagagtttgcactgagcctactctccagcctgaacgacagagcgagaccccatctcaaaaaaaaaaaccataataagaactttttaatatactatattataatgtaaaaagactagatgtcaaacaaattaggtgatgggaaggaattgagggagaattttagactaagcaattgagcagcacctgtttttcaccacaaatctgttacatgtattgctcaattgtgctgaatccatattgggtcctggtggctatgtaatagtctctttcttggataaatgtttgtcctctcttatggtttactaatggtgtacagaacagcattgaatagtggttatttcctatgacttcctagatatctctctcataatcctgaatgttttaaagatcattcttagatagagtacagctagacacgaaccatagtggaaatcaggtagacaaaatttaaaaggagtcttaattgaaggtcattttattgtcctcagtattaatcttatttaaaacaaacctgtcactgagcagaactcaaaacaccagagccctttgccaaatgtgattttttacaacaggagcgctggcagttgagaggagtattctgtcacacttgagagaattcgagtccctgaagatttatatgaatgcttagctattatcgaaccatctcttcacagatgacttagtaaatgtctgcctttgcatcagataatggcttacaagttaatctcctcttgctccctgttacacacatatacatcttcttcctaaacagctcataaggtgaaagaaagactcagatttctgactatgtaattgataatatcacacggactgcctgctcatcatctgctagtcacattggcagagttgacagttttggagacactgaagacagtgcatatattaggaaataagcagtttcctgatataaattttcttgtagtttataaattacatagcatttattattccctcatattttataacatttaataatagaactgacacatatattcattttaaactcaattgtgtataataactatcatagcaacccttcagtgcctaaatatcaaatcttccattcctcccatgaacatcttgaatatataggtactgtggttagctccaacaagcttttggttagaattcattgcactgatacatagacattgttttaaaggcaatttcaaatcaaagctgtcagctgtgaatcaagcacaccttaaaaagtgacacatttgtcactagattccagcctctcaaattactgacacgcatcctttttatgtaaagatgacattgttctttcctgatatattgcattcctcatgaatttcttatagtcatagaatttttataaaccatttcagaatcgctgaaataaacatcaatatttttaactttttcattctgtcaaaaatattgtatgcagagatattgctgtaagtgtgtatacctgtgcttaagagactagggctgaagagaagtaatcaaccgaaccactggtgtaaatgtgcgtcacatttttagtgactagaaattgaaataattccaacaaatttatgtgctttgggcttgagaattcagactgccttaggctaagataaaaatcttttcctggtactatataccttcttttattgaatgactacctggctctttctattatatatgcagattttgtacctctggtcatctttgtaaatggtgcctaaaagatatttgaagaataagtgaccagcaataagaacaaatgtctatacaaaagcaccctttagttggatgtaattcactactttgagttgttaataacctctaaggatgacagtagctattagttgaataaaccattatgtctattattagaacactagatagtttataagtccaaacaatgcataaaatacctatctcatgttaccattgtttaggttaccagataattgttctgtccaattattccacttaattttttgcttgcccattagctaaatggcaagataaaatttgtcaaacgggggggaatgtattgaaaatgctagacaactacacttaaaatgaaaacaggccaggcgcggtggctcaggcctgtaatcccagcactttgggaggccaaggcgggtggatcacctgaggtcgggagttcaagaccagcttgaccaacatggagaaactccatctctactaaaaatacaaaattagccgggcatggtggcacatacctgtaatcccaactactggggaggctgaggcagaagaatcgtttgaacccaggaggcggtggttgcagtgagccgagattgtgccactgtattctagcctaggcaacatgagcgaaactccatctcaaaaaaaaaaaaaaaaagaaagaaaagaaaacaaatgcataatttgcaaatattatttttatattgtatgttatctagggcttctaaatgcattcttcttataagcctaggtttgcaataacattcatttagaattgagtaattttaaatataatattttataaaataaaatataataatttctcttaattctttgaaaatattaaattaaaagggggttgcaaactctgcattccacatttccatcccaacatttaattttagcaattttgtagtctgcctaaaatgcaatccatcatttactgtttagaaaatagggaatgtacacaaaggcctttcagctttccctgaactccataaaaatctttttgcttctttactgcccccctttgtcaggagttctgaggaactgttttttatcttaagtctcacaaagcatttaggagaatatttaaacttaaattcttttaaaacttatgttcaggacaaagtaacattgtatgcattggtgtcatatgtatttaaattttgaaatttttaatactggcaaaatgaggtttcaattttaatataaattatttaacaatcttaaatcattaaatatattacttaatatatttaatatatctaaacagtcacaattttcccatactaataatcataaaaaatcttacccaatggtcatatagatatacttaatggagttttgggggggtatttttgtatattaaaaaattcatatatttgccttacttagaagaactgattaaatgaaagtataatattaacaaacatattgttattttatatttgcatttgtgataattatatttgaaacgttcaagattttccaatgaatttcttttgcatttgcgtatttgtgcctttttattataaaaataggtggctttttagttccactgcataagtttcaacataggtctacaaatagtgcatctttttgaagttaatcattataatcacaaattgaagttgcctgagctccaattggagtctaaatggatgactgaatcttattattcgaaacccactgttgctacacaatatggccacacaagagagtacacaagacccgtctgattcagcctcagtgccataaatattttaatggtttcgttggaatctggaaatggagctcaccacaggagatgcttcttcctttgactctcattattatttcctttacaaattaattaataaaaacttagatgctaaattagcacttgatgaaaacttatatagccttgacattttgattctgtgagtgaataaaaatacttggagaaataaaaatcctaatcatgttcaggaatacccacaaggtaacaagtacatttttaaactttaaaaacatttattattcatgataaaacatgttgtgtgatttaaatataaatttttattatttgctttaacttatttccggattaaaaagtaaatgtttacctagctgttctaaatggtaatcctcatgattaaaacagcaatttgtcatatttcagttacaaatgatcttttattattagttatagaacataagtttcttcattgactgaggcgatgtttcaagtagataaatctgttaaaaaaattgtggtcatattctgttaaattctcataccaggcaatttgtttgatattcaggaaaaacctagccactgaccaaaaactctacctgccttctcagttgtatcctcttggacttaaaggggactgggaaagttataagatggttcatgatagtccatcaacatcccaagaacaaaaacagatgttgtactgacagcatcatatgatcatatgcatgtaagagcacattcatattgccaaatcagttggaatttttcacggttgaaagttaaatgaaatgcttagatgtatgagtcatcggagttaaagacaattacagccagatttatggctgtgctaaaataaagctagttagaaaacagaccaaattccatgacgataccaagtctgactaatgattcaccttaaatttcggagcaacatttatcctcacttgtttgtttatttgacaatgtgcccttatccattaagtaactaggaggaagggaaaagcactacgtgggtgagtgacaagacactgacactgatttgtgactttggataattcctggatgctgttatctgttttggcatagagatggatctgtaactgctaataattgccgactgtgaccatcccagaggccatttacttaacccaggtatttcagacctgacagcccgaggataaacacgatttccctccatcactaacttcatctgcagggcctaagcctccttcacagtctctccagtgatttattggcatctccaagggtatctcacatgtgctgaagaacaaatctgctcactttcatctgcttggttttcccttttgaaatctgctgctttaaaattactaagggaggaatcatgcctgctgctacccttgccagtgaccttgcagtttgtgccctgattgttctaattaccacaatcaaaacagaagcgtttgcagttactgcagtgctctctctgtggatgtcaggtctgactcagagagccaggctggggaacagccatttccactcttgtacctctgcaaaaggacttccatgttccgtaaacagactcccacctctcattttccccccaagcaaagcatcataaattagagagcatgtaacgggaaagaaaatccattagccatttgggttcagtcagacaagccagctcatggaaagtttatacaggaaggtcacatttcaattgagatcaggagggtgaaagggtccagctgtgtgatgagagagagaatgttcgggaatgtggaacagaggtatccaaggcagaacaaactcgtatatgaaggctttaagggtgtgcaaatctagcatattttatgacataaaagagtcctgattagctagaatatgatgaatgtgagaagaggtgaaggctggagataggaaaaattattccagatcttataagctatagtaagaaatttgcatattatatatagacttgtgggaagccattggattttgtaagaaggagattaacattatcttatttatgttatttgtgatttataaccccaaatgtgccagatacaaacaaaccaaaaataataataataataacaagaagaagaacaacaacagcaatggaactgtggtgatggttttggtcacaaaatgcatatatatctatttttcacaatgcaaaaatatttcattatttcaaattttaacataaatgtgggtatgcatgagcttacaaatcttgaagtttattggggaatattggtgagcatggtttttattgcatggtcacaacttactaatgggaaacatctgaatacctattgagttaatgcatgcacatttttattttcctggaatactgagaaaaaggttgctacataatgtcttgatagcttctaagtcatggctcaaaagtgaatgtggaatctgctaatcggaatggactcagattcagccaagttctcaaaaacatttgctttcatagatgtcttcaagaaacaaggagtcttgaatttaaattgtgaagtgtctatcttagaatagagagatttaaaatctgactgtattttgtttaaaaaagcctatataactgtattatataaaattatttatactacagttaaaaaaagaatcccatcctatttgtgcctaaataagtgcctgcttgtagcatgaaaactatttgttgagggtccttagatcctcagagcatgctgtgaaagtaggtacaattgttctttctatataagcctcttaagataacagataattgccagaaatacagcacacagtacaaaattaccttgttttacttttgccacaaaaaacaatttcttttggctttgagcaataaagtccaatgatttttttcctttcaaaatatcttcctccctctccataagttttatatttattcacgaaggaatattccaatatcggatgtttttgtctgtgtctcttcctggaacaaatgttaattaatctctttgggtttgtatgtcaagtggaggggtggggattggggacaggtgatagttgtctagggagttaacttcatctctataggagagtggatagacgctgtatacgaaaagctcttgaaaagggaaatacagcagccacttcctcagggcttccatggtggtcagactccttgattgctttagattaactctggcttttgtccttcggaggccaccagattgggtggatagacattgtccttgctgttcttttgacctacctacttgtactttaggggaaaaaaatgcctgtaataggttaaatgctttctcaaagatcaccaaagtatataacacatggcaaatagacagagaaatgagacagtataatcagtataatttataaaagtaccttacagcaggatcccatgggatatgggttttttttaaaaaaaatctacctaatcttttcattgaactcctattcaggattcattatattgaatatggctcagagacctggaaaattgtttccacctttttaatttattcaccatcatttatggaagttttcaaggacgtttacttacctacctcagttaacagattgtactacttgggaagtctataaatatgagcttaaagcattttctgagttttaaaataatttagattgtgtagaatgttaaaactaaaagaggaaaaaattattcagttcctcagttgaacctagcaatttatcttttcacagtgtgctcaagtatagtttttgaaaagtaaagaagatggtttttatacaaacataaacacatttcaaagattttattcaactaattaattagtagtggagccaataagctggtaagactggtttaaaggaatatctgaggaataaagatttatagaaacagtcaaagaaattctaaagagaattgactaatagatataaatctagtaaatatttgattaataatagcagtaacctatggaattatgttttctactgagcataaatgagcatgaatctctttgggtttgtatgtcaagtggaagggtggggattggggacaagtgatagttgtcaagggagttaacttcatctctataggagagtggatagatgctgtataagaaaagctcttgaaaagggaaataaagcagccactgcacatctgcacatataacctgtagatctgggggctctaataaaaaagttaatggcaatgtcaaaatcaggtgttttatcttagataacttcatagtcattgattgagccccttaaaaataacatttaaaggacatgtagtcattctgtttctttattgccaagttttcagcaatttttctcatgagaatgagtgctaagaaacttttggtggagcgtggtggctcaagcctgcagtcttgcactttgggacgccaaggctggccaattacttgagatcagtagtttgagaccaccctggccaacatggtgaaaccttgtctctactaaaaatacaaaaaaaaaaaaaagtgggatgtggtggcatgcgcctgtaatcctggctactctggaggctgaggcacgagagtcacttgaacccgggaggcagaggttgcagtgagccgagatcctgccactgcactccagcctgggctacagagggagactccatctcaaacaaacaaacaaacaaaaaagaaacttttaaaatataacaatagagacattacataggcccacaaaaccacctccaaaaaagcattctatcacctgcaagaaagcatatatatatatctgcttttgtgtatatatatatatatatatatatctgcttttgtgtatatatatatacacacacacacacacatatgtgtgatatcagcatgtgtatttacacatatattttgtgcatgtatatttttaactaaaaatgtgctaggagttagatatgaactgattttggaggaggtgatatgctgtagagagagagaatgggagaatagcagtattataatctctctccattgtattcagtttttttctttgtctgaatttttaatagaagtcagccagaagatgttagtttctgggaaatgtgttgagatttacagtcaaatccagagagaactagaggcttatgagtaaataagtaaaggttatgcagagaaagtattctttttcctgtgtaaacttgaatattggccaggcgcggtggacacctgtaatccagcactttgggaggccaaggcgggtggatcgactgaggtcaggagttcatgaccagcctgtccaacatggtgaaacccattctctaccaaaaatacaaaaattagtgggtgtggtggcaggatcctgtaatcccagctactacggaggctgaggcaggagaattgctttaacctaggaggcggaggttgcagtgagctgagacagcgccattgcactatagctacggcgataagagtgagacttcatctaaaaaaaaaaaagaaaagaaaaccttgaatatttcttgtacttgtgttcaaatcatacagttatgaaagtttacccctagctgttacacttaaaatgtacttctgaaatatacagagagatgatacagactattaatgagttccactaaacttttaatggtttagaaaatacaaatattttcttatttttctggaattccagccattaatgtaaaacattggtttcaacataaataacacactggcatgcacatatgcctaagcatgggcccccacacatacagacattctgaaagaccactttttaaaaatattcagtaccgtatattgtgcattccttctttatccacatacttaagctgctgcaagcatcccattgataacaccagtaataaaagatgggaccatcagtaatgagatttgaaagccccttttgcaagaaagtaaggactagaaggtggaaatcactctgtcttagagtcatatggattggggctttgctagaagtgtgtgctctcagggaaagctgcctttttattttctccagagaaaagcctttttgtcagtaaaagaagatgtatcatccaatgcatatgtaaaattctaaacagcagataaaacaacattcactattaatctctgcaaaagaagatatattgaaaaaatcctcaagtgtccctctttgggtttctttgttatatattaaagcagttatctttagatgcatgagaatcacctgaagaccttatttttaaaattcagattcctgtcagttcactcccaaagattccgattcagtagttaagagacaaagcctaggaatgtgaatttacaatcaacacctcaggtgatagccatgcatgttcttaatgctctactactatctatgcataaaaggaagataaagttttaaaaacttgaaatgtggtataacagtttagtattgaataatatacatttttacttattgtaacaaattatgatatctacttggggcaacagtatcttttattttggatctgaatcctaattttggctaggtatcactgagggattcttagtctaaaacaattaaatggagttagtggttttttttagtaactcttgattttctgtttttttccattggcatcttacaaaatttattcattcatttttccctttttcacttggcattatttgttagacagtggacaaaagaactatagaaagtagagaagcatgtgatgttgtcctgctcttagattctcgcaactcaggagaggacattcgcttacaccaatcatctcaaaacatggcagtttatgctgaactcagtccaatgggagagcatttgactgagcacatagggagagaagttagctctgttgaaggataatcaacgaagaattcttaggaaaggtacagtcattcattgaatatttgctcggcacttactaggtgcatatgtgcactaagatctaaggatgggctgatgaagaacccaggtcccttttcttctagtggacatgcagactggcctaaaaaaaaaaaggtaactggaaaatggataaggaaactgagtcactcggtttatttattatcactcggtttatttgcttttgtttgtattttcattttgacacagcacagtgtcatcttaacgcatcctccaaagtgaaggatggggtggataacactttagttggcatttctgtagccaggagccaggatctttctcccataattgcattaacctgggaaggcaccctctaggtagatttgtatagcaccctggttaatcaattatcagtttacttcttgtctcactaagctttaacaccttacatttatgaagcagtgtaaatataactttagcatcttgatcacagcaagcacctgatttgtatttttttattagctcaagtgaaatcagatcagagaagtacattacaggtcataaaatatgtgcaaatttcataatgacctccttttaaaatgtgcaaaaataagattgttaaggcacattccagagccttggggggtgtgtgtgtgtgtgtgtgtgtgtgtgtgtgcgtgtgtgtgtgtgcttgtcttttgagaatatctgtatatcagaaaatttggctgagaagcaatcttcttcttagtggttctttttctcttttgaaaataaagtactaaaaatacttaaagatgcagaacagcaacctgttcccagtgagactctcgtttaattaatgtggtgatctatatagagaaaagggacaattgcaaaagtccctcaataattatctaaccacagtctttaggtaattacagcagaaagattttcaagacacaaaacaccctggaaaatttgacctcttattttgattcaggcctttcatttcttaaatattttctttaatgttgatgtttatgcttgacaaggtcagcctaatgccagatgaatccctggaactcaaaacattgctgaattcacagttgaaggattttaatataatataccagcttttaaaaatcctacagtgagaataacaggactgaataaaaaaattaagaaatgctcaggtagaaataaatagagaaatttagaaaaaaaataaaacgtattcaaaataagtattaagcattggcaaagaaaaaatagtagcagacaattacatgttccatttgtaaagatgattattaattagtggtcttgcaaaacattggagaaaatttgctgaaccatcacattcataaatattaaaaccacccattagtgaaaatctttttactaaacttcacaactgatagtcaaataatgttcagtttttctccattgcaataaaaaataaaggcttttgccttcagatcagtctctgggccttattaattcagtcagccagaagccacatggaaatattttgttttgttaaaagccagcttgccctcatgatcttttaaaatcttttaaaaatcttccatcagccctctccctgacttgaattatggcagtgctttctaaactggtaaactcaatctccttggtgtgcctcaagatagagtacataaaccctccttagaaattgagctctcaattctaaattgcactctccatgagagcaagcaagaatgctttgctttgtattaagtggtcacaatattaaatataaccatagacagcactgtattttctaaacaccttattttcttttaatgactgacataaattagatcataagtatacaaatgcatatctgttgtatttttcagcaccatgtgtttttttttcttttttctgagttattttcctgctttcggcagccttttctctcaggtgccttgtgatccacagtggtgtgtgttcacactaaccaaagcaatagtcttacctgccagaaatagctgtgacatttaaagagaggtccaggggaaggcacagtgcttaacatccaagtctgaagagctaatagtgaaattggggcatcagctacagagagatttaggggaagtaacaggcaggttaaatattttatggaaatgatttctgttctgtatatgattgcaattaacacatgtcaatctgtttcattaatttgttaactcatctattatgctatgccatgaagaaaataaaattggagttctttatttttttgagatggagtctcactctcttgcccaggctggagtgcagtggcaggatctcagctcactgcaatctccaccacccaggttcaagcgattcttctgcctcagccacctgagtaactgggactacaggtgcgtgcaaccatgcctggctaatttttgtatttttagtagagatggggtttcaccatgtgggccaggctggtcccaaactcctgacctcaagtgatccgcctgtcttggcctcccaaggtgctgggattacaggcgtgagccaccgcgccccgccacaaaactgaagttctaagcttcagtttagatgctcactaaatgcttgttttgcaatacctgactgtaactggcaggaatatgttttgaaagtcctcattttccaggtatgcagatgaaatataggggcattatctactatgtcaaattataatgatttatcagtggcacatgaaagtcgcctcacatttcttaatcagtgatataccattatgtcatgccaccttttaatgtaatatgtttatatctttctttagatgtaagcattcatttagttcatcacggtggctttcacacttactccaagaacgctatgagttcctttgatgtgctcaagtctcctgccccagggagaaagggagtggtgagcaggaatcgctttaatctatttacacagatattttcttttccatttattttaaaggaattttttttaacttaatgagtatgcagtgacggtggtgatgatgatgatactaaggtttaaatgattagatagtcaaatctgggctggaattgtaatactgttttgacttttaatcttagagaagctccagtctgcttattttctgggcataaacacatgagaacaataacacagttctgttatctgaatgttgttatattttgtttgaaacattcagtgactttcaaatattgtatttgcctaagaaaattcaacagagtcagacattctcttccaggttaaatttggtgagtctgctaggaaaataaattttgtgcactggtcattctgatctagtggacgttctaataaaagcacctttgtgctgcctacgtcttcactttaaagataagatacctgggtactcgacaccaaattatagtttgagatctcaaaaatgggatagggaaaccacagctcaaaaacaaaaatactagcactggaaaagatagaactagtgaagatgaatcattctctagactttaaattcagagatatcaaaattaagaaaaagtaggaggaataaaaaaagagggtaagcaaaacaatataagtttgtatagcaagagggtataaagcaaatacaatatttttcagaaaaattaaataaaaatagatttacataacattgtttttaatctcaaagatcaaatttcaattttcatctcattttaaaacccatatgcacagtctcctttatatacatcagttgggtgtcaaagtgacttttttcttgtttccaaatacagttatttttaaaatttaattgtatgatttaggaatttgaaagcaagccagtttgcacacacatatgttattatatgtgtgctttagacttggtttttagttaatgtaacatgacagggccacctgagttatttgtttacaaactagctggaaagccaccctggaggagaaacctggcaacaaaatggtctgcagctttgttattgttatctataggattggatgccattattgctgtaaaatagttcacaagaactcagtctatgggaaagactcaaaaattctttgcctgttaaagaaaaatcaggatattggactggttagtttaactaaaaagtgatgatactcagattctgcttggattcactgcttctcagcagttgttttgtttctttctaattgatattttatttttcagagaacccattataaaactcttcttcttcccttaaaatcacaaccacacaacagcaattaaaacatgctttgacgtaagactgatatggttttaaacccagcttgactatcgaattttttactttaggcaaaacacctctgacatttatgtcttatcgtcagtaaaaaggggtgattaacagttttacaagattattcaataaataaatataaattcctccttttccttcctttcctttcttcatcttcagcatctgcatgccataagctcattttagttctctggactcatgttaacatgtcccacctttcccaaattaaacatcatctctgttattggctccattcttttcctctcatttgagacaattctttatcaaccaacaccctctctgctctgtattgtgaaactctgctcctactacattaacagtctcttggtttctttaaaaagaagacaaaacaattaaagaacagaagcaaaaaatctactcaaatccccaattgttaccctcaaaattaattgtcccacccctagctttctcattgcacaactctttgtcaaaatgttttctaccatcacagccttcaatgatctttctggttcctttatctcctgaagtctgacttctacctccatctttttctggactattcaacacactttgagaaaaaacatacttttgttaaacaggtatgcatccctgaagcataaaatacatagtactgaaagtgcacatgtgtggttcttcccattttttttacagcacttgaaactgacaagtagtagtaccaattacttagtaaaagacctttttcatttcatttctgaaatattgttattttcctttttcatcttccatctctgactacacctccaattttacctctttgctgccttccttcctaagaaagttcttcatgcaatgccatcttgtttttcttcacttgcctctttttctcactttaattttatgaactctgatgacttacctctgtagtgtaactactcaaaatatgtatttctgaagtctcaactccaatctcatattttcaacttatatttatggaggcatctcagactcaacctacctaaaaaatggcttatctgccctaaaatctactttgttctttttttctctactgctaataattatcttcctagttggtcaagctcaaaacctaatcatttttactccttgtccctgtgtcagctgtccacattcaagcagcgtatcatttctgcacatttttcaagcaagtcagtaactgccttttgtttgggactgtcttttcatatagtgaacagccttggaagatagaaatcatttctccttctaaaacaaaaggcaggtgtgcttgcagccttggatagaggtagtgcctctttctaaagcaaagggacatctttactggccattataaaatatccatgtttcctgagctctgcgttcctcttttctaatgcaacccactgagcatgtaggtgtcacctgagcttttctgtgggaattgcggcttgaggaatcagtgcaagaaaatcatgatactcttgctaatgctattaatgtgagtagtaaagttaattgtctctgacccagcactattgtgtctttgcccagcactcaaaagactggcaggcttgcaagtaggacaaaatgttagatttttcacagttcttctgcttataagtacttgttaaaaccaattaaaacacaacttgtagtttgcacctataattttgtagcatttgcttcttatctatgtcactaggatgtgcttagtgacagacccatctatcatctattactcaagtttttggctgtattcctaggcaacagagagaaggggaacaaacaagaggacctgtgcacagtttgagaaaggcaaaacaccgagcttaattgcagacttgaatgtagctagcaaacgaagtaaggcaaaaggttcctttttttttttttagatggagtctcactctgtcgccagtctggagtgcagtggtgctgtctcggctcactgcaacctccgcctcctgggttccagcgattcttctgcctcagcctcccgagtagctgggactacaggcatgtgccaccatgcccagctaacttttgtatttttagtagagacggagtttcaccacgttggccaggatggtctcaatctcttgaccttgtgatccgcccattcggcctcccaaagtgctgagattataggtgtgagcctccgttcccggccaaaagtttccattttttaaatagttgggtttttagtttcgattctttccaaaaaaaggttttcttaaaaaaataaaattagcaataagatgaaatataacaacaatataatcttattaagacaatatatgatatacatttatcaaaatacttatattttcaaaagtgcttaaaataatctagcacatagtagatgctcagtaaatatttgatattatgactgtgcatgggtcattataggctactttatgtatatcatttcatttagtacaacatcactctgaaaaatgttttattgttaccgtttttcagttgaaacatttacgttgctcaagatctcactggtaccatctactattaggtcagtctgccaccaaatctcatgctcttaaatgccctttttctcctgagcttccaacaaatagtgtactgtatataattgttgaagggaggggactgtgagacaaaatatttagagtgaatgtgtagccacaatttcagttcctcaacaaagtgataaaattaggaatcatcctcaatatatattcttccaacacacacacacacatacacacacacacacacacaaataccacaagcccacttgaatgcaccccacctacacattgcaaccatagagacaattgcagcattaaatacagaatattctgtgtgttgtttgtttgttctccctttgctacaaaaatcagaatttctactcaataaacagcaaagggagatacaaatgaaccaaattaaagaaggaaaaaatgttgaaaaaattatatacagaactatgtattgatttattgagagttcagtaatgtaatccagaaataatggatgccttaaaagtaattaaaagaatgcaaataaacatttagtgccaattaaagaaaaagaaatacaacattagacaaaataaaagatattcatttgatgcaatgaggaaataatcttttattcctctttaaattctctgtggaataaggcatggttataaataaataaacatctgccccatggacttaatggatcgttatattttattgcgataatcataatgaaattgttgggagggattagtatctctagtgtaatgctaagaaagataaagcctgtgcccaggcaaaagctttcttggttggtcaaaaggtttgaagacatttcaaactattctaaaacaaacaaacaagcaaacaaacaaaaaacatacaatgtctttgccacatatttaggaaacaaaatgaacaatttatttctgacaacctcatagtctttgttctgtcagaacaataatggaaaggtctaaaccagaaaatgctatgcattgaatttataataaactattttttcctgtaacaaaaaattgataaacttgatatttgcagatttaatgattatgtgtttaaaaaaaatctggtttttgcccttgcaaaaaatcatatatatacacatagatatgtatgtgtgtgtgtgcatagtatatatatatgtatatacatatatatacacacatttatatatataaacatttcctttaacctcctattttattccaataaaaatattggtattagagatagttctgatatttcatcatgaatagttaacattgcatttggaaaggattaatttttttgaaacgtaattttaccttaataagtagcccagcgtaatattttagtaattacacagatttttttttcaagacatttgacaactaatattgcataatagttaagagtgtgggctttggagccagacttcctatctctgttcattcactgataaaatggagacagtagtaacttcctcaaagagttgttttttaagatcaaataatgcatataaaactcttgaaatggtaccaaatacagagtaagcaccaaataaacattaactgttattgttattccatgtccgaataacacagaaaagtaagaattttaatatttcatttgaatgaccttttaaggatacacctagcccattatctttcttgataatcttgtaagatgattccttttttatctccgatctgttgaggcatggatagaggttttcagagaaaacattttctaggtaactgaaagaaagtagcaacaacaaactgtgacaaaacttaacaatgagagaatttacaagatagaataattgcaactccttttgaaatcaaccactatggtcctctggctgggatagctaagcaaagatattccagcctgaaggttgagatctacttgaagagttttctatccagattgtgagggcccctcaaacttcacttagtatctgtttctattagtatggaaacttctggaaccttgtggtatcacattcacttgactactttattcctgctctagctatcttaaagcctttcttaatcttttatcttttagagaagatacttctaggttttaaatccaccgatcttgaagctattgccttcactctctgcttcagagcccatccttttgtatatgagtagtttgttttgcctaaagtactttctcccagtcagattttaagtccagtttctcatctgtttttgagagcaaactcctgggccttggctcactaacatcttgacagcatatttcttctttcctatgggcttttcagcattccctgggtttttctaaaatatgaaagcagactctttatctcttactttgtcaaagcctaccctccccactgatttctcacccagttgctagttttaagacctgcctctggccgggcgcagtggctcacgcctgtaatcccagcactttgggaggccaaggtaggtggatcacgaggtcaggagatcgagaccatcctggctaacacagtgaaaccctgtctctactaaaattacaaaaaaattagccaggcgtggtggtgagcgcctgtagtcccagctactcgggaggctgaagcaggagaatggcgtgatcccgtgaggcagagcttgcagtgagctgagatcgcgccactgcactccagcctgggcgacagagcgagactctgtctcaaaaaaaaaaaaaaaaaaaaaaaaaaaaagacctgcctccaaatatcattgtatttgcaaacatgaaatgacttattgattctgagctcagcacaagagcaaacctttctcagcttgacccatcttcacatcgttaatgtcttattcagtcactacccaaggggctgaccttcaagattctaatccatgaaagcttaaaatagtaaacaaatttgaatatagtttaacatacataataaattttatttctagaagaggaggatcagcccttagacatgaaaagtaaaaatagtttattcccagatttccctttgtgcattagtatattcaaccgagtctatccaagtaacaggacaaaaaaagctggcagttgttgctgcgctgtgaagtcttattaggtgagtcagctaattatatggcactaccataaatacagcaggcactgccctgcttgttaggcttgccaaggaaaataaggatttaaagcagcatactacctctttgctatataatgacattttcttcttaaaaatgattttgcaccaattcctgatttatccaccaattattttttaatttatggttgaatgtatttaaacctgaattcagagataaaactagtaaatagctccccaaaataaccccaaatatatttaatatattagctttactctctcctccactgccaaacctttaaaaactgaaataaattgtttttatttcatcttttctctttttctctctctctaaggtgattgccaagactaaagaaacagctagaagggcaaaagacaagaaaatcagtaagatagtaacagattatccaaagtagagcacggctcaggtgcagtggctcatgcctgtaatcccagcactttcggaggctgacgcaggaggatcacttgagtccaggagtttgagaccagcctgggcaacataatgaaacttcatctctataaaaaaaaaaaatttaaatagccgagcatggtggtgtaagcctatagtcccagctatttgggaggctgaggctggaggatcacttgggcccaggagttggagactacagtgagctatgattgtatcactgcattacagcctgggcaatagggcaagaccctgcctctaaacaaaagataaacaaagtagagcataaatggcttctaaatatatgttatttatgtgtaagactgggttctctaaaggtatcatttaattaaaatagatttgcattctcaatctgtaggtatggattatgtataatgtatttaagatatgacttacagcgttcaccaatgtgactattcccaagtgatccagatggctgatgacatagtaatttgtacatttgctgagacctgatctgagtaggtatgtaacataactgagggagagcaagtccatttgccgaaagaaagcctagcatatgacccaggagccacatcttcactcagccttgttgctaggtttggcttagcatatataatagcatagcatgtataatttatgacaaaaaattatactttgcactttttaattagaacattcaaaatgatctcaggaagtggcaccagagatcatcagtggtctactgtacttcgtgtgtatgtgtctgtgagtatgtatgtgtttgtgtgtgttcccacattctaaggcatgtcttttacaggttagtagaaaatgttgatagaaaattatagatttcaacatctaaaacacagtaggtcactacattgttaaaacttggaattttttatcttgttgtaaagtcaggccaaccaaacctaaaatactgctacattgaaatagtgcaaaatattcaaaatactatagttatagatttggtagtaggactgtaccagacctgtcactctatacaagacttatgccttgccctttcacttacctgttcccttttacatctatcttactagatgtaatgctataaattatatttctaatatattataatttatcatgtattataatgtatcaaatattacaaattatgttgcaactccccttacctttcgtctgcatattgcctcagaaagaacagatggatccaacagacttcaaccacaggcccttagtgacaaatagctcttaatgctgggcttgccactttgatgcatttctaaagttatagaatgttaaatgcaccaagtcctttggtcattttatttctaccttagatctaagccataactatactttcccaaaaattaaagtttgaattttaacttaaccatatataattggaaaaggaggttgggttcgttaagtgtaattttatcatgctttattatcctttgggcattggatacagcagaacatgccaatttctatggcttctcatgtgacagaatatacttactaggatgcaattaaatactcctcagagtatgtaaacaataaatgtaatcattacattatttttatattgttctttcttatgcataatagtaagactgaaaatatagtgttatttctgaaatatgcatattgttttgcttttgatgattaaataacattgtccaaagttttaggttttttgaaatcttatattttttaacaaaatatctagcctttccaaaacaagacctcaataattcgtttaagacccagagttgttcctctccacatagatctcttaaaaaggcagaggatttatgacctcaagagaaatcagagtatccaaagtttgctttaattcaatgttttaaaaataaaattccttagattttatcaaaaattgagattagtttgattttgaatcagatgccctttgctccccaccccaaaatggcattatgagcagactaggaattgataatagaaaattgaacatatgaaatatatctttaccttgctttttaacaaggtattcatgtctatcgccttcatttttaagtgcatcaataaaatacatggtaattctcttagtgaaatatactatctacactatgtacacactcccctgtctgaggtagagaagtagagaatattcacatttttgaaacgtctatgctatttttatttaaatacgagttctgggcttgatttcattttggaacacgggtgtgtgcttaagttgaacctttttttcctcttaagtcaaagttcttttttagtttcttcttttatctttttggctactatctctctccttcatcctcctggtgtgagttgttgagtgaaggtattaattccattatttgaggctaagtgacattgttcaataatgcagcaaaacaatggttctacccaaaatatcttcaagtgtaaaagcagtgggcaaaagagaaagtgcgcttctgctgctttgaatgtttaaggctgtgaaagttgatcacacaaattgggtcattcttgttatacccaactaaaacaatcaagaagcctgggaggaaaagcattcaagaaacatcacattgctccaaaagtgtaattttctacaagtccgcatgctgaggctgcctgttgtaacctgggaccaattttttctgtaactgctgaaaaaacttgctgcagctctaggactaattttgcccaccactgtcactcaccaattgaagcttactagctccccagaacctttctagtgccaatgaactttctcaaagagcagcgtgtatcatttctctttttcagaacacctccaacctcctctttgttctttgggtataccaaagaccaaccagccttgaatttcaatttttcttcccacataaaagttttaatttagaaatgtatctctacatttctaactttgacaaagcatagataccagataattgatgaaaccttgctattttaacgatcaccatggattacttcccagtgtcttcagataaccctcaacatttgccaacatttgatggacttcaaaatgagcatatcttttttaaaaaaaattattcacactgacagcaagtacattggtatactctatattaaattataccacagggtttacaaacaattggtgatgtcgggcagtggtttccaaggaacatacttaacaagacactcacaaggccctacaaacctgcatttttaacaagggccctagatgattctagaagagtgtggtttggaaagcaatttttgcctttattatgtgtcattttaaatatatttaaaattaaagttataagtcatagaattgaataaagataatttccttacagaaagtattactaggtatctaaatacaatatggttcaaaacaggaaatttaaaaagattatgtaaattctgtagttgtattcctaaagacagtagctgaaattttttcctacttctccttgtatcacttcccttttccttcactttcacttccctggaattgtacttcccaataagctattagcagtgaaggaagcttcgtctcatgatctgttttatagagcacttcagctgggacgagtacgaaatgataatcagttatatcagctattcaaccctacaggtttatttaaaaagaacttgaataagctttttagggagaaagaggtcagtctcagccatttctgtttcctaatatagcttttaagtctttccttattagcaatgagggtcattccattgtaattttttgataaccatttttctttctgtgtgtcaaatgcagatataagatactgaactgagtctatttcactgttcgtaaaacaatcccatttgaaaaaaaaaagtctacagctattccagggatagggcctagtagagagagaataaaaggtattttcttactatgtctctatatcctaccctgtaggttctcttattaagcatacaggcatataccaaaatccagacgtttttctcatttattttattgccctaacatattctgggttaatataatatcataatgaaaatttgagaaaaaattgattttttcaaaagtgtttaacatttgttatattggtagttttttttcttgtttgtggtaaaaataaatagaaggtgcacttcacaccttcaagtatgattatattttgaaaacaagtcatgaatactcataaaatgcaaattttaatgttctttttttgttacagccaaactatattaggcacagttgtaaattggagttgaaatttaatatttctttatagataacaatgtttttagaaataggtttatgaaacagtaaatatacaggtatagggataaaattgtgtctgatggtcatatgaagtgtttgttgttatattctccttggaatagctgccaaatattttagtatgcttaaaatctacgaatgtgatagagtcaacaaatttagatcacatattcagaaaaacatagttagagaactaactattgaaatgagcatacagcagtcttcctttatctacagggatacattctgaaacccccactaggacacctgaaattgcggatagtagcaaaccctacatatactgttttttccaatgcttatgtacctatgaaaaagtttaatttataaactaggcacagtaagagattaacaacaataactaataacaaaagagaacaattataataatatactgtaataaaagttatgtgggtatggtctcgctttctctttccctctctctctgtctctaaatatcttagtattttggggttgcaattggtggtgggcaactgaaaccatggaaaacaaaaccacggataaaaggagactactgtatatactttttaaaactgatgaaatattaaactcatgtttcttctatatcccacccatttcccccacccaaacctagatagatatcttatttgatctgtaaacatttaattaatttgtaaaagttaagaactttttgaagtaaaactgcaatatatcatcacacctaaagaaataaacaataattcttaaatatcaagtcagtgttcaaatttccccaactacctcatatgtgttttccatttgcttatgtagggttcccaatgagaatgaaataaagttcttaggttgcaattggctaatgctctctcacttctactttaagcggcaggttcccactaacttctttttagttgcaatttacttattgaaattagacgtattctttgtcttgtgtagtttctcacagtgcaaaatttgctgattgtagccactgttgtaagcaatgaacatgtttttcaccaccttatatttgctgtaagttgtcagtgatagttaaatgttaatcaaattcaaattcggatcacgtagggcttttctttttttgttttctttttctatttatatatttatttatttattttgagacggagtctcactccgtcaccaggctggagtgcaatggtgtgatctgggctcactgcaatctccacctcccgggttcaagtgattcccctggctcagtctcccgagtagctgggactataggagaaccaccacgcccggctaactttttgtattttagtagagatggggtttcaccatgttggccaggatgctatagatctcctgacctcaccgatcatgtaggacttcaattgtcgaacaaacgaacctttaatagcagttacaccattaggatgacctgatccaacatcgaggtcgtaaaccctattgtcgatttggactctagaataggattgtgctgtcatccctagtgtagcttgttcccacttgatgaagttattggatcagtgaacaatagcccacttaaactagtacagtcttagtttaagatggtgatgtgtatgtacttccatcagagggcacataatacagtaaatcctcacttaacttcatcaatagtttctggaaactgtgacttgaagcaaaacaacatataacaaaaccagttttaccattggctaattgatataagcaagaattaagtcctatggcaaatttctggacacaaaaacaccatcaaactcctaaataaagataaatcacttctgacattaaacattgaaattaatgtgagctatatatacgtttaagaaagattaatacaaacaagtcaaataacttacctaattatttcggtggaggccgcaggtggttggagcctatcctggcagctcagggagcaatatgggaacccaccccggacaggacgctgttccattactgcagggtgctcttgtacacacccactcacccaggctggaaccatgcagacacacacactcacctaacctacacatctgtgtacatccttcaaagttcagccaaataacatataaacaaatccagtaatatccatcagtcttagttccgtcataacaactcctttttgatcatcaaacaacaaacagggtaggtctgccatatttacttgtctggtccatatcaaaattttctaacaaattatattagaaaatcaaatctctgtcagtttcaaaatcatggaaaaaaatttgccttatttcccttatacttggatatcctaacagtaatctaaatattaatgagaaagttaatgatgtcgtttccttctccctgttgtaaagaaggttttgctgtcccgtttgatcactaagactaattgacactcagaaaaagcataggaaacttctcagcatcacaaaagctctgtcatctagagaagctaggacttgagctcaagtcctgtgacatggaaggccttgtgcctagccatcctgcagcagaggcgtatctaccaagaagtgaaacactacgaaaacagtatgtttactccacattttaaagtgaggtagtttggggtggttcatattttatttaatttatatattatttggattttttttagtttataaaaagggcattggcaagggcagaatgatctgtaagcttctctgcccacctaccataagcatgatctttagtgtgaccttttcttactgttagccattttcttatacttctgcgtccctgtcagtcacttccatgtgaagacatggggaagcttttttacatcagacatgttgttgaaaatcagccgcgttggctgagggattatttgatctctttctccaagtccctttaggctcacattgcctctctgttctttgaattttcacttacctttatcttcttataattactttgctgaaataaatgcaaagcaacaaaaggtatttagtgaagaataccaacaaagccatgaccatttcaggctgagttttgtagtattctttgtctaggaagagatacctagaaaaattttctgaccatgtatttgattattttccttcaatatgtatagtctcagtcttcaaatttcagaaaagaatttgtttcttcattgtcatttaaaattaatgtgttaaatatgtatgcttttacattataagtggttataaaagttaaacacttagaaaaaaagtcaaaataacatacatactatccaacaaaataactttcatattttattgtgttttcttccaaactttttacctttgcgtctgaattctgtgtaggttgtatctataatatagacaacactttatagcctgctaaatattataccataaataggtagttgttacataattctcaggtaatagtaatacaggtctttatcataatctactgagtagttgaatgataattttttttaagacaaggtctccctctgtcacccaggctagaatgcagtggcatgcacatggctcactgtagcctctacctcccaggctcaagtgatcctcctgcctcagcctcccaagtggctgggactgtaggcatgtgccaccatgcccagctatttatttgtatttttagtagagatggggtttcattgtaacagcccaggctggtcttgaactcctggactcaaatgatccacctgcctcagcctcccaaagtgctgaaatcacaggagtgaaccactgcacccagcaataattttttaactcttcattattcattgaacatttagttaacaattctaaaaattttgtttcctgctgtcattgatcttgtgaaaaatatctttggactatagctgtggattatttcctaaatagtaaattacttgagcaaaaagtttacatactttgagggttgataacccatgttgccgcaatgtttccccggaggcattgtggagtttagaatgccagtagtaatattaaggtgtgccattttcaagatccgtggccaacatccctatatgtaagatttttccaaaacatggttctgatttttaaaagtgaaaaatgctacttcatcatgttctttttgtgcttcttactttaaatattagaatgaagaaggagccccacaggaaggaattctggaagatatgcctgtggatcctgacaatgaggcttatgaaatgccttctgaggtaggagtccaagctgaatctttctaacaagacagtaccaaaaacctgtcattgtcacatttctctttcattagtgcttagtgagaatcatttgctctctacatgctcattacgtggacaacttgcaagttaagaatagtttttacatttttaaagggtccttaaaaaaaaagaggaggaggaagatgaagaagaggaagaaaggatgtaaaagaaatcatatgtagtccacatagcttaatatacttactacttgaccctttacaggaaaagtttactaacccctgcattagagaatatatttttagaaactttacattctaaaataaatttctaaatggaaagttagggaaatcaatggaatgccaaaggaaggttattattttttgccatacatgtccaatgggatgacgcatagtaaaataaaagttacccacacaagttatagaataaaaagataaatgcatgatttgcgacaattgatatattccagtataatgttttaaacaacacaatatgattgttaattttattttgattgaaaatgaaagtatctttaatagaaaatgtatcaaaagggaaattagaaaatactgttagatgaataaaactggcccaagaagaaacagtaaatctgaatagatttgtaacacagcgaatagattaaattagtaataaaaaaaaaaacctacctgcaaagaaaatcccaggccgagatggcatcactggtaaattctaccaaacatttaaagaggaattaatactaattagttaacaccaattaatatctcttacaaaacagaagaggagacatttcccaactaattttgtgagaccaatattaccctgataatcaaaaccaaatgaagatatcacaagaaaagaaactatataatggctccattaaaaattgagttcaagtatgttgtagtttggttatgtattattcctcacggcattattaaaaggcatgtcgaggatgggcacagcagttcacacctgtaatcccgcactttgtgagccaaagtggccaggttacttgaggccaggagttcgagaccagtctggccaacatggtgaaaccccatctctactaaaaatacaaaaattagccgggcatggtggtacacgcctatggttccagctacttgggaggctgaggcatgagagtcacttgaacccaggaggcagaggttgcagtgagctgagatggcacccctgcactccaatcttggtaacagagcaagactgtctcacacagacacacgaaaggcatattgataataattcaacttatagaaattgagattaaattgtttgtttgcctaataagaatttccaatattttggggtcttttatgcaagacacagtactaaacacaatggaaaactatagagtaattgacattaccaggacataaggagtttacagtctggtaggtttgatgaaaaaaaatagaaattcattcattcatttcttcattatgattcctttaacaaacataattgattgtcttcgatgtaccaggcatcacaggagcaaaaatatataagacatactaaaaagtaaaacattttaaagatctgtttcaatcaatcaggagaagttttattgaggaggtaatgttgatctgggtgggaaaaggtaagagatatagtaggtcaaaacaaacagaggacattctggcacaagggaatatcagaagcaaaggcatgtatgtctgagcatgcaaatggatatgtctgagaacagtgaataattatgactcaagcttaggaacaaggaaaatggtgatagattgaatttgcagctatgggtcaaagacaagttatagagtattaggataatcttgtcatttcagcttgtattctattcagaaaacaacttgagttattgaagttatgcttatttgtttgtttttaagcagaatcctgatattattagagttgctctttaggaggaataatctgatccctttaattaaatccattaatatttgtgttgtggatgctatccagatactgtatggagagcttgaggtttgaaatacaagtaataattgaagccatagatgaagacgaaattttcaactgggagagtgaaagtagggaaaatgtatcttgccttcaaacatcttaatttccttctgagaattagagcatcttagtctggaaaaggctttatagacagcttgattttgttctcacattttacaggtgaagaaactgagaaccagacagtccaacttatttgtcctaccaaactaggtatatgatcattaaatggtgcatccggatcagaacctagatattttaactctgactactactgtaattcacttttatatcagacaagaaagacacaactattaaaaataagataatatttgctgcagaatatttgcaaaaacattgattgtaaattttagtgtaagtggggagccatttcctatctcattggctgtcagtgctgatgcgtaattgaaacttatactaacagtgtgtgctgtctttttgatttttctaatattaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaatattttatttttatcccatctcactttaataataaaaatcatgcttataagcaacatgaattaagaactgacacaaaggacaaaaatataaagttattaatagccatttgaagaaggaggaattttagaagaggtagagaaaatggaacattaaccctacactcggaattccctgaagcaacactgccagaagtgtgttttggtatgcactggttccttaagtggctgtgattaattattgaaagtggggtgttgaagaccccaactactattgtagagtggtctatttctcccttcaatcctgtcaatgtttgctttacgtattttggggaactgttgtttgatgtgtatgtgtttataattgttatacatttttaattgagccttttattaacatatattgttatttttgtctcgaaataattttttagttaaaatctattttgtctgatattggtgtgaatgctgtacctttctgacaataaataatattcgaccatgaataaaaaaaaaaaaaaagtgggttcccgggaactaagcagtgtagaagatgattttgactacaccctccttagagagccataagacacattagcacatattagcacattcaaggctctgagagaatgtggttaactttgtttaactcagcattcctcactttttttttttaatcatcagaaattctctctctctctctctttttctctcgctctcttttttttttttttttttttttacaggaaatgcctttaaacatcgttggaactaccagagtcaccttaaaggagatcaattctctagactgataaaaatttcatggcctcctttaaatgttgccaaatatatgaattctaggatttttccttaggaaaggtttttctctttcagggaagatctattaactccccatgggtgctgaaaataaacttgatggtgaaaaactctgtataaattaatttaaaaattatttggtttctctttttaattattctggggcatagtcatttctaaaagtcactagtagaaagtataatttcaagacagaatattctagacatgctagcagtttatatgtattcatgagtaatgtgatatatattgggcgctggtgaggaaggaaggaggaatgagtgactataaggatggttaccatagaaacttccttttttacctaattgaagagagactactacagagtgctaagctgcatgtgtcatcttacactagagagaaatggtaagtttcttgttttatttaagttatgtttaagcaaggaaaggatttgttattgaacagtatatttcaggaaggttagaaagtggcggttaggatatattttaaatctacctaaagcagcatattttaaaaatttaaaagtattggtattaaattaagaaatagaggacagaactagactgatagcagtgacctagaacaatttgagattaggaaagttgtgaccatgaatttaaggatttatgtggatacaaattctcctttaaagtgtttcttcccttaatatttatctgacggtaatttttgagcagtgaattactttatatatcttaatagtttatttgggaccaaacacttaaacaaaaagttctttaagtcatataagccttttcaggaagcttgtctcatattcactcccgagacattcacctgccaagtggcctgaggatcaatccagtcctaggtttattttgcagacttacattctcccaagttattcagcctcatatgactccacggtcggctttaccaaaacagttcagagtgcactttggcacacaattgggaacagaacaatctaatgtgtggtttggtattccaagtggggtctttttcagaatctctgcactagtgtgagatgcaaacatgtttcctcatctttctggcttatccagtatgtagctatttgtgacataataaatatatacatatatgaaaatatgtatttggtttctgcctccagttcttacaaagagctcctaaaacccttgtaatttcctgagtagtaggggtgctagggtcatcttttgttctaatatttggtctttgactctgctttctgacagagctccttagtccctgggtgagagtagcatcttctcttctaatgaagtgactcttgctgggttcctggatgggggctggtcaccaga

SEQ ID NO: 14829 - DNA, 113876 bp, Human; identical to SEQ ID NO: 14828

SEQ ID NO: 14830 - DNA, 9192 bp, Human
tttctccagcgccaaactccagtctacaggccgcccagtagtagacatcaaatacctgttaaatagcccttacatctccagcccaacggcaaatatctaacctctcttaaacaccacagcccttcccttccccttctccccaccccccatcccaaaacctggcccaggctctgaataccctggatccacttggcttcctctgcagtcagtacctatggggaatgggaatctcttcagggggttctggtccttagagaagggattttgtgtggctgaaaagctggcatcctggggttctggtcccgtcaatgacaacatcgccagactggagacctcagttacttcctctgaaaatgcagtgatttccaggggtcctatttaagctctaaaaattccacaagagctttagataaggaaatagcaacgcaggggtgtgttcttttgccagttctgccacaggcctgcccagtctctaaagacaagacatccaaatcccccaatagaactagttgtcttgtccataaagtgagactaatattgtgggcgctacttatctacttagcaccttggactggtgaggactgtggtgcacaagctaccttacaaatgtaccacactgagtaacatctttaaacctccttgcagctccagggctagccttctcctttgcggagccctcccccacctccggcctcctagagcttcaggccatgttcccctgtcccctgtgaatctcagcatgctacctgaagcatttcacctgaaaaggccacacagggaggaggcgaagcgcagcaggaatgaaatagtcaactgctgtggagttggaaatgttgctgcatcccaccattgactggatggggcctcactcccccaatacaaattattttacgtttgcttctcccaagatcatgtgtaaggccgggcgcggtagctcatgcctgtaatcccagcactttgggaggccgaggcgggtggatcatgaggtcaggaatttgagaccagactgaccaacatggtgaaaccctgtctctactgaaaatacaaaaattagccgggcgttgtggcgggcgcctgtaatcccagctactcaggaggttgaggcaggagaatgaggcaggagaatcacttgaacccaggaggtggaggttgcagtgagccaagatcgtgccattgcactccagcccgggtaacagagggagactctgtcgcaaaaaaaaaaaaaaaaaaaaaaaaatcatgtgtagaagtaaataacacctcttcccagcacctgtggatccatggcattcacacaggtaggcactgacgctgaaatggcctcagatgctaccaattctttctgccgaggcctaaatccaataaacagagatggatggaaacaactatctaataaaagtttcgcatttgtgtgcctggcaacattaagtaaccgtcaggctttcctttagaaattggaattaaatgcgatttagaaactattaacgactttgggcgtatttaataacacatgaaataacccggaggattgaaatgttaggtgaggcgactccggctcatagacgcgcctctccatctggggcgtctggcacttagtggaaccactcaataaacacgtttacccctgcaagcggcacatcagagtccgggggtaattctcggtgtcgtggggccaggacggcgaggggctggaagaggccgccctgtgggagctgggaggctgagataaattcccgtgattgggggctgaaatggcctcccatgccggactgccgtggttctagaactttttcctggaacaggccggcactcccactggagagtcccagctgctgcgcctctggccgcccctcccctctcccgggcacctggcgccggctcccgcgtcctttcaggaattcacgtccgcctggaatttgcacttcaagtctggagcccccaaggaacccctcctgaccctgaacttctatctcagtttcaagcttcctagtcttccccccacacacacacctagctcctcaggcggagagcacccctttcttggccacccgggtatcccccagggggagtacggggctcaaaacacccttctggaaaaacaaaggtggaagcaaatttcaggaagtaaaacttcctgaaataaaataaaatatcgaatgccttgagacccatacattttcaggttttcctaattaaagcaattactttccaccacccctccaacctggaatcaccaacttgattagagaaactgatttttcttttttctttttttttcccaaaagagtacctctgatcattttagcctgcaactaatgatagagatattagggctagttaaccacagttttacaagactcctcttcccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacgccttgctcctgcttctgctacgaccttctggggaaaacgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggcccgcttctcttacaggtatgagctaatcttgaatgtgaactttttttgattgctagagattgccagcttaggaagtaatgttctacacctgtcatttgatttttctcttgctcaagccttaaaagagctgccaaccgcactgctgtttttcctgaaagacctggaatttcacatggttacttctaactttgccattggcttttaacattttcgtgttaatgttaattttcattttatgttaatgactctgcctatgaaatagtgtttctttattcttgtacaaataaaggtcagtactacaaccaaatttaaaatcttccgaaaagattaaaggtataagcagattcaatacttggcaaaactattaagataatagcaaaaaaaaaaaaaaaacccacattttttacctaaaaaccttttaagtgattggttaaaatagtttggccgggtgcggtggctcacgcctgtaatcctagcactttgggaggcagaggcgggtggatcacctgaggtcaggagaccagcctggccaacatggcaaaaccccgtctctattaaaaatacaaaaattagccaagcatggtggcgggcacctgtaatcccagctactctggaggctgaggcaggagaattgcttgaactggggaggggaggcagtgagccgagatcgcaccattgcactccagcctgggtgaaaaaccgaaactccctctcaaaaataaataaataaatacagtagtttgtaaaatgattcatcggtaacatgggatgcagctattttttaatccttatatgaaaattgtatgcaggggaaaacatgtgaaatagaagataaaagacatatacctacttaaaattaggtacttatgtgaggacagggcctaagaaataataatatatattaaaaagacttggatattggtgactttttttcaacatttttctttgttacatgaattagccattaaaaaaagaaagatggtgctctacaatttcttttcagtgatctgtggtcttgtccttgtgatgagaggacctgggtgttaacttgtaaggttttatttcctttgtttggctaactcatgtctgacttcctcttcctagtgtgatttggatcatggccatttctaaagcctttgaactgggattagttgccggtgagagaccttttgttcttttgatcactctcaatttttatgtggcctaaaatacagactccatgaattgattttgtcgttaagggctgggccatcaggaatttgctcgtccatctcggggatacctggccttcagagatgacagcatttggccccaggaggagcctgcaattcggcctcggtcttcccagcgtgtgccgcccatggggatacagcacagtaagaactgcctgacttcgatgcttctgccctggcccttcatgtgtctcctgagtatctttccaacactctttcacctaaaagggcacctggttctggaactgtgcaggtgctggactgcttttggttttggaagtgagacaaggattgtgtattttacttccctagagtgcagttttcctcccctgagtccacttcacactggggaacccagaaccaccactggcctatgcatgaaaatgacttctctgctcaaaggcacagagtcttactctgatacaacacattggtgttgtattaaccttcgcttacaggaattgcccttgcacttttccatccctacaccctcagtcatctgttcttacctttcaggtaaggagctaaacagaacctgctgcctgaatgggggaacctgcatgctggggtccttttgtgcctgccctccctccttctacggacggaactgtgagcacgatgtgcgcaaagagtaagcaattcagaggggcggggagccgtggagaggagagagaaagggaagtggaaatttcagacccaaggctatcgccttacctgttcattctcaggaactgtgggtctgtgccccatgacacctggctgcccaagaagtgttccctgtgtaaatgctggcacggtcagctccgctgctttcctcaggcatttctacccggctgtggtaagcggaggttctcctctttcttttgccctttgaagttacgtagttgccttggggggtgcttagttagcaggctctccttgtacctcttgtcttgctagagcctggcagccaaagttctgcttataaaagcatcgcagactcctgatgagatagttgccttggcctctttgatatttatttcctcgggaacctggctagtcctgctgcctttcagatagagatgtatttcaagtctatttgacattttatggtctgaacttctattgaggaaaataaacaagtctcggtctcttgttaaaccaagagatgttctctggtgttcctttcctttgggtagggggacccaaaccaggatgggcagctcatttagagcccaccctgacgacaaattctatcagaggcttggccccttgctagtcctttagaaacttccagagtcctaaaagtccctggtaaccccctccccataccttaccatgactggtcacagaacccttaccatgactggtcacagaaccctttcaccttcttgatttttactgatttgaggaatacaatgaaaagaagggcagcacctggagaggaaaagaggcgacagtcctctctccaccctagcctgagccaggtttctagggccccccaaattcagagacctattatagttctgggccttggagatgttagaaatggaaaatattcaagtccaggaagtaaatgaaagcaaacatttcactgagaacaggaaggaattccccaatccagacagggattgtgtctttgccatttgcatcctgggtgtcaggctcaggataggtgtttgataagtgtgggttgggtgattggatgtgtagggaacatgttctcttcctggaacatggggcccaatcagaatctaaccaggttgtgctcattcctgcaagtgaaggcatcaccactgggctaggttccaggtgtgagtgtcctgagaagagcaggttcacagtagcgtatagatatgccacatttgtgggcagcaggatgaactgccagagaggtttgctttaatgaccaagcatccctaccttccagatggccttgtgatggatgagcacctcgtggcttccaggactccagaactaccaccgtctgcacgtactaccacttttatgctagttggcatctgcctttctatacaaagctactattaatcgacattgacctatttccagaaatacaattttagatatcatgcaaatttcatgaccagtaaaggctgctgctacaatgtcctaactgaaagatgatcatttgtagttgccttaaaataatgaatacatttccaaaatggtctctaacatttccttacagaactacttcttacttctttgccctgccctctcccaaaaaactacttcttttttcaaaagaaagtcagccatatctccattgtgcctaagtccagtgtttctttttttttttttttttgagacggagtctcactctgtcacccaggctggactgcaatgacgcgatcttggttcactgcaacctccgcatccggggttcaagccattctcctgcctcagcctcccaagtaactgggattacaggcatgtgtcaccatgcccagctaatttttttgtatttttagtagagatgggggtttcaccatattggccagtctggtctcgaactcctgaccttgtgatccactcgcctcagcctctcgaagtgctgagattacacacgtgagcaactgtgcaaggcctggtgtttcttgatacatgtaattctaccaaggtcttcttaatatgttcttttaaatgattgaattatatgttcagattattggagactaattctaatgtggaccttagaatacagttttgagtagagttgatcaaaatcaattaaaatagtctctttaaaaggaaagaaaacatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatataagacaagaactcccctttttttcccaaaggcattataaaaagaatgaagcctccttagaaaaaaaattatacctcaatgtccccaacaagattgcttaataaattgtgtttcctccaagctattcaattcttttaactgttgtagaagacaaaatgttcacaatatatttagttgtaaaccaagtgatcaaactacatattgtaaagcccatttttaaaatacattgtatatatgtgtatgcacagtaaaaatggaaactatattgacctaaatgtgaactggttatttctaggtggtgaggtgctttatggtggtgggtttttgctcttgatgccctttttgcattttccaaagtaccatggtgaggatgtgttatatcttttccagggtcctaaaagtccctggcaactccctccccataccctaccatgactggtcacagaaccctttcaccttattgatttgtactgatttcatatggaatatggcaactacatctggctcaaaacaaaggaaaccagaagagccaagtcccaggtgagtgctcagttctgtttctagctttgacgtgtgtgttcttctgtgaaggacaaaatttgcttctattatttaggtaccataatttgtgtttttccaaattaattccctgcagatgcaaactgccaaataggtgacattttttacaatgcccaatggaaagaaagtaaaatggaataagcaggaagcagtgaggtgtaccagaaagcacaaaatcaggaggtagacaggctgaatttggaaggtggtctggccacttactgacagtgggacccagcttcctaatctgaatctggattagtgcctacatcacagtattagaactaagtgacataaaatagttaaatagttaaaacatttatacaaaatagattctcaataaatgtcacattttcttctctttttacctgcatatttaccgcagagggtttaaaaacatttttggggccagaaatagaatttatttttttctgagacagggtttcatgcttccgccaggctggactgcagtggtgcattcagagcagtcttgactgcagccttgactgcctgagctcaagcactcctgccacctcagtctcccaagtagctgggaccacaggagcacaccaccacacccagctaattttgcttattttttacagagatgggttcttgatttaagccacgtcatctgtgcttatgcttttctttatatcaacttatttttattgtggtaaaatatacataacatttaccattttaatcatttgtaagttcagtagcatttaagtacatttgcattgttgtgcaacagtcaccaccatctatttccaaaactttttcatcatcccaagctgaaactctacctattaaacattaactacccctttgcccttccccaggccctcggtaaccacacttactttgtctctgaatttgactgttctggatacctccagtagggggagttatacgctatttgtctttttgtgtcacatcgtgtcttcaaggttcatccatgttgtagcatgtgtcaaacttttttttttttttttttgagacagggtctcgctctgtcgcccaggctggagtgcagtggcgccatctctgctcactgcaagctccgcctcccgggttcacgccattctcctgcctcagcctcccaagtagctgggactacaggcgcccgccaccatgcccggctaactttttggggttttgttgttgttgctgttgttgttttagtagagacgggatttcaccgtgttggctaggatggtctcgatctcctgaccttgtgatccgcccacctcggcctcccaaagtgctgggattacaggcgtgagccaccatgcccagccaatgggtgctgttttaaaggcctgacatcagagaatggtttacttatcagagctcagcctccaccatggaatattacatcacctttaaaaaatcatctttagaaaggatttttaatgctctggagaaatacttaagatactatgtcaggtgttaaagggagaagacagtatggtctcaactagaattcttaaaaggtaagaaacataaaaacattaaagcggtcagttctgaataggataattatgggtaatttaacaaaaaattttttaaacaacaatagcatgttaaataaaagaaaattagaggccaggcatggtggctcacgcctgtaatcccagcactttgggaaaaggccgaggtggatggatcacttgaggtcaggagttttgaga

SEQ ID NO: 14831 - DNA, 64137 bp, Human
  misc_feature (1)...(64137): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgatcgattgattcgtagttcccccccgcgcgcctttgccctttgtgctgtaatcgagctcccgccatcccaggtgcttctccgttcctctaaacgccagcgtctggacgtgagcgcaggtcgccggtttgtgccttcggtccccgcttcgccccctgccgtcccctccttatcacggtcccgctcgcggcctcgccgccccgctgtctccgccgcccgccatggcgactgcgacccccgtgccgccgcggatgggcagccgcgctggcggccccaccacgccgctgagccccacgcgcctgtcgcggctccaggagaaggaggagctgcgcgagctcaatgaccggctggcggtgtacatcgacaaggtgcgcagcctggagacggagaacagcgcgctgcagctgcaggtgacggagcgcgaggaggtgcgcggccgtgagctcaccggcctcaaggcgctctacgagaccgagctggccgacgcgcgacgcgcgctcgacgacacggcccgcgagcgcgccaagctgcagatcgagctgggcaagtgcaaggcggaacacgaccagctgctcctcaagtgagtgctagctggcggccgcgttagcgccaaggaggggcgggggcgcaaccgcggcgaccagctcaccgggttctgccgtggggagggagcagaggccaggatgcacgcgtccttctgaaggaacagggtctcggtctccggaaaggagaaagaatctagagttcatagcggagcaggggtcgcggagggggctcgagctgtagcgctggggggccgtgatgcccatttctagattttggatacccgctgggacgtggtaagtgcgcgcctgggactgccgagaaggagctcccgctttcgcactcgaatccggggagccggcgcggagaggcggcccctcaggccccaggtgcggggagctggagcgcgagcgcgcgctcgcgtgcgcgccccagtttccggccggcgcgagacaaagcgtctagcggatttgcagtgccgggatgggcggccggggaggactggcagcccgcctctagaatgaatgagcttcgcgcgggcagagagaggaaggggagggaccttcccgcagcatccgcgtctcctgggggtgggtcccgctttggcgcgctcagtcttggccctgtgacgttttgcgaagattctacgcctgctttaggcgggagagagaggcggagcttgatccgtgcgcctccagccagccccgggcaagttaggtttgctagctggttagctttctctggggaaatgtgtcctgtcccagcgggactggtgcggtccctcgggtggttctgcgcagggaaggaaagctgggtttgtgcatgtcacggctaccgttcttagaattgcggttctcctacccctcaggcagcggccctctgtccccagcttttgcctcctcgtagtatagtcaggctttcgggtagagactgtgcttagtaccccttagtcgaccactgtgcagatagtagaccagggcaggtgacagggtgctgtgtaaatgctgagtgtttgagcgaaggagagtttgtaattcacctaagcgagtgcgagttttcattccagtgcacaaggatacatttgcagacctttgctggccttattttgactttctgataagcaaaatggcctgtcatcagtaggcaacaagtgttgatgtcatgctttagagatttgcaaaatttgggtctgaaattcatggtcgccattagcactgccagctgaaatttctggaggtaccttattctcactttgacaccctttgcccctggatgtctttctgtctgtatctgcgtgaatgtccctgtccgaagtctctgagattttgtgtatttttacttatccctcctatcatatgttttcggttcataaaaaagcatgtgcacgtggtaagaataaaatagtatagactggtttgtagcgaaaaacgataactgcactacctctttccggaggcaatcacatttatccctttttgtttttatttctttggatatttagttatacaactcgaaaataatactaagcttgtatttccctttcttggatttactaagccttggtttcatcttttaaaatgagcagtcagttaactcacactattatttctatgttcctccaaattttttgccactgaattccttcaaatcttagatatcgttgcttgtaagacttgccattattatgtgtaccactaagaaaataaaaacatcaggaccaactgtgtaggatccatcctgttggacccatcatgatgggtttcatagatattaaaatgtcaaacagggccgggcgtggtggctcacgcctgtaatcccagcgctttgggaggcgaggtgagcggatcacttgaggtcaggagttcgagaccagcctgaccaatatggtgaaaccccgtctctactaaaaatacaaaaattggccggacgcgggggctcacgcctgtaatcccagcactttgggaggccgaggcgggcggatcacgaggtcaggagatcgaggccatcctggctaacaaggtgaaaccccgtctctactaaaaatacaaaaaattatccagacgtggtggcatgcatctgtagtctcagctacttgggaggctgaggcaggagaatcgcttgaacccaggaggcggatattgcagtgagctgagattgcgccattgcaccccagcctggcgacagagtgagaccccatctcaaaaaagaaaaaaaatccgggcgtggtggcgggcgtctgtaatcccagctactggggaggctgaggcaggagaatcgcttgatatccaggaggcagaggctgcagtgagccagatggtccactgcactccagcctgggtgacagagtgagactccgtctaaaaaaaaaaattaacacagatcaaatatctgttgcgtaccagtcaccgttctatgttagaggatatgaagatttttttaaaaaaatgaattactgttctttgttgctgagagtgtagtgggggagctatatcccagcaagtaaagaaagattgtcttttgtctgatgtgaagcattttgatgctggcgcttttgtaatctttccaggagttagccacaggaggtttttcacacagtaacaaggctgccacctggctgacagtagttgtaaatgtatcgattctaaaatgcatgctggtttcagcggggttaaaaaatgagaataatgtgtattagaatcaatgaaataatgcatgtgatacaatttaggtaatagcagatgctaagggaataaaaataaagcggagtgaagggttagtgtgattaaggaaggcctgtctgaggagttgacagtacctattctctgagggttagtagtgttctgggattatatttttcttaagtctgtgctactgtatgtatattcctattgccaggattagatgactcttcttttccccccaacataccatcatttgctcaaaacatgccacattttagtttgctccttatttgaattaggactttttttatatggatttattcctcaatagcttttcatttttcttgttaagaaaaatttgccctcagtgtgtttgcagactttttgaagatatttaatcataatatctatcacatgaatctgctttcttccctagagttctctttgcttaaggtaggctgtgtactgatgtcctgtaacttattaaagacagcttcctggccaggcacggtggctcacacctgtaaagcactttgagaggcctaggcaggtggatcacctgaagtcaggagttcaagactagcctgtccaacatggcgagaccccgtctctactaaaaatacacaaattagccgcgtgtggtagtggacgcctgcaatcccagttactgtggaggctgaggcaggaggcattgcttgaaccggggaggcggaggttgcagtgagctgagatcacaccaccgcactccatcctgggtgtattttccttttccttggtttcttcatattttgttgaagaacatccttaagtaatttattcagaaaggatggcaggaggtaaactttctgagtcctgtatgtctgaaaatagctttgggctaggtatagaatactaggttaacatttttccagaacttggaaagtattattttgccctattgtcttctggcatctagggttgttaatgtctttcttttttttttgagacggagcttggctcactgcaacctccgcctcccaggttcaagcgatgctcttgacccagcctcccaagtagctgggattacaggtgtgcaccaccacacccggctaattttgtatttttagtagagacggggtttcaccgtgttggccaggctggtctccaactcctgacctcaggtgatccacccacctcggcctcccaaggtgctgggattataggcgtgagccaccatgcctggcctatatttaattttttatttggaactagagtgtttgtaattaagtataatcatcatttaggtagatttagattaagaaaacagctttgagagaattatagattccaggttacttagtttctttttggttcctcagcaaacaagataccttagaggcagagcatggaaatgcttggtctaaagagaatttggcaacagtttccatgcaggtggtgtctgaatccatagaaaacagacctcatatgtaaggtacagttactttgattcagtccaagactgattatattttgctgaaagcttttttgagagaacagtttccaaaaatgatgatgaatgccatcactcaacactttaaacaaaaagtacagagaaattgacttgtttcagattttcactgttaactatacgggaaaactagatataacagaaagttaagtgtttacatcagtcttcaataactgattttgtggattcagacatttattttccttcagtgatacaggtcccgtatcttttctgtaaaaccctgggggcccgatgtgctttggaagttaaagcaattccaatttaagacggtaatatgatgcacatactggatatgacacccccagtggggtttatagatagagttagggtagatagagttagcactctatcatgaaacatttctgagggaaagatattgtcatggcaagtggagaaagacagattgaaaatagacctggtttcaggtcaggttttgccactaaatgtgttaataaaaattttaggttttcaaactctggaagtatagataaaagatggtgaatttttgtttttatttatttattttttgacacagagtctcgctcttttgcccaggctggagtgcagtgacacaatctcagctcactgcaacctctgcctcctgggttcaagcaattcttctgcctcagcctcccaagtagctgggattacaggcacccgccaccacgcccaggtaatttttatatttttagtagagaccaggtttcaccatgttggccaggatggtcttgatctcttgacctcgtgatctgcccgcctctgcctcccaaagtgctgggattaccaggcgtggccactgtccccagcttatttccttttcatggtaaataattttagtttgttgggttttgtttgttttgttttgtttttgagacagctctgttgcccaggctggagtgcagtggcgtgatcttggctcactgcaaccttggcttctttgggttcaagcgattctcctgcctcagcctcccaagtcgcagggattacaggtgcccaccaccatgcctggctaattttgtatttttagtagagacagggtttcactatgatgggcaggctggtctcgaactcccaacctcaggtgatgcgcctgcctcagcctcccaaagtgttgggattacaggcgtgagccaccgggcccagcctggttttttattaattacaggttattcacggccattctctctaaagtcaattaattagttgtagaaagcttnnnnnnnnnnnnnnnnnnnntagtagagaccaggtttcaccatgttggccaggatggtcttgatctcttgacctcgtgatctgcccgcctctgcctcccaaagtgctgggattacaggcgtgacactgtgcctggtcaaaaacatgctaatcttctttaggagtgttttctttgtacataggatgattaattgaaaaacaaaaacctttggctgggcgtggtggctcacgcctgtaatcctagcactttgggaggctgaggtgggagggtcatgaggtcaggagttcgagaccagcctgaccaacactgtgaaaccccatctccataaaaatacaaaaatcagccgggcgtggtggtgcacgcctgtaatcccagctactttgggaggctgaggcaggagaatctctcgaacccagcaggtggaggttgtagtgagccaagatcgtaccactgcactccagcttgggcgacagagcgagactctgtctcaaaaacaaaaacaaacaaacaaaaaaaccacaaaaaacaaaccttcatcatcctgtgtattactatatctttttttaatgtactgattttgccctatttgaagcagattgacagtatacatcttggccttaatataagagttatcaaacttttatatttttataactcttaaaatataagagttataaaactagttttctttataagagttataaaactagttaaactgcttttcatagttcttttataacagagttatgttaaatgttactttaattttcaagggaagacttggaaggaccaaacccctaaaaatgatttaaaagtctaggaagcaggtcccaagtaattaaactgtcatgacatttccttcccatgctttcaaaagatgtttgataaagcaagatcttttggagttgtttatttaacttaggggatgagactaggtaatattttgcatacccagattcaaggaagtaaacaggcagaatgaaagataaagcactattaaaatatggtgggtcttttcttttttgtgtctttacacagttgctggttatatttattctttcgtttgtatagatggtgtcacctctgatatgtctgagttagaaatcttcagactttttttttatgccattagtgtaagtctctttcatgtacaaatgttgagaatgagcctcaggtatcagttgagtaatgggaccctgtataggtcccattatttttaggatcagggaagtttttaaaatcagttttaaaccctttttacagtgtacctctttgataaggagattgtgctttggctgtcatttgatttttttttttttttttttttttttttgagacagagttttgctctcgttgcccaggctggagtacagtggtgcgatctcagctcactgcaacctccgcctcccgggttcaagcaattctcctgcctcagcctcccaagtagctgggattacaggcatgcgccactacacccggctgattttgtattttttttttaatagacttggggtttttccatgttggtcaggctggtctggaattcccaaccttggatgatccgcccgccttggcctcccaaagtgcggggattacaggcgtgagccaccgcacctggccggctgtcatttgaatttttattattttattttattttatttttttgaggcagggtctcgctgtgtcgcccaggctggagtgcagtggtgcgatctcggctcactgcaacctccgcccctccaggtttaagcaattctctgcctcagcctccggagtagctgggattacaggcacgtgccaccacgcccggctaattttttgtatttttagtagagatggggtttcaccatcttgcccaggctggtcttgagctcctgacctcgtgatccacccgcctcggcctcccaaagtgctgggattacaggcgtgagccaccgtgcctggcttgaatttttttttttttttgagacggagttttgctctgtcgcccaggctggagtgcagtggcgccatctcggctcactgcaagctccacctcccgggttcacgccattctcctgcctcactcagcctcctgagtaactggaactacaggcgccctccaccacgccgggctaatttttttttatatttttagtagaggctgggtttcaccgtgttagccgggatgggctcgatctcctgacctcgtgatccgcccgcctcagcctcccaaagtgctgggattacaggcgtaagccactgccctccgcccgaatttttaaaaattaattttattattattatttttgagacggagtcttgctgtgtcaccaggctggagtgcagtggcacaaccttggctcactgcaatctctgcctcccgggttcaagtgattctgccgcctcagcctcccaaatatctgggattacaggcacccgccaccatgcccggctaattttttttttttttaatttctagtagaaacggggtttcaccatgtcggccaggatcatctcgatctcctgacctcgtgatccgcccgccttggcctcccaaagtgctgggattacaggtgtgagccacggtgccctgcctaaaaattaattttttttttttttaataactgagtcttgctctgtcgccaggctggagtgcagtggcacgatctcagctcactacagcctctgcctcccgtgttcaagcaattctcctgcctcagcctcctgattagctgggactacaggcacacgccaccacgtcggctaattttttttttctttttctttttctttttttttttttgtattttagtagagacgaggtttcaccaggttgcccaggcttgtcttgaactcctgagctcaggcaatatctgcctgcctcagcctcccaaagtgctaggattacaggtgtgagccacggtgccaggccaaaaattaaattttttaaacagcaaatgtatattcattatagaaaaggagaaaacacaaacaccaagaagaaaattcttggttgggccttaggttgggcccaacccttaggttgggaccagcggctcatgcctgcaatcccagcacttttggaggccgaggtgggcggatcacctgaggtcagcagttcgagaccagcctggccaacatggcaaaaccctgtatctactaaaaatacaaaaattagccgggcatggtggtgggcacctgtaattctagctacttaggaggctgaggcaggagaactgcttgaacctgggaggcagaggttgcagtgagccgagatcgtgccactgcactccagcctgagtgacaaagcaagactccctttggggggtgggggaaaagatgcaggaaaaaaaaaagctgacatttattttgtgccaattctgtttgccaggcattacagtagatgctttacagacattatcttttttttttttttttttttgatgcagagtctggctctgtcgcccaggctggagtcctggagtgcagtggcacgatctcggttcactgcaggctccatctcttgagttcacgccattctcctgcctcagcctcccaagtagctgggactacaggtgcccgccactacgcccggctaattttttgtattttttagtagagacggggtttcactgttagccaggatggtctcgatctcctgacctcgtgatcctcctgccttggcctcccagagtgctgggattacaggcgtgagccaccgttcccggccagacattatcttttaagctcatgataactgctgatgagtaaggaaacttcaggctcagagagtttaagtattttgcctggtattacttagcaagtaatgaaagctagaaaggatggtagcctgacttctagcattgtgatagggtgttcacatacataaccttatttcatccatacaacagtgttctacaggtattactctggtttaccgacatgtagcaggctcacagagcatcattatctgtggttggtacttgaagtctcagataggatagttgattttcagatccctttgggtgctacttttggaaatgctactagttgcatgtttttcacgttgatagtttgtagccttcaagggaggtaattttggatttgtcagaagggtagtggtcagtagttgaaacagctgtttgaaatactgagggcttcatttgctaaagaaaggtgaagatgaattactgaaagagatcgcttttatcttttttctcttcttaaaaagctactttccaactttattccatgccttaataatttaaaagaaattaaaacctctaaataaatctttaatactcatgacagggtgttctttcattctttattcaagacacatttttgtggaacaggtactatatgccaggtcttgaaccagatgctgggaatagagaaatgggatactcagtccccattatcaagttacttacagtctagtggggaagacagaaaaccaacactacaggattgtgatactgtaagtgcagtatactaataaaatatattaagtgctgtgatgccagtatccaggtgttgctgtggagaaacaaggaccgctacctaaggcaggctaggagccgtgtgaaattttgaaagacatcccaggggaatctgagctaagtgcagggaggtaagtagggatttgcttctaaatggaaaatggagagtgagttgtcctgaatgtcaaataatttatataactggagccatatatatgtgtatgtgtgtgtatatatacatcttatatgtatatgttatatataacatatactttatgtatatgttacttatatatgaagtatatgttatatataacgtgtgtgtgtgggggtatatatatatatatatatatattttttttttttttttttgagatagagtttcactcctgttgttgcccaggctggagtgcaatggtgtggtctcggctcactgcaagctccacctcctgggttcaaatgattcttctgcctcagcgtcccaagtagctgggattacagccgcctgccaccacactcggctaatttttgaatttttagtagagacagggtttcagtatgtttgccaggctggtcatgaactcctgacctcaggtgatccacccacctcggcctcccaaagtgctgggattacaggtgtgagccactgcacctggcctactggagccatatatatatttaatacatggggtggggaaggggattgtatttttagtaatgagtggacccaagattttaaggcagaattgtgacatgatcattctggctatgctgtggagggaaaaaaagaggagaggtacaaacactagtaagaacacttggggagtaacaaggcagcccttgaactgaggcaggtggaagaaaggagagaaggtggatttaagagatactgaacataaaggactagggagaagaaagagtctagggtgactgcttccatgcttgggtgcctgagtagacaatattgctcttaaccgaaattggtggggaatgaacaggtttggaggaccctaagtcagtgaattagtggtgtttgccggactttaggtagcaatgttagttggcaatttgaagtactcaagagacatggaaagcatgcgcatatgaggactgggtagagaaaggagaacccacaatggggatgataagtaatagagaggtgaggctgggcgtggtggctcatgtctgtaatcccagcactttgggaggctgagtgtgtggatcacttgaggccaggagtttgagaccagcctgggcaacatggcgaaaccccgtttctactaaaaatgcaaaaattagccaggcgtggttgcacatgcctttaatctcaactactgtggaggctgaggcaggagaatcacttgaacctgggaggcggaggttgtagtgggcggaggttgcagtgagctgagattgcgcctctgcactccagcctgtgtgacagagggacacttcgtcctaaaaggtgagaaaagagaggtgagtcatggaacaagggttttttgtttgatgaagcctaaaaagtatctgttgtcattggtgtttttggtgccttaggtgattgttgactgagaggagagcctttggttaatagaggaaaccactggccataattaaggggagaatgagaggaaaaagattatgagtttagaatacttgtttaagaatgttggcagtgaagggaaggagacaagtttttttttgttttttttgttttttttttttgagacaaggtcttgttctcttgccggtgctggattgcagtggtgcatggttcactataacctggacctcccaggctcaagtgatcctcccacctcagcctctggagtagctgggactacaggcacacaccaccacgactggctaattttttgtggggagagggttttgccatgtttcccaggctggtcttgaactttgagctcaagcaatccgcctgcctcggcctctcaaagtgttgggattacaggtgtgagccactgtgtctggcgggagggaggcattcttaagggtcaatttaaactagattcttactcagtgtttatgtaacaaaacattggacaggggaccagaacccttatctctctaaggttgtgtcctaaaatgtgatcatttcaccccttttggtataaaacattttagtagcttctagggtaaagactaagaccctactaatagtagggtgaccatataatttggcatccaaattgggatacttttgtgtatgaaagagggagctgttaataattatgcagtgacagctcgcataaatggaacttgtccttggcaatctgggacatatttgcccaggttatcctacctaaaagttctttccctacatgggctggtcccagtctgaccctccagcttcatctcataccacagttgaacttgtttactcctctttagccatgaaatcctttattcagtcccgtttactgtgatcctcttaaaatagggactttgcatttggagtttcctttgaattttttttttgaggacgagacttgctgtgtcttcttggctggagtgcagtggtgtgaccttggctcactgcaacctctgccttccagtttcaagtgattctcctgcctcagcctcctgagtagctgggactacaggcgcctaccaacgagcccgactaattttttgtatttttagtagagatggggtttcaccgtgttggccaggttggtctcgatctcctgacctcatgatccacctgcctcggcctcccaaagtgctgggattacaggcgtgagccactgtgcccggcctaattttacatttttaatagagatgaggtttcttcatgttaggctggtcttgaactcccgacctcagatgatccgcccacctcagccttccaaagtgctgagattacagacatgagccactgagcccggccttattttattttatttttgagacagtcttgctctgttgcccagactggagagtagtgagtggtatgatctctgctcagtataacctccacctcccacgttcaagtgattcttgtgcttcagcctctccagtagcggggattacaggcgtgcaccaccaagccctgtgaatttttgtatttttagtagagaaggggttttgccatgttggccaggctggtctcgaactcctgacctcaggtgatctgcctgcctcggcctcccaaagtgctgggattacagatgtaagccaccacatctggtctgctgtgttatttttaatttgtgcagaatgcaggagttgtcagaagcaacatatgttatagcagaaatacttacatagtccccagcagaactcagtaatatactgtgattagttttttttgcctatcacaccttttgatcacctataaaaatagtactttttcccacttacttttttgtataattatatagagtctatgccagttgttagaacatcaaatcatttaggatcatttttaaattaattttacctcattaaataaagaattacctttgggtaccttgtgtttttctacagtctagttgtattgtataagcattgatagtttgggtatagaattctaggttgtaaatgctattttcttagacttttgaaggcatgttttggccgaggtgggtggatcacctgaggtcaggagttcgcaaccagcctggccaacatttgtactctactaaaagtacaaaaaattagccggtgtggtggtgggtgcctgtaatcccagctactcaggaggccgaggcaagggaattgcttgaacccgggaggtggaggttgcaatgagcccaggtcgcgccattgcactccagcctgagcgacaagagcgaaactctgtctcaataaataaataaataaacaaataaacaaataaataaataaaatgaagacgtgttctttagttttctagctttcattggctgcagaagtaatgatgagtgaaaaatttaaaagcttgtaggatcttcttttgatccagttctaaaatttcacagggatgttccttgttgtagatctcttttcatccattgtgttcatcatctgattgaattcttttggtcttgaaatttatgtccttcagttgttggaaattttcttgagattttctcctcttttattaccatatgagactcctagtattcaaatgttggatctcttacattgatcctttggttttcttcccttttttaaaaaatattttttctctactaagagatgttctcaattttgttttccaatttttgctattgtattttaaatttctaatagcttctttttattctgtctcttttttttaaagatagggtcttacccttgcccaggctggagtgcagtggcatgatcttggctcactacagcctcaacctcctaggctcaagtgatcctctcaccttagcctctggagtagttgggactactactggagtagttgggtgtgtgccactacacctagctaatttcttgatttttttcatagagacagggtcttactatgttgctggtctcaaactcctgagctcaagtggtccttctgcctcagcctcccaaagtgttgggattacaggtgtgaaccatcatgcctagccttttttattcccttgatgtctctttttttgtttttgagacagggtcttgctctgttgcccaggctggagtgcagtggtgcgatcttggctcactgcaacctctgcctccgtgttcaagtgattctcatgccccagcctcccaagcagctgggattacaggtgcccaccatgacaccgggctgattttcgtatttttagtagagacggggtttcaccatgttggtcaggctggtctcgaactcctgacctcaagtgatccacctatcgctgccttccaaagtgctgggtttacaggtgtgagccactgtacccagcctattctcttcttgatagctctatagcattgtttttgtctaaatttgatggatttggttcctttttttttttttttttggagacagagtcttactctgtcacccagactggagtacagcggcatgatcccagctcactgcaacctccgccccctgtgtttaagtgattctcctgcctcagcctcccgagtaactgggattacagacacgtgccattacgcctggctaacttttgtatttttagtagagatgggattttgccatgttgaccaggctcgtcttaaactcctgacctcaggtgattcgcctgcctcccaaagtgctgggattataggcgtgagccactgtgcctggtgtgtttggtactttctcttatctttgcagaagtcttcattgtccttcatagtccctctttgctaagttaatttctttttctgtttaggtctttgtgtcatcactcagtgcagggaacagaaagcactagggattttttttttttttttttttttttttgagatagagtttcactcttgttgcccaggctggagtgcagtggcgcgatcgcggctcaccgcaacctccgcctcccaggttcaagcgtttctcctgcctcagcctccctagtagctgggattacaggcatgtgccaccacgcctggctaattttgtatttttagtagagacggggtttctccatgctggtcaggctggtctcaaactcccgacctcaggtgatccacccgcctcggcctcccaaagtgctgagattacaggcatgagccaccgcgcccggcagcactagggattttaagcagaaagggaaacaatatgagatgtaggtgcttagaaatgatttttagagaggctagaggagcaataatgatgcttagaacattgttgtagaactgaccttctttgggagcttttatgtgtgaggccaccaatggaaccagtaaactgttttaaaaacagtatatagctactattcaggactaggaagctgccactgctattgctttaggaatagctgcctcataacacccagcaaactggagaatggacattggaacactgtttcagaaatattttacacccaggtcagtgcctagcacattgtagatgagtgacaaaggtagtagttattggtttttctttttctttttaaatgaatcagtcatttaaattaagacttaatctgtacgagtctgctccatactcctgtgcctgtttatgttacagtgatttttttttttgtttcaaagaagtggttttgtggtccagtttcaatctcatttagtatttttcctaattttacccgagtttcaactagagtttgcctgagtctgattaggttgttgctaattctttgacagattagtttattcagtgagtagcagaattttattggcaccggaaactatcctttgtaactttgagtttatgcaaaagcatcttcttagtctttttgcatatgccagaggagacccttgttaatagaaattgtgatcacaaggccgggcatggtggctcacgcctgtaatcccagcactttgggaggccgaggcaggtggatctcctgaggtcaggggttcgagaccagcctggccaacatggtgaaaccccatctctactaaaaataccaaaaattagccgaatgtagtgtcgggcgcctgtaatcctagctactcaggaggctgagacaggagaatcacttaaacccggaaggcggaggttgcagttagctgagattgcgccattgcactctggcctgggcaacaagagtgaaactccatctccaaaaagaaagaaagaaagaaagaaagaaattgtgatcataagaccttctagagtttttgtgtaatttttttttttgagatggaatctcgctttgttgcccaggctggagtgcaatggagtgatcttgactcactgctacctccatctcctgggttcaagcgattctcctgcctcagcctcttgagtagctgggattacaggcatgagccaccacgcccagccaacttttgtatttttgtatttcaccatgttgaccagtctggtctctaactcctgacctcaggtgatctgcctgcctcggccccctatagtactgggattacaggagtgaaccaccgtgcctggccgagtttttgtgtattaagttatatttgttttaatttcggggaagttcattaattttcctttggaaaaatactgtggatcacatcctttttccctttggaagggaagttaacatgaggacagtgttgaagctgatgagtggctgttggagcaaatgcatgcttgataagcagtttgagcctgttacgaaataaaattatctagttttaggacaaggtttttatgtgggtatattttactttaaattgaaaataaggtttattttttctctaaaggtctggagcatggctagatataagagacatggcatgttgatgctgagctctgggtgtgaagagatccccagacacggatttgtgtgatagtcacttgagtactgcactagtgttgagtggtgttcaggggctaccagacagctgttcagaagaaccttacagtatatgaaagcaggaacagagcttagccagctaggcctaattggcctggctctgtatgtacagtgggtctgttttaagggatttaaaaatccttgttttgtggctttgattagaaataagaattttgtatagaatgatttctgttagctgattacaggtgaaaaactaaatggcttttctctttcatctcctgtaatatatttgtttttctaaataagaatgggcctgaggtgaaatgttagggataggtactgacacaaactgaccaagagaatgttaacaggtgggcaataatttgccgttaccaaattaattaaaactattttgtaatgagcttcagattatgttgtatttgtccctgcaagtttacttattgatttgtttcacactaattctttgttccctgtttaagtggacaatcttattttttcaagtgtttatggttggaatatgctaactaattccttttcctttttttttttttttaaataaggatcttgctctgttgcccagagcgacagtggctggagtgccgtggcatgaccacagctcactgcagccttaacctccctggcccaagcaatcctcccatctcagtctctctagtagctgggactacaggcacaggccactactcccagctaatttttgtattctttgtagaaatggggtttcaccatgttgcccagggtggtctcgaactcctgggctcaagcattctgcccattttggcctcccaaagtgctaggattacaggcatgaaccaccgggcctggcctcctaattcattttcaagtagttattgttattgcaggcctggaatgactttctgcatgttatgtatgtggtatgacttttggaagaatgtaccctaaagttatcacctagtaatgatatatttctctaagagttccattgagggttcattttccagcgattctgtgattggatgtggtttttttgtttgttcatttgtttgttttagatggagccttgctctgtcgcccaggctggagtgcaatggtgcgatcttggctcacagcaacctctgcccccccgggttcaagcgattctcctgcctcagcctcccgagtagctgggattacaggcatgcacaaccacacctggctaatttttttgtatttgttagttagacggggcttcaccatgttggatcaggctggtctcaaactcttgacctcatgatccgccttccttggcctcccaaagtgctgggattacaggcgtgagccactgcgcctggcccaggatgcttttttttttttttttttttttgagacggagtttcactcttgttgcccaggtgggagtgcaatggtgcgatcttggctcactgcaacctccgcctcccaggttcaagcaattctcctgcctcagcctcccaagtagctgagattacaggcatgcaccactacgcccggccaattttgtatttttagtagagacagggtttctctgtgttgaggctggtctcgagctcttgacctcaggtgatccgccagccttagcctcccaaagtgctgggattataggtgtgagctaccgtgcccggccctggatgcattttttaatctcctttttttgccttgccctgtcttcttatggtgctgactgatctctactttctgactggtaggactagtctggagtagggtacacctagacaaatgaaggacacccagggagtgagagagagtcatcctcacagaaggactagtgcagaggccaagcaaagttcagacactaagttccagaaccaagtagttcaatgcagaagccagggttggaaatgaccttaaaacaagtcaaggtcaaactggcggcatgttgaacaaccagcatgattaaagcagcagagtatatggtattgctggtggtagaaggtgcttaggagcattttagaaagtgttaaccaactggatttagattagttctataggcctcaggagaggataggcatgtgtcccagatacatggtactaggttttattgggaaagtacaaccatagtaaagctgtgtatgttagtcttaagtcactgctgtagaatgttagcaggaatataaatatatcctttctagctaattttctttttctttttcttttttctttcttttttttttttttttttttgagatagagcttcgctctttgacccagttggagtgcagtggcacgatctcagctcactgcaacctccacacccccagattcaagcgattctcctgcctcagcctcccgagtagctgggattataggcatggaccaccatgtccggctaatttttgtatttttagcagagatggggtttcgccatgttggccaggctggtcttgaactcctggcctcatatgatccacccgctgcagcctcccaaagtgctgggattacaagagtgagccactgcacccagcctggctaattttctttttaatggccagatacttgattacacctggttacttgttagaccaataaaattcaagcttacttgaaatgaaagctaatttggtttattaagggaggaaattcttaattagcatagaatgccagttacatttataaaactttatttttttctggttgcagttagagtttggttcttctgtaaaacatctaaagcaaatgggtatgttttgtgacttattttcaggagcgtgtatatttctagtattagattcacatgttgaatttaacataggaagatctccttatctggaatagaaatagtttaatcaggcaggtggataacacaacaaatccagtcaggaaatggactcaaagtaaatgtatactaatatcttaagtgttagatagcttctagtaatttaggattcctatctaaattgctctgtgtttggaggcattgtcagatgtcattctgtgcttaggtgatagctgcagcaagtccatgtatgtatgttttaggatatcagttctacaggtttctgcactttgactatgtgctgataattacacttggactttctacattatattgatgaatgaaaaataatatggttagaaaattatgacaagaatatgttcagaatattaactcactgcatggctccccatgtatccttgacaactcatgtgacatagaagactcattgatttggctgagtgcagtggctcatgctggtaatcgcagcacttcgggaggctgaggcggacaggtcacttgagcccaggagtttgaaaccagccggggcaacataggaaaaccctgtcttcccatctgccccagcaaaatacagaaattagccgggcgtagtggcacatgtgtatactcccagcttcttgggggactgagatgggaggattgtttgaacccaggaggtgtaagttacagtcagccatgatcgtggaggattgcttgaacccaggaggtagaggttgcagtgagccgtgattgtgccactgcactccagtctgggcaacagagcgagaccgtctcaaaacaaacaaacaaacaaacaaacaaacaaacaagctgggcgcggtggctcaccgagcctgtaatcccagcactttgggaggccaaggcggttggatcacgaggtcagtagttgaccatcctggccaacacggtgaaaccccgtctctactaaaaatacaaaaaaattagctgggcatggtggcgggtgcctgtagtcccagttactcgggaggctgaggcaggtgaatggcgtgaacccaggaggcggagcttgcagtgagccgagatcgcgctactgcactccagcctgggccacagagcgagactctgtctcaaaacaaacaaacaaacaaaaaaactccaactcattgatttattgctattgtctgatggagacatgggtgtaaccttaagaattttttttcatgattcattcagcctgggaaattggtaggaagaaagagaggatacccatgcatgtgagttttagagattatagaagcatcagttattatttttttcttcttggaagagacatgatattttacataggatgaaaaaagagaagttgtgtgtgtctgtgtgtgtgattttttttccttcctggaaaacacatgatacattttacataggatgaaaaaagagaagtgtgtgtgtgtgtgtgtgtgtgcgtgtgcttgtaacatttagcaaaatagtcattatctgagttttctgtgcagaagatgtaggaataataagtcatgggccttgccctcaaagggtttacagtctcttgaggtagctaagcatatccacaaatacagggatttgtatgatcaatgcactgtaagtgctgtatatgcaagaggaagagatagtagtcagttcttctctctttattagccacttcatgatgcattgactttttttttttttttttgagacggagtctcgtgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgatctcctgacctcgtgatccgcctgcctcccaaactgctgggattacaggcgtgagccaccgcgcccggccgcgatgcattgactttttcactgttaatattgtggcctaaggaggaagaggaaaaatatatgaacacagaacaatttgtttgtggagttaaagggctcacaaggtaaggacagctgtaagaactgtctgccctgagctcccagtgcaggtagccccacaagtcccttttcatcattttacttcagcatctgcaagataagtctttatgctacctagacagctacacacctaagtgtggtgacatggcctagtgcctgaccctgagcagtaaaggtactgagggtccagaagaaggaagggaatactaaaaacgcacttagttgggaccctgtcttatttatttatctttctcttcctggtagtacatagtagatactcagtaatgtctgctggattaggtaaatatgtctcaaaactagggacctggactgagcctttccgcaccgtctcgaaactctcctgtgtacctgtgcataagagtgcatataaatgccactgtacatttgtgtgggttagaaaaagcaaaagtgtgttcataacctcttatgagaagagactataaattactttgcaccaagggcggtagctgactcttgagttctcttcagtgcctggtacaatgcctgctgcccacctgcttgtgaaggctgtggtggcttgtacaggcactgcagggcagatctagattgactatttgggtctcagaataacctgggtcctctgtaacagaggctgagtacttatcttttcatgagttgttatattaaagtaaaattgtaagcactgctttcctgtggcttgcttctttcattttttaacagaaattttattgagtatccccaccctataccagacattgccaggcactgaggatctgaaggtaatctcattttacccacattccagtgtaggagacagacatggaatcttaaattttaaaaagatgtatataccatgcaccatatgagaatgatgcaccaagtgctgtggagcccagaaaggtacatgatttttttctgctaggagaggtaaagcagggaagcattacagaggaaggatgacatttgttccatccttggtcttagtttccaatggcagttggttaggaattagatggagttaggaatgggaatagatggcatggagtgggggagagtgaagtccgaggctcagaaggtctttaggacttagacctgaagggctttctagggggactgccatgccaaggagcttgcatatttcttggtggtcagaagttttcaaactgttttgcagaaaactaggactgttgggatggggcttgatgggacactggaccctacactgtatcttctttttttttttttttttttttttttgagacggagtttcactcttgttgcccaggctggagtgcaatggcacaatcttggctcaccgcaacctctgcctcccgggttcaagcgattctcccgcctcagcctcctgagtagctgggattacaagcatgtgccatcacgcctggctaattttgtatttttagtagagactgggtttctccannnnnnnnnnnnnnnnnnnnctcccgcctcagcctcctggggaagtggggattacaagcatgtgccatcacgcctggctaattttgtatttttagtagcaccgccgcttctccatgttggtcaggctggtcttgacctcccaacctcaggtgatccgcttgcctcggcctcccaaagtgctgggattacaagtgtgagccattgcagccagactatatatatatatatatatatatatatatataatttttcttttttttttttggtggtagggtctcactctctcaccaaggctggagtgcagtggcacgatcagggctcactgcagcctcgacctcctgggatcaagtgattctcccgcctcagcccctctagtagctgggactacaggcatgtgccaccacgcctggctaattttttttatttttagtagagatggggtctcaccgtgttgcccaggctagtctcccttccaaagtgctgggattatagacgtgagccaccgcacttggccaagaagtaatttataacagaacaatttatattttcatagaacagtgttttatgtgactaagaacttgacataaaatgaacagtagaagcattagtcatgattgaaattaaagctcctataaaatttccactggtatcattgggtggccctcagggtaccacaagtaagtactctcttcatcccctgtcctccttatcttctttggtttttatttttatggaagaaatcaccatattctagtcatctggatgtactgccttgggttaatttttggcttcttgtgttttctacactccacaagatgttgaacacagtatctttcacttggtagtatgacatcttgagttttgagctatttgcatgtattacttattaaatctgtgaagtcaaataaacaagaacaatactgcataaaatatgccgattttacaggttgttccatacaataacttgtaaagttgacatgctgttttatgcagtatcattcttgctggaccattttggtccctggaaggcacaggtcattctcctgccatgaggcaggatcacattgagaagtaccacattatgacctgagctttaaaaattactgtttgtaattgttaagtaattaattttgagtcagtagcttttgtaagtattgtgtaatactgcatttaaaatatggttttattttcagtcatatgtcttatgacatgtatcctagcccttctggtagttttatagtggggcaaaatagagactccttcacaagtgtcagttcattcctgtggagacccagcacttgtgtgaactaggcattttggttgtaaattattacagtatgggattttttttaacagttaattttttcctcttctggactagtcttcagttaaagcctgccatcgtgtggtgttttaaagcatgagatttaagcatgtggcatgactgctgagcttttatgatgagtaaaaagtgaatactattaaatcttttcatatgtgatcaacatttggccagtttatttcttcactttattttaatattacaatattattttgaaatttttattaattaaagattcctcctttagccagtcctcaaacatcagtaagtaaaagtactcttttacttttttagtttatttttaagatcctgtttctccaagaaaaatacaatagcagttttaagaacaggtattaataattttgatgttattattattttttgagacggagtctcactctgtcacccaggctggagtgcagtggtatgatctcggctcactgcaacctctacctcccgggttcaggcaattctcctgcctcaccctcccaggtagctgggattacaggcacaccccaccatgccctgctaatttttgtattttttatagagacagggcttcattttggccaggcttgcctcaaactcctgacctcaggtgatccacttgcctcggcctcccaaaatgctgggattacaggcatggcccaccatgcccggcaataattttggtattattaaggcttctctgtgtaactactgttaataattatttggatgagagaaatactgacctttaaaatataattattgggcaaaatatatccaaatgaactataattttataatgtagaactccatttaaaaaaaagtggttatttagaggccgggtcagcagctcatgcctgtaatcccagcatcttgggaagctgaggctggcagatcacttgagccaggtgttcgagaccagcctggccaaaataggcaaaccctatctctactacaaatacaaaaaattatctcggcctagtaccgcatgcctgtaatcccagctacttgggaggctgaggcatgagaaccacttgaaaccaggaggcagaggttgcaatgagccgagatcgccccactgcgctccagcctaggtgatggtgagatgccatctcaaaaaaaaaaaaaagtgatatttagagaaaaagaaacttcagtttgaacctcagcttgttttttgtttttgttgtttttgagacggagtttcactcttgttgcccaggctggagtgcaatggcacaatctcggctcactgcaacctctgcctcctgggttcaagtgattctccttcctcagccccctgagtagctgggattacaggcatgcgcctccatgcctggataatttttttgtatttttagtagagacggggtttctccatgttggtcaggcaggtcttgaactcccaacatcaggtgatccgcccacctcagcctcccagagtgctgggattacaggcatgagccaccacgcccggcctgtttgtttgtttttttgatacaaggtctctctctgtcacccaggctggagtgcagtggtgcggtctcggctcactgcaacctccacctcctgagttcaagtgattctcctgcctgagcctctcgagtaggtgggactacaggcattgcgccaccatgcccagcttaagtttttgtattttttggtaaagacgaggttttaccatgttggcaaggctggtctcgaactcctgacctcaagtgatccgccagccttggccttccaaagtgctgggattacaggcatgagccaccgtgcccggccctgaacctcagttttttggtagttggttttataaactgaaataatttttatgcaaaatattagggaggccgttatttattgttacctctatgtaacaaaatgggaggtacttgcaagcttggggtcaattagttcttactaatatcaggggagtttcagtatcatgcattgggttataacattactttttaaaataaccttttcttctcatttagtgtaatttgattttctttttttttttgagactgggtcttggtctactgcccagctgcagtacagttgtgcagtcatggctcactgcagcctcaacctcctgggctcaagcgatgtccccgcctaagcctcccaagtagctgggactacaaatgtgtgccactgtgccaggctctttttttttttttttttttgtagatttggggtcttgctatgttgcctaggttggtcttgaattcctggtctcaagtgatcctcccacatcagcctctcaaagtgatgtgattacagacgtaagccactgcgctcagcatgatatcctgacttacagttcctgtatgttttggcttataatatgcattatatttaaaaaatgaattttcatttcttcaaaaatatcctgtgttagtgtgcctctttatagaacaagggggacatgcagtctcactcaaggacaagcaggattctggtacattggtctttaatatggacgtctttgacccatagttattagtaatcatgtgacattgaaagagaatgttagccaacaaaaactctagatccagtgcttgtgaattgcttctctaattttgataggtgatgggagcctttatttaaactacttcttttgtttgtcccttcagcagagagggagaagacctcaagtcatcagtatggtttgatgtcttatgctttttaaatctgttccagctatgctaagaaggaatctgatcttaatggcgcccagatcaagcttcgagaatatgaagcagcactgaattcgaaagatgcagctcttgctactgcacttggtgacaaaaaaagtttagagggagatttggaggatctgaaggatcagattgcccaggtaaggtcaagcctactcttgagccgtatgtgacaggttaattgcctcatctgccttaagccatagtttgattgattgattgattttcaaatgtattttatttttgaaattttatatatttgttttctgatggtttacttgaagaaaagtcttgaggtagctaacatgcaaaacattatcacctcccaggcattatatctggattggccagatcttgtggttcccttcttcttccctattgtgcacacactcattctgtctctgctctcaaagcctattttgttagttaggaaataagtaagaaaagagatgccaaaatgctgctctccacacaggaaaaaatgaaagtggttagctaaaataactagtttgatttttgaaatgtgagtgagtcatacgtctctgttctattccctgttgccaattaacaatttgactggtcgtttggtatgatactctgtgggtgggaccagcaaatgaatacccagttctgtgataaatgttaagatgaagtaattatacattgataaatatataggaattttaacacttgatttgatttgattcatagatatcttatgttcattattaaatgattgccatgtaatttttatcacaattctttttccttgtaatagttggaagcctccttagctgcagccaaaaaacagttagcagatgaaactttacttaaagtagatttggagaatcgttgtcagagccttactgaggacttggagtttcgcaaaagcatgtatgaagaggtaactatatataattttgctttgtaaaggaatggaggggttctagaatgactttgtcatagctaaacatgtaattatattttatttatgatttctttgccacaaaaatatatcagataaagaaataataaggtttggggatggggagaaattttgcaggtagattattcaagctactgctgctaaaagaccgcatttgagaactcaagctgttaccgtaaacagatatgatttcacttcatcttacttatttttgtttttttgtttttgtttttttgagacggagtcttgctctgccgccaggctggagtacagtggcacgatctcggctcctttcaacctctgcctcctgggttcaagcagttctcctgcctcagcctcccgagtagctggaactacaggcgtgcgccaccacgcccagctaatttttgtattcttagtagagacgggatttcaccatattggccagggtggtctcgatctcctgacctcgtgatccgcccaccttggcctcccaaagtgctgggattacaggtgtgagccaccacatccggcctcacttcatcttaacttataaaggcttggtcacagcagctaattactgtcaacatgtttaagcattagttatctattcctgcctaacaaattacttccaaagttcatcaacctaaaaccacagacttgtattaatttcttagttcctgaaggtcagaattcagagctgctaaactgggtggttctgtttcttggtcccatgaggttgcagtacagcttttaacctgggctggaggaatggcatctgagctctttcacagggctgtgggcaggacgtgtcagttcctcacctcatggtcttcttcatagggctgcttatgatatggcccccctaagggtcagtgatgagaaagagagagagagagagaaagaaacacaacgagaacatgaatacatgctaccagctaccaaggcagaagccagattgtcttctataacctaatcacagaggttacataccatcactttggccttctcctatggctcacatctggaaatgcggctactcacagcatttataggcgtgtaaatttttttttttttgagacacgagacccgctctgtcgcccaggctggaatgcagtggcatgatcttggctcactgcaacctctgcctcctgggttcaagctattctcctgccttagcccccctagtagctgggactacaggcgcatgcacccacgccctgctaattttttgtatttttaatagagacgaggttccaccgtgttagccaggatggtctcaatctcctgaccttgtgattggcccgcctcagcctcccaaagtgctgggattacaggcgtgagccaccgtgcccggctcactcatgtggaaatcttaaaatatcacttataagccttaactgctgtggtcaaggggcaggggcaaaaccgttgtcaaacaaaggaagtaataaaattgaggaaaggggaatgtatatttcatgaaaattgtagagggttgaaatcaactcatgggggagaacatgctgttaatgtgctaggcttaatgtttttagaagtagtgtaattttgaaaacagtgcaaataggaattcattgtagcagttagcaaaccagttttttagttggaggaaaaataatagaaatctgattattttttaaaattacaggctttaaacaaaatagatattagtgcaaggtgcaccagacaagcagtcagaccttggacaactcttagtgtcagtttcttatttaaaatgaaatactaatactgctatttttttcttcaatgagtggtaaggatcaaagtggaatactgtgtgtgaaaactctttggatactgtagcaagtgctgtcatataattgttactaagtgttgctttgttaaagcagatattttgatatgaggttgacttacatttttgttttgttttgtaaaaattgtgatttatcattacttatttctgatgttgtgtgtagacaaccaggagtagggttttttttctttgtaaggtcactggttctatataaaaaatagcatcagtaaaaagtaatttaatatttttagagtgcatagcatctttgaatttttggcttttgcctttttgagaatggatgttaagatagtcctcttcagttttgttttttttgtttttgttttttttaactctttttggagacagagtcctgctctctcgcccaggctggagtgcagtagtacgatcttggctcactgcaacctccacctcctgggttcaagcgattcttctgcttcagcctctggagtaactgggtctacaggcatgtgccaccatgcccggctaagttttgtatttttagtagagacagggtttcaccacattggccaggctggtctcgaactcctgaactcaagtgctccatctgcctcggcctcccaaagtgctgggattatagttgtgagccaccgcacctggccttttttactttaaaaaaaatttttttgtgtgagacagagtctcactctgttgcccaggctggtgtgcagtggtacggtcttggctcactgcaacctgtgcctcctggattcaaatgattcttgtgcctcagcctcacgagtagctgggattacaggttcacaccctcacaactggctaactttttttttttttccttactttttactaagtaataccatgttggccaggctggtctaaaactcctggcctcaggtgagccactcgcctcagcctcccaaagtgctgggattacaggtgtgagccactacgctggccttaactttttttttttacattcatgatatatattcagtaataatatctaacttccttattatgaacagttgggggaaaaaaggaaggagaaagacgaaagaggaaggaggaggtagacaaagaacaaaccattagcagtcactcttcagtatttttgtgatttaggtattatttgcttcatgaaatagatgtgatctctgggaaggtgatagcagaatcctcctgatttttctgatttttcagattttgtcaagtgcatgctcctgtgtagtagttaagagaaagatgaagaaatgcaaaggaaaatacatgcgctaatatacacaaacagcaactttggtgggttatacttccctcttgtggcttcttcagatattaccattctaattattatttttttttttttgagacggagtccagctcagctgcccaggctggaatgcagtggtgcgatcttggctcactgcaaccaccgtctcccaggttcaagtgattctcccatctcagcctcctgagtagctgggattacaggcaccctccatcatggctgactaatttttgtattttagtagagacagggttttaccatattggccaggctggtcttgaactcctcacctcaggtgatctgattgccttggcctcccaaagtgctaggattacaggcgtgagccaccgcgcccagccttccattctaattttatttagacacttccttaaaacagagtaaaggaaaggatcatgacaactacttctattcttcaatggtaaatttttcataaatatttgagttagtcaactaatattgttaataagatcctgtgtcacttgataatgatagcttaataccggcttttaaagaagtcttgtaaattagcttgtgctgcctattattatgtctaagaaaatggttttatggctgggcaaggtggttcacacctgtaatcccagcaacttgagtggctgaggcagatggatcacctgaggtcaggagtttgagaccagtctggccaacatggggaaatctcatctctactaaaaatacaaaaattagctgggcatggtggtatgtgcctgtaatcccagttactagggaggctgatgcaggagaattgcttgaacccgggaggcggaggttgtagtgagctgagatcataccattgcacaacagcctgggcgacagagtgatactctatctcagaaaagaaaagaaaagaaaagaaaatagtttcatttcacataaatctttacatgaatttatcacaactgttaagtttaactttccatgtgctgttttttcagagatgttcttaagattatcaatgaaacaattcagaaaaataatttttgcttagtgtttagtatagtatactgtgtataaatccttgattgcagatagttttagtaggccatccaggcctttccttggcttcagaaaaataaatagctatgctcctgaaaaggaatagaaagttcctaaggcttgagatgctaccacttctgtcattagttccatttcaaaaacctcaactgaaaactaagaggcaaaaaagtgtttattcacatgaccgcctgaggacaaacaggaggaagttcgtgtgtaaaacttcagatggctgtgatgtcactcagatgtgtaccaatgcagccatggtaagtagcttggctttatgctttttgttttttccccaggagattaacgagaccagaaggaagcatgaaacgcgcttggtagaggtggattctgggcgtcaaattgagtatgagtacaagctggcgcaagcccttcatgagatgagagagcaacatgatgcccaagtgaggctgtataaggaggagctggagcagacttaccatgccaaagtgagctctcttcagaagattcttttgaacacttaaaatcattacttcacaattcccatgatgaacatggctttatgtttattttgttctagtttttaaaaatgattcccctagtctccatgaaatatatagaaaattgattttttcaaaaaagtgcagttttctataaactaaatgttattaaaaattactagaagaatgtagggttgttgcaattttattagaggttaggttttgtctttttgtcccattgatcattcgtactatgccatagtagttgaacccaaaccatgtgaaataactttcttccaataacaagtactgatcatgctgtcctacataaacatccatttagtaatgaatgaatgtcagactgcattagatctcactttcatgtcatcattgtgcatagattgtgactaccacacttccggcttttttgcataagggccaaatggaaagtctctgctatttcttcttctgtcactattattcacttaaaaaaatattgtagaaacttcccacttatattagctgaccttacaagaattcataaaaatcaccaactagtacaggctttccctggtaaatgattttgccttgtgttttaaatgttacatgatttgattaaaaagacttttttgtggttgacttagaatattagagtcacagagttattgaaaattttcattgcatggctttaaactgttcatgttgctttttatctattgtatgaagtagcagttagtgaaagtgaaagatcttattataagcagtaacttcagttgtataacatttatctaatatcacacattgagctatacagtgaaggagctaaagtaaggatccgtcacagactgtggcctcacagggagccagggaggagacacaggagcatgtccctgagacacacatacacaatagtgttatgggatttgtattttactcaaggagttttttttgcttctgaaaggaagtgtttctatctggtttgaacgaatctataaactagtattttctgcttgttggtttacattctgtattggatttggtgggttagggatatgtgatgtttcttttcttacagacaccaccacagtcaagttgctattgcccagtcttcttattatcagtgttatcttagacattaaaggtttaatagatgaaatattgaagtaataagctttgggtaaaggcctaggtatattagcattcttaaagctcattatttaggaagtgactctaaaagtcacacagaattaccatcattcacaccatatcagcaaacttcatgatgcttttcctgtgtttcatctaccagttaccagcaggacttaggtttgaaatgccttgaggtgaatcatgcttccttttttgtttcagttctagataagactgactatgctttgcttcttcttttagcttgagaatgccagactgtcatcagagatgaatacttctactgtcaacagtgccagggaagaactgatggaaagccgcatgagaattgagagcctttcatcccagctttctaatctacagaaagaggtaaataatcatctttctgtaagaagttagacttgaaggctaccttcaccacgggcacctacctgctttgcttgggctgatgtcactcctccctctgtttgttacagaggatggtgtcatcctgtgctttcgtcttcacagtacttttctagattcgttcattttgcattgcataaacatcctgtgagcagatactattgttcctaattagtagattacacagagctaagggacttgcccttgaggaaggagcctgctagtttattcactgtacttaccctaggacccggatcttccgacctgtctaacagcttcatctctacagagttattctcaacaccttccttttttatatcatttgaaaaccaaaatgaagaaaaacatgcaaaaattctttgtgggtggtgaatgctttgtgtttctagacaaattctttagtgcttaaagtatataacaattaggatccaggaaagtagctttaatttgcatattccgataagaatttagtgactcattcattcgttggtacgcctaagtgacaaatggcattattgccggctgtgttgactggctgcctatcagggtgtgatggtgtgcttcaggtgctgcttaagcaggcatggacactacttcagatcagttttagcctagggtgatgtcagtgtggacacaaagtacatatactccatatactgcattcagaatgattcagcaattaactcgtcaccttaattattttggaaataacttccgcttctattttcctcaagggaggaaatcttgttttgaattttccacatgagaataaactttattttacttttttttttttttttttttttttctttttgagatggagtctcactctgtcgcccaggctggagtgcagtggtacgatctcggctcactgtgagctccgcctcccgggttcacgccattctcctgcctcagcctcccaagtagctgggactacaagtgcgtgccaccacgcccggctaatttttgtatttttagtagagacggggtttcaccgtgttagccaggatggtctcgatctcctgacctcatgatccacccgcctcggcttcccagagtgctgggattacaggcgtgagccaccgtgcccagcctattttactcttgattgggcttttcttccttcctttttctttttaccatttttagtaaaatatttttctaattataaaactgatgacctctgttgcaggaacttagaaataaagcagaaaatgagtcccataaaatggggtgatataaaataatttagttaacacaggggcttttacactgtctatcatgtgctttgttacttacggcacaaatttttaaattattttaaacctattttgtgctgatagtgttttgaagattttcatttaatagcagagctggaagcacctctgagttcattccatgtaaccacagatctaggtgagtttaatgatttgcccgttgcccagaggctgcagactgataaatgggtttctctactccttcccagtttttccttttataactcattttcttcaaagaagatttacttttagaaatttaacagataatctttttttccattgcaccatctgtcttagtccttttgggctgctataacaaactactattgacttggtagcttataaacaacagatatgtcagaaattatttctcacagttttggaggctgggaagtccaagatcaaggcactggcagattggatatctgcctggtgagggctgttccccgatttatagatggtgccttcttgctgtgtcctcacatggttaaagggtgaatgagcacccttggccctatattataagggcatgaatcccattcactagggctttcctctcatgatctaattaccactcaaaggccctacctcttaatatcatcaccttgagggttaggatttaaacatgaaatttgtgggaacacaaacacacagactgtatcactgtctttgtttttcttgttgtttttttttcttctgagacagaatttcgttcttgttgcccaggctgtagtgcaatggcgcaatctcggctcactgcaacctccgcctcccaggtttaagcaattcccctgccttagcttccctagtagctgggattaccggcatgcaccaccacaccctgctaattttgtatttttggtagagacagggtttctccatgttggtcaggccggtcttgaactcctgaccttaggtgatccgcccgcctcagcctcccaaagtgttgggattataggcgtgagccactgcacctggcctatatcaactgtcttaacaggtacttttccaaaaatgggcctctctgttcttgtactgagttggcatttactactcttttccatttactaatagtaagttgtctactagttactgtctatccctcaattttattttttcctactgtattattatttttttggctgctgcctaatccatttgatttacttagtacagatcttctcttgaggttgatcttcactgtgctttggatgaggagactgttattaataagtagtagtgggctctgaaacttagtagctatgtgttctaacctaggttcaaggctgtttccctgttaattgaattcccatttttgcaagttggtttttttttttttttgagacagaattttgcttttgttgcccaagctggagtgcaatggcactatctcagctcactgcaacttctgcttcccaggttcaagtgattctcctgcctcagcctcctgagtagctgggattacaggcacgcgctaccacgcccagctaattctttgtatttttagtagaaatggggtgcaccatgttagccaggttggtttcaaactcctgacttcaggtactctgcctaccttggcctcccaaaatggaagggattacaggcgtgagctgctgccttaaatgctgggattacaggtgtaagccactgtgcctggctgcaagttttttttgttaaccttatcttagtggtttttaagtaatgttaggcagtgcactgggggtttccaggagctaactccttagcagataggagacgagcaatccctttagccaaaatagtttttaatttctctggggtgaatctttcctctgttcattattggtaacagactttatggtaaacagtatattttgaggaatatttttattagttgataaattttagccttagaaaaatcatcaaaaataaaaatgttatctttttgaatattttcctattgtttgtcttaatagtgtttgttgctgagtcatatcagtttcatcatgctgcctattaggccataagaatttccttttggttaaataactcaggttagtgaagtacttcttaaattttacttaaaattgacatggctttaaaatactggttttacaagatatatttaaataatatatagatggtagcagtgttatgttttggaattagaaattttacattgcttatagcatctctagatttttgacttgggaccaaatgaattggttggttagagtctgcttgccttagagaagagtacagtatggtacttaaaaacacctctaacttttgtttttctaacacccagattctggagactttggttgcagctagaccttaataaaccagtacaattacattacatactataaaatatttaaaaaccccaagatcatcagaagtcataaaatttagggttagtggcaagatctgagagatcatctagatagttagagctcttcattttccttatgtggaaactggtttagtgagattagttacagcttgcttatagcctcataggtagtttcaatggcagaattagaaaggagaatctaggtctaacttctcatactgtgttccttatatttcactacacaggtgtaagtgcagctactgaaaatagaatttaaatatttctatttaaaatacagaatgattcagagtaactttaaaatttttatacctagattttgatttttccctcttaaagagctctacaacatcaaaggcagtcaaacagagacatcattgggtttataaatctcggctcaggttatctgtgaatcttgggtagtttatatctctcatcaactctcctttagattctacctttttgcccattcaaatatatcttctacctctgatatatgaaataaagggaggcattttgaacttacatgactttttttttttcttttggagaaaaagaaaatacaaggaacatggtagcggggaaatggatttctccatttatagcatgatttttgcaaacgcagttaaatgcaagttctctgaggttcagggactacctttgtaatatccatcttaagaggagtgcctgtctaaatagcatgtcaagtcatatactactctggaatttaattaattgattggtcaattttttttctttaaaaatatatttttgtgtgtgcgtgtgaaccaggcaccccctctgcccccaaataggtttacagtgactcttgattattttttaaataaccttgttattttggcataattttagatttacagaaaagttggcaaagtactatagacagttcttgttttcctctcacccattttcccctgttgttagcatcttatgttaccatagtatatttgtcaaaactaagaaactgacattggtatattactgtgaactcgtctccagactatttggatttcaccagttcttctgttatcttctttctgttccaggtgccacatgcctcccctggtctgtgacagtttcttgggctttccttgttttttatgagcttgagtcttgagtaagattgtccaggtatcctgtagactgtcccccaatttggatttgtccggtgcttttcacgtgattagactggggttttgggttttaagtgcccgttttgtcacatcgtatcagggattgcacgtatgtgataaccacatgacatcactggtggtgtttggtttaagatagtgtttgtcaggtttctccactgtcaacagcgctactatttttccgttcccatacactgttcatggaaaacagctcactaagtccagcctaccctcaagggtgaaggacagggcaggacttaagcgccacattctggagggaaatctacatttattaaatggcattcttctgtaacgatttatccattccccgtttgtttggtttgtttgtttgtttgtttgtgtccgtatggaccatgggcatttactttatactttgggttgtaagctaatactgcagtatttacttttttggcttaaattgtttcatatttggccactgggagttctgtcagcttggccactatgtcccattgttttttgagcactttgttgctttctggtactataacatgctctaggctcatcttgcattttccctgccccagtcctagaattatccagtctccaaggagccctggttcttgttattggagaatggtatatagaaattaagatctgggcactgagtgtgctcactggtactgggtatcactgcttcttggccctctcaccgataaaagtgggtaacattttatgtatgctaacccatgtgtatgcacatatttataactttttctgtctaatcatttgtgttaagataaacatgaattcatacagatgtctctgacttgaatctagtaggacagcattcaattttggcttcctttctgacatacctgtatcttttctctctcagagtgagaaacctggtttttatcatccatttacttatctgttcagccccagtatatgttaaagcagtttcaaaattttgaacctgtactgctgtgaaaagtaaatttaccagcaagagtacagtttttatgtatttggtagctcctttttatctctagccttctagatttagtttttgcacattagatgccctttctctcctgctctgttgcaggtacttgtgattctgagggcctaagctatccatcagtctttttgagttgtcactttctgaggctactgagatgaattctgtcatggagaaacacagaagaataattacccagcgagccacaaggtttctaagatgaactttctggtgtaggatgtgtgatttttaatttttttatgccaaatatacagcttctatattcacagtaatactttacaaatcaccctatattgtgtgtcctttgtgtgctaactgaacatgagatagcccagcaatcctaaagggacactaggtagtgccttccacatagtaaccagagtccctttgccttggtttctgaatattcctcagcagtctgctaaaacgtacttttacccactcttaggtttattttgtcagtcagtgtttatatctttttttttttttttttgagacagagtctcgctctgttgcccaggttggagtgcaatggcgtgatcttggctcactgcaacctctgcctccggggttcaagcgattgtcctgcctcagcctcccaagtagctgggattacaggcgcccaccactacaacctgctaattttttttgtatttttagtagagacggggtttcgccatgttagtcaggctggtctcaaactcctgacctcaggtgatccacctgccccggcctcccaaagtgttgggattacaggcgtaagccaccacacccacccagtgttcttatctttttaagttctttatttaatttatacttttggaagtaaaggctttgtaagggagccagacttgacttttaccaaaaccacatcttaacatttttttggctaagtacagaaaaattatatgtatatttacagaacttacatttgtggaatatgtcttttattcttttatcagccaaaactatcctgaggtctgtgttttgtatttgaggaattttgggttttaatttcttaaaatctcttgaattctagtgagttagagattccatagggttgtactgttttccagtctaggaaatgatttaaaatagctgcctggtgctaatgttggaatgttcctagaaagtaaatatgtttccttgcatcttaagtctagagcatgtttggaaaggattcaagaattagaggacttgcttgctaaagaaaaagacaactctcgtcgcatgctgacagacaaagagagagagatggcggaaataagggatcaaatgcagcaacagctgaatgactatgaacagcttcttgatgtaaagttagccctggacatggaaatcagtgcttacaggaaactcttagaaggcgaagaagagaggtaaggaacttaagggtcaccctaccttatggtccactttttgcctctcaccctttttattgaaataaaaataaatagcattttaaaaagaactttattttcttggtcatttctttgaacacctaggtatagaagtagtaatagatcatatttctacctcatcgcagaaaatgttgctcaagtactcttagtttatttattattattactttaaatgctgaactgcatcaggatggattagttcctttgagattttaagtgttttggtgatttaatatattgtaaaatgccaaactggctgaaagagactttacatattatttatttatttatttatttatttatttatttatttatttatattgagacagagtctcagcctgttgcccaggctagagtgcagtggtgtgattctcggctcactgcaaccttcacctcctggtttcaagcgatttgcctacctcagcctcctgagtaactgggattacaggcgtgtgtcaccacacccggctaattttgtttttagtagagaagaggtttcaccatgttggccaggctggtctcaaactcctgactgcaagtgacccacccgcctcagcctcccaaagtgctaggattacaggtgtgagccaccacgcccggctggctttatatatattttaaatctggtcaatgtataaatatttttgacacctgttctcagaaaagagttccaaaagggccaggtgcattgcctcatgcctgtaatcccggcactttgggaggccaaggcaggcggatcacatgaggtcaggagttcaagaccagcctggtcaacatggtgaaactccgtctctaatgaaaatacaaaaattagctgggcatggtggcaggcacctgtaatcccagctacttgggaggctgagacagaattgcttgaacctgggaggtggagtttgcagtgagccaagattgtgccattgcactccagcctgggtgacaagagtgaaactctgtctcacaaaaaaaagaaaaagaaaaaaaaagttccaaaaggaaagtggctgatttaggataaaaagccagataattttaatattatatccgttgtgatcataagaaagtacaggtacgaaaagagaaaaaagtacaccaactataacagtggctgtggtgggtggtggtagatcagatgactttctacccatttaccagacttcttgcattatggttatattacttccatccctagagaaaacattcagattgttattttttaaaaaagaaaattgacgatgggcaccttatgaagaagtttacattagttaaggtaaactttggctttggctaacagattgtaagtaatattttgctttagaaatgcatgggtgggatattcttcttcttattattattattttgagacaggttttcactctgtcacccaggctagagtgcagtggtgtgatctcagctcactgcagcctctgcctcccgggttcaagccattctcctgcctcagcctcctgagtagctagtattacaggcgcccaccaccacgcctggctaatttttgtatttttagtagagacggggtttcaccatgttggtcaggctgatcttgaactcctgacctcaagcaatccacctgccttggcctcccaaagtgctgttgggttacagacatgagcctctgtgcccagcccttgtttttttgttttttttttttttaaggcgagaagggcatatgtgttttaaaaatgaattgttttatttttcccatataggttgaagctgtctccaagcccttcttcccgtgtgacagtatcccgagcatcctcaagtcgtagtgtacgtacaactagaggaaagcggaagagggttgatgtggaagaatcagaggcgagtagtagtgttagcatctctcattccgcctcagccactggaaatgtttgcatcgaagaaattgatgttgatgggaaatttatccgcttgaagaacacttctgaacaggtaataaaatagacccttttttttctagcaaggctttgtggattgctagattctcttgcaattgtcatagctccttagtttttgtttggattcattacgtcttcatggaataagggtttatgtcctttttacttaaattcataaaataaaataaaaattaaaataggaggaggaagagttaggtacccttagtagtttaaagatttgcttcattaacccttctttagagggccagggcttttttgaaaagcatgttccttttatcacagtggttctgaggatgagttattattattctctgccctagccaaatttgtgaagaagttggagcaattggatgaaaatggtggatattctttcggtcattaacttaataaaaagcttactgaaagaaggagataagagcctggactcagatattaagggaatatttttccctgcaaataaatgaatgaacaaatgctaatactttacatgaaaaatagcatgaagccttattttgaaatatgtttaaaagtaaacatgaagtattcatagcagagatttctgaaatttagggctggggctttcgggagctctgtagtgtgggccttccctagctctgcatcaaggagctggaggccatgatgggttgtgagatgatactagaggaaggcatggtctgggagcgtgcaggcggcagtgggatggatgtcacatcttgaaacatatgttcagggcctgctaaaagtagttttgaaaattagtcttttctcaccacagttattaaaactatcttgcatgtggatgaatatgtaatttggatgagtgaaggagcactaatgagcaccaacagttttaatgctaaagagaataggctctaaggtctctttgtagccttttttttttttttgagtcttgctctgttgcccaggtcggagtgcagtggcatgatcttggctcctccacctcttgggttcaagagattctcctgcctcagcctcctgagtagctgggattacaggtgcacgcaagcacgcctgctgatttttgtatttttacacagggcttcaccatgttggccaggctggtctccaactcctgacctcaggtgatccacccgccttggcctcctaaagtgctgggattacaggcatgggccaccatgcccagccccactgaccctttttttgagccccttatgctttcatgtatgagagctgaatgtgggcagaagtgggacagatgcagaaggaaaatgacagattttcttctgtttctaagcttatgtgtctattttaaaagcttgaagtaatccaatacttgatgtttaaaaattgtgattatgacagctagatagtgctgtaaatttgaaagacccaccttatctagcagtgaatttgaccatttaatttggttcataccctgttcttccagttctgtcctctttaaagtcaagtaccttactaattaactcattgttgaagttactgtttgacaaaatgacagaatcgtgttttctttttatagtaggaaaacctgaaatgtgggaagatgaccataaagcggtcttagtttaactgcctgtatggattaatttatttgattattccacaactttctttatctttgaagtaacacccctcaccctcctttctgtgtgtaggatcaaccaatgggaggctgggagatgatcagaaaaattggagacacatcagtcagttataaatatacctcaagatatgtgctgaaggcaggccagactgttacagtaagtgaatctagtcatcatttaatttaacttcattgtgttaactaacaaagtaactcaaaaagttttttggctaaaagagaagcattttagaaatggccgttaaagtactttttatattattagggcattacaagtgctataaaagatttttaaaattctgtcttattgagagtagtgaagaatggacctttgaattatttttatcttgtctattccagtagatataaaagctatctctaggctgatacttatagcccagtgtcattcaggagacactgcttggcataaagaactgttaagaatttagcattaacatatgcctaaaacagcaatctctagccttgggtgagcttcagaatcatttgggtagtattttggtgttcaggccctacttcaccctttgctatctttagggttggggtaggagcctaggttttgaataaaagtccttagattataggcacccttgtaaattttcactaattggcattctgtgtcttgatttctaaatggctctctattggtatgttctgaaatactacatctttaatagttactgaattattattagcttactttttagagaagtatgtttcattgagtaatcaaagattcttttgcttttacttagtaggtagatttagctaacaataaaatatgttaactttgatacagatttcaaagaagtcactcttttcatcctaaaagaatgtagaggtgactgtctctttccttttatatattctttaaaaaatattaaacgcatgttttaaatgtgtttataattttatgttgatacaaaccttactgttgaagatcaaaggctcagacttctctttaaaaaggtgtattcagagagcatgatgccactttgtgaaaatatcaaatgctaatttggtaataatgggtaaaaatgggatcaactatcctaactacaatatcctttcttctcgttagtaattactatagtgagaaaaaattgctcactatagcaattgctattatatgtcttatggaagctgtataatgtggtaaaaagaatctgacattttagttcagaggattcagaattgagtgtgctctctatctcagaagtaatatggaagccttatgccaatcatgtgctttttctactgggtatactacctcagggactaaatacatggattctagagatctagtggataactcaattatcatataaaataatgtgatacttttttcccttcagttactggcattaaatgtgataagcagctctttggaacatggtagtaataagtgatctttctgtaaaattgcagaggcaaaagcaaagatcagtttaaaactctagaatagaaatatgagaaccacatgtgtaattttaaattttcttatagccgcattaaagtaaaaaagaaagacatgaattttagaactatattttatgaaacccaatatatccaaaatattgctttaacatgtaatcagtctaaaaagtcagatatttttacattcttttttttttatgtttagctaagtcttcaaaatctagtgtgtattttacccttacagcacattcatttcagactagccatattttaagtgctaacaagccacattttgctgcggtattgaatgacatggctataggacatattagttttaggttaagttagccagcaaggatactgacattttatgatgatgattactaacataaatcaactatgtgattacatataggctagtgagaaatattgcttacaattagggaaacactaacattccacatagtctgaatgttggaccagattcagttctttttttcagtttaatcccagttaatatcttgtgcccttttccatttgtaatgctgatgaaagatctggatgcttcaggggaacatctcaaaagtaagggctctctcctaatcagtaattcatagattttttttttcctgtttccaccccacccccccaccctttcttttttttgatagagacaggatttcaccattttgcccaggctggttttaaactccttagctcaagtgatctgcccgcctcggcctcccaaagtgctgtgattacaggctggagccactacacctggcccccattttgaaataatacttggctttgccatcttcagctttccttttgcagtcataaagtcttttatattctataacaatgtatggattacaaacttttctgtttctatttgtttttaaatgatctttctaagagatcagggctagtagtatccctgtagctaaaggcattgagtttcctagaggtgtagtgatttgtccagaattcaaacctaggctttctgactgccaggtgttcttcactctatccattctcttttgccagtagatatataaaaagaatttcatgctcatgagaagggaaatataattatttctttgacctatttcaatagcaattatattttcccttgaacagcgagtgatttatacatttccagcattctttttggagcgcagtctcagatactctagggtattgtgacattgtctgtttggagacgtaccagtttccataagattattctagataggctctctgctgcagaaggtctctttagttcttgctgtaggcagccagagaacattattagagggagtcacagaaggctctaacatggaaggatggcctataaaacccacagagtaatagaacgctgaggctaccattcactgagttagccagccactgaatgtgggttatcacttgctcttttcaataatcgcacctgttacaggtgccatttctaccctgttttatggatgactaaagtaaggtaacttgctcagggtcagctggtgtgtaaaggaactaggatgtgagtgtaggcagttttacttcagggtcttatatattatcatcttcacttatcagatggggaagctgaggccttgagaagctctgtgagttctcctggccacatagctgtgtatagcactctgtagctggggcatagttctcagacttttagaatcaagtgtttgagtctcatcgcattgctgtcgttggcgtgtgggagaactgggttctgggtgtactgacatgctttggttttttacagatttgggctgcaaacgctggtgtcacagccagccccccaactgacctcatctggaagaaccagaactcgtggggcactggcgaagatgtgaaggttatattgaaaaattctcagggagaggtatggccagtttatcaggaccaccacaatgttaatttcacttaaagttcactgtgcaagtataatcaagatcagattgaaacgtgcaataaccgattgcataaacagaccaaagctgctaagttaattgaactgaagctgtctttaagttttaggaataaataggagtgtattatagagtactgattattagcacaggctccagaacagattttctgtgtcctgtttctgttttcactgcacattagctttgtgactttgggcaagttacttcacctctcttagatttgtcatttaaaaatggatattaatgacacaatatccatgagctaataataagaatgagacagtacttgggaaatgcttggaatagtatctggcatagtacctttatctagtaaatgcttaaattattaaccttgttactagctctcagaatgttcatgaaactgtgagtttgaagattgtggagtgtacatcttcttggagtgtgtgttttcagtgtgtcagtcttagaatccttgtcaaagtaccttaccttccccattgccacataaagacactgcatatacccctaccaatactagtcttagaaatactacttcctaataaagcggctaaagtgtgctttgaagctagtaaaacatggcttcctccttgtctttccctagcgaatcaccttatccaggtgctgtaccacgcatcactgagcctctgtttagaatttgagtccctcctttgttgctattgccataagcatgttaatggagcttttgttgtgagttcagcatggtttgttcttctcattttccttttagttgtaatactgctttttcatcctttgcctaccaggagagctgtaagttggcttgcaaggaagccattggtcataaccttgttctgacatgcttactgattctgaccttttcacccagtttccaggctggcaggctctgctgtttgtaccttacaacctgactgggtatgcatttcagtctgagtggtgctgaaaggagatatatagggggaatgttaggctggcaaacctggtagggaagctaaccatatttacaagtgcagggctattcatttatttggaaaatcctgagtatctgctgtatgccagccactttgtgttaggaataagcaggaaaaaagccatacgtggtttctggcatcatggagcccacattgtaaagagagtaagggagccagggaataagataaagtgattttctgataaaggtaataaagataaactgtggtatcaggcccagcgcagtggctcatgcctgtaatcccagcactttgggaggccgaaggtgggtggatcacctgaggtcaggagttagagaccagcgtggccaacatggtgaaaccccgtctctactaaaaacacaagaattagccgggcatggtggcacgtgcctgtagtccaggctactcaggaagctgaggcaggagaattgcttgaactcgggatgagctgagattgcgccattgcactccagcctgggcgacagagcaagactgtgtctcaaataaataaataaagttacaggactcgctgagtaaagtttgtcaggagagggtccagaattgagccctagaaaatattgacattaggaataagagcaaaggaagtagaagatgcagccagtgaagtcagaggaaaatggtgtgtgatgtcaggaaagccaagggaggaaagtatctgtgaaaggagtggtcagcgggtcaaatcacaccgtccccttaggggttttttgtctgctcccatagtgccacgggcaggcctctaacctgcgtggtgctcatcacattgttctcactcactagaggaagcacactgagggcaagggcctgttctggtagatcctggtatcatgcttggcacataacaggaattcaggaagcatttactggatgcattttttaaaaaaaaatcagacatggaccttgacttacgttcagagaaataaagcaatagcagcattcattataagagtctgaggtgcctggataaaaagttctgttcatggccatcttcctgtctatccctcactgtaaccatgtctcttgtgaaacattgttaagagtggtgattggctcagataagactgaaaagcactgttataaggggtacaaggcagattaaatggactttcgtgagccatggaatctagtcattatttatgtcattttttttttctctgtgaaagtgtgttccaagttagaaacaatgttataggaggatatttggaatggagcagtaggtttaaatgccccaaaaaatagatacagtgacatgaacaaagtagtagatattatgacatgggatgcatcttcagacagtattactagtattactgatgacatattagtaaagctaactgaagcttagctccatttcataactcaaacattgaatagtagattatttgattgattgattggttggttggtccattcttttttttttttttggtgaaggagtttcactctgttgcccaggctggagtggagtggcatagcacgatctcggctcactgcaacctccgcctcctgcctcagcctcctgagtagctggaactacaggtgcgtgccaacacacctggctaatttttatatttttagtagagatggggttttaccatattggccaggatggtctcaatctcttgaccttgtgatccgtcacctcggcctcccaaagtgctgggattacaggtgtgagccaccatgcccggccaaggttggtccattcttttaacaaacttctaataccttcagcttgcgaggctctgttttaagtgagttctgtcagaaatgaggagagaaagtattatgaatacaggtcttatttcactagacagttacttttggcatttattcatttaattcgataagaccatatttgtcagtagggaccagaccacattaggaacaatctataaacaatccccgccataaagaccagtttgcagtaagattgttggtaactggcttagtcagttttgtttcttatgtttttttttttcttcttgctggggcattggaaatgtcagaaaacccaattaaactggcttagaaataatggaaattttttgggctcacataataaaaaatttaaatagtggacctaatccagtggctcacagcatgtccccggggatctgtctgttgtttctcttctggttgcctcccttggggacgcaggatagctgctggctgctcccagaggtacgtcttttctatttgctttttgtgggaaggtgatctttcaaaaaagtgctctttatggtggagtttatagattgttgctaacgtggtccggtactactgacagataaacatggtcttacccaattaaatgaatacataccaaaagtaactgtctaatgaaataagacctgtattcataccactttctctcctcgttcctgacagaactctctcagaacagcctagcaagcagaaggcagtagaagtttgttaaaagaatggacaatccagcccaccaaataatctgatattgagtgtttgaattatggagggaagctaaacttcatcccctgtgaggcacccatcctgggcttcactcacactggactagggtgggtcacgtgcccacctctaaaccagttcctggagttgggagggcggaattagagctcaagacttcttcctcccctctacagccacattgcactgggctccttgtgacacacgtgtgctccatggggggtgtgtacccaggtaaacctaggggctcttattcaggagggaaggggcactgggtggttaaaaacagcgattgtcaccatggcaaaaacaagatgttttttatgagggaaataaaaaataaagcagtccttccaaactttccagaatatagatataatggaaacttttgtatatgcaaatgattacttatatatgtagagatgcaatatataaaatataaacaatcatctttcgtccacataagatcgccctgatttgtagcatttgctaatttctgtggtataaatactcctactgtggctgatgccaggcttccagcattatgtgactgagcacagagctgtgcagtgatgagcagcatcagcaggtgcagccagctccgggcaccactgcacagatcagtgcaccttcatatgcccaaggctcgcagcaggggcggaccaatgctgcattttatagacagagtaaagcctgtcatgtaagactatttatgtgaacctttcaggacacttggggtaaacacatttatttagtagcatcttgactaataacaatttccttgatctaaacctcccaacagctttttggttctaaattattatttattatttttctacctagatttttagacattagctcacccattttttatacggctttctgtattagattaattggtttttgcatgttttcaaatgaagagtgcttaacagcagggttacacttaaagtagttatgttaaggtaattcataataatgaagacaggcaagttgctgttttctgaggttctcattgaggctaatagtcttaagctacatcatgagccttaagagccaatgtttgcatatgggatgtataccacgagcttctagaagctggaatgtggtaattttgttatagaagattttatttgactcgttcctcattttaagatgagttgagaaaagctgggtactctcaaagttttttaagaatttatttttctgctttatatgctgctatctcctagttgatagcttgaacggtggttgatctaaagaatcacattttttttattactaatttggttaaaacactgatatttgtgaaatggctatttctgtttgtaaagatagaccaatttcacagaattgaagttactggctaattgagaggctcaaaatggtccatcttccttggtcctgcaagagtaataaaaaatccccacaaaatactgttctgccaccttactttatttacaaaacacattattgggcatatttcaaatcgaagtctcatttctgtgacactgggttttgattttctttctctgccattgtaaactagctggtctgtgttagataagcttttactgaagtaatattgtgtcttcccctgtagcattctctttcttgagtgaccttaggacagggtacagaataaaattatatgctctgcagcactcttgaggacacactcatttacttgctgccagatcatcaggttagccttgtgcttaagcaaaaacactgctgcatttgtgccaagtcagcattttccacaggaaagtaatctgtatttgacctttttagtagaaaatggaaatagttgctttctgtcatacctttagtgaatgataggagacctatttctgtacagaatacattggaacctcactagtacgttattggtaaatagtgtacagtgttcatctgtcttgattttgtttcattcaagaggtatcagttgctgaaaggaatgaaaggagcttgtcctttcttctcacttatcaggtggtcctgttgctggtagtccctgagatcacagttggcttccagcttcattttattcagcatttatttagcaccttatctttgccaggagctaagatctttaagctgaattcatgttgagttttataaagaatttagtatgtcaaataatttgtagaattcttagtaacagaataggataaaaagcagtggaaacttctcagcagatatttcgaattggatagtacttcctcccctgcaggaaatatggaaggtataagaactgctactaattatgcggaaatttcagtttagtaaccagaaagttactgatatacagctccccccgccccacccctttaaaaataataaacaggggccaagtgtggaggctcatgcctgtaatcccagcactttgggaggctgaggtgggtggatcacttgaaaccaggagttcaagaccagcctggccaacgtggcaaaaccccatctctactaaaaatgtataaaaattagccgcacgtggtggtgcatgcctgtaatcccagctactggggtggctgaggcatgagaatcgcttgaacctgggaagtgaaggtttcagtgaaccgaggtcatgccactgcacaccagcctgggcgacagagtgagactctgtctccaaaaaaagggatgaataatagtaataataataaacagaaatgctgtctcttttttttttcttttttgagacagtcttgctgtgacactggagtgcagtggcgtgatctcggctcactgcaacctcaatgcaagccattcttctgcctcagcctcctgagtagctgggattacaggcacgtgccatcatggccagctaatttttgtatttttagtagagacggggtttcaccatgttggtcaggctggtctctaactcctgacctcgggtgatctgcctgccttggcctcccaaagtgctgggattacaggtgtgagccactgcgcctggcaagaaatgctgtctcttaagcaaagaaaaggtccctctcccccgcatttggtgattttaagtgtgttttttaacttaaactactattgtttttaggaggttgctcaaagaagtacagtctttaaaacaaccatacctgaagaagaggaggaggaggaagaagcagctggagtggttgttgaggaagaacttttccaccagcaggtattactttatttatttaatatatttatttcaaattttattcacagaattacatgaagaccaagagtgtggttgggtttttcccctatcagttgatgaaccagcgcagttatctaccaagtggggtttgtactccccaaagggatattcaaggtgatactttagggtactggaagaatatgttggcacttttatttttattttttctcattgtaccaagtttcagttttgtcctttgttttctaatgtgcattatgtgttacagtaaaacatgtctatggattggatgtttactccaaacttgtttactctgtagggtcctatgattaaaaggtttagatcactaatttagagcaagaatctgcatataaactttaaaaaaacaaagtaatattcaacttcagtgtgaaacaaaattcttgctgtattaagttcctaatcattatctaattgaagatagattttggctgatggttgggcttttgagagcccttgaaataaagaaactccaaatttggttttaattataattaaattggaattattaataactaatgagccttcagtttatattctcaagctgtttgagtccgatcattaatcaaagtgtctacccttatcctgataagactttgtttccatggctccagatttttagtcttaagtctgctttgcttcattagccctagtcctggtctaaataaacactgtctcatatatttaacccccagggttgagaaccacttgaggtgggttgcatgaagtagcatgaattttttacctggatgccttctcatacattttggaggaatattttaaaacacatatgttacacttaacttacaagaaacaagcacaagttccattttctgtgcttcaatgggaaccatcgtaattactagaagtaaaataattatgtaagagataactcaaggcaccagacaagagggtcagcatgagttatatagcatgtcagatgctagaggaggtactccaggccagcagagtagttgagaagaactctgtgaggtgatgcttgtccactaatttgaaggatgggtgattatttggttattggagagaaggcagatgatggtgctctgaggatgttggaattcaccattgcttcactaacagaccaccccaaagcttagtggcttaaaacagtgatttcttacttcccataattctgtggtttgactgggctcagctgggcagtgtttctgttccacatgctgcagactgaactcaatcgagcaggctgtgttcagctcagaggttggcctcggctggaatatcttttaggtctctttctgtgtggatttctatgatttaagagtttagtcaaagctttatagcatggcaattgtctaacagagtaagtggagggtacaggtttctttcttttttcttttttttttttgagatagagtcttgctgtgtcgccaggctggagcgcagtggcgcaatctcagctcaccgcaacctccacctcccaggttcaagagatacccctgcctcagtctcccaagtagctgggattacaggcatgcgccaccacgcctggctaattttttatattgtagtagagatggagtttcaccatgttggccacgacaatctcaatctcaagagagtaccaggtttcttaaagggccctttgtaacattctcttagtcaaagtcatgaggccagtccagattcaaagtgggggtaaatagtctccacctgttggtgggaggaatggcaaagaattcatggtgatctttaactcactacagaggatgtgtaaagaatgtggccgggcacggtggcttacgcctgtaatcccagcagtttgggaggcaggcagatcacaaggtcaggagatcgagaccatcctggctaacacggtgaaaccccgtctctactaaaaatacaaaaaattagccgggcgtggtggcgggagcctgtagtcccagctactcgggaggctgaggcaggagaatggcgtgaacccgggaggcggagcttgcagtgagctgagatggcgccactgcactccagcttgggtgacagagtgagactctgcctcataaaaaaagacttaatgcaccaactatatccgctcatccagttattttgtagggttcatgtgagagttaaatgaagttgaaagattggaattaaactgacatagtctggaatgcttagggatgtagcttctgtacaatttggaacaaaggagaagttaagactgcattttaaaatatcactggccaagctgaatcagagggactaactctagagaggagattccagaggcagtgagggaatatataatggaaatttattaaggcttagtgactaaacttgagggtgagagaagaaaaaaaataaagatgtatgaggtttttagcttttgtgatcacagaaactaatgataccaaggttcataagagggaagatggaagggcagaacaggcgtttgaacttcatatttgaggatgaatccaatcgccttttgaattgattagaaatattttggtgaccttcaaaaaaccagttttagttcaatcagtggtgagtcacaagtcatattgtgaggttatatgaaattaatgagtgataaagaaatgggtagaggagccatgttgacttcaccttggaggacaaatccactgcagatggcttgggatgtgtaagttcaggatctagcaagctgtagtctccgatgtggttgttaaaagctgatccactgatctcctatttcctaagttatcaaaagaggttattgaacaatggttttcaaattgagctgcacattagaattactttaaaattatatatagatagctaccctttcccagtaaaatgagaaattcttatttgattgatcaagggacctagatcagaatttgttttaaactcctcaggatctgaatgtgtagccagagttgacaattactgttctggaatttgttggggggtattctagaaagaagtccataaaagaaggttagaggccagatacggtggctcacgcctgtaatcccagcactttgggaggccaagggcaggtggatcacttgaggccaggagttcaagaccagcctggctaacgtggtggtgatgcacacctgtagtcgcagctgctcgggaggctgaggcatgagaatcgcttgaacccaggaggtagaggttgcagtgagccaagattgcaccactgcactccagcctgggcaacagagtgagactctatctcaaacaaacaaagaaaaagaaaaaaagaaaaggttagaaaagatgagagatgataaagggtccatttgaggttaggtaatatggtttggtatccctgtagttaaaagtttttgtcttattttagaatactgtgatctatttctttagtattaatttttccttctgttttcctcatcagggaaccccaagagcatccaatagaagctgtgcaattatgtaaaattttcaactgtcttcctcaaaataaagaagtatggtaatctttacctgtatacagtgcagagccttctcagaagcacagaatatttttatatttcctttatgtgaatttttaagctgcaaatctgatggccttaatttcctttttgacactgaaagttttgtaaaagaaatcatgtccatacactttgttgcaagatgtgaattattgacactgaacttaataactgtgtactgttcggaaggggttcctcaaattttttgactttttttgtatgtgtgttttttctttttttttaagttcttatgaggaggggagggtaaataaaccactgtgcgtcttggtgtaatttgaagattgccccatctagactagcaatctcttcattattctctgctatatataaaacggtgctgtgagggaggggaaaagcatttttcaatatattgaacttttgtactgaatttttttgtaataagcaatcaaggttataattttttttaaaatagaaattttgtaagaaggcaatattaacctaatcaccatgtaagcactctggatgatggattccacaaaacttggttttatggttacttcttctcttagattcttaattcatgaggagggtgggggagggaggtggagggagggaagggtttctctattaaaatgcattcgttgtgttttttaagatagtgtaacttgcttaaatttcttatgtgacattaacaaataaaaaagctcttttaatattgatatactgtcctttttaacgctttaaaaacagattttgaggggagaaaagtattgtttcagttttgcttttgataaaaatataatttgacttctttgaactggatttttctttaaggctttgccagttgtggaagataagctattttgggggtctttcagtatttaattgtcattaataacaacaataataaaagcaataataataactaatgtttttgagccagatatcatgctcaatgcttcattacattttttagcttattaacaataaggccttttaaaatttcttcaggaaaaccaaataggaacagtagaaaacattgaggaagacattcctttttttttttttttttttttttaaaagacagaatctcactctgttgcccaggctgtagtgcaatggcacggtcttagctcactgcagccttgacctctcctgggctctgcctcccaagtagctgggactacaggcacacaccaccatgtccggctaatgtttttgtattcgtagagagcattttgtcatgtttcccatgctggacattcctagtaaaagaaaaaatgggaagaatattttagaatgtaattctactgtcttttaaaataggaagggccgagaaattgattaaaagccaccttttagaaaaataacatgaatgctatgaaatacgaatgtgctgtgtgtggggtagctttattatgtatggtgctaattatggtgtcaattcgtgtggatttggggaggttttgtcttgattgctttagttaagtgagttcatcttataggaagtgcaatatctgaactcttcctagaatggacagataatatttcagaagctaaccctagtcagtgtttgtttttctcttaaaatattcctgcagtaagctgcacaaagactaccagctttcacttgaaaataactcacaaagccccagaattactgtgttccgcagatttactgcatactttggtgccgtcgcagacacaagataaatgctgggttagaaattctgtctggtaaagcagataaaatgataacttctcaacgcagatttatcttcagagtgggaatggcattacagtacacagccaaactcagctgtgaaacattttgccacaagatggggttcttgtcatcaaaatacattctaggtgcttttattgctggataaattaggttataaaagccaacacttgaattaatttgggcattaagaaaaattggcagttgtaacatagtagaatagtgtgtatgctggggaaattgagagtacaaatgcagggctcaacataaacagtttgttgcccctggatgtgtggcagtagtagattcctgagtctgtttagactgacaaactttggactaaattgaggttttctgaaattgagctgcacctaaacccattcccgcagaatgtgagtgagctagagggcacgctgccatcctgtgtattaaaatcagcatctccgcatgaaattgatgttaggcatacagcatatatatacatttttggattatttatttgataacaagcatgattcacattttccccttgttttgtcttcagtgtttgttttcacctctgtttaggtatggatttattttattattttattttattttatttatttttttgagacagagtctcgctgttgttgcccaggctggagtgcaatggtgcaatctccgctcactgcaacctctgtctcccaggttcaagcgattctcctgcctcagcctcctgagtagttgggattacaggtgcacaccaccacgcctagatatggatttatttttattcctcttgttcaggtcttatctctgtgttcttcattaagaaaattttggatgttcttattttgttgagtattatctcatccccactgtctgttctttccttctggggtttcttttatacctgtgttgaacctgtcctgtttcatgtattttaggtttctccacactatattctcagttaactccttcgtat

SEQ ID NO: 14832 - DNA, 44999 bp, Human
aagactgggcagacctttagaaatagaatgacaagtgttaggatgcaaagcaaaagcaactgaaacccaaagggagtgtcagcttgtactaccacactctggaaaacagtctgacaatatctgctaaagccaaacacacctatcctaaggccaagaagttcccagcagtgagtgcattcatctacggaagaacgtgcactagaatgtgcattgcagccctattcatgacagccccaaactggagacaacacagacatctgtcagtagtagactggagcatactcacaccaccgacaagtatactgcagtgagagagaatgacccacagctacacaacacactagaacatgaatgaaccccacaaacaacggaaagcaaatgaagccaggcacagaaaaagtacatcccatttaattccattttcatcaaggtcaaaactaacccatggggttagacaccaggatggtaggttcctttggggaggaggcaatgggtaggaaaaaacatttatctagaatctgaagtttaaaaaaattaaagtagtttctcctgctgtgctgccttttttttctgctttgctttttcgaggtaggaagttccaggacaggtaatatgtctgaggaagcctccacctccctcaccctactcacccttctcctctgggaccagacaggcaggaactccagggaaagcccaacaaggagctgtcctagagcactgatttcattttggcttcaagtaagattttcactagcaactctgcttttcatctcttttaaattttattattattatttagcattttcttatctgttacaatgtattaggcactgttcaaagcgtggcattagtattaatatgttacccattcattcattcagcctgctggagacttggtaatggcctctttattgagaacttactctgtgccaggtagtaagctaagttcccaattaatcctcacatgagctcttccttgccaggcaggagagaggggaagatatctgttagcattacagaggagtacacagagactcagagaagtcaagtgccttgtccaaggtcacacagctaagtcagtagcagagttggtatacaaacccagattccacattactgcaaagcaccaagctctgtcttatctagtgaccaccctcaagcaaatcacgttgtaagactggcagaaatacgaggtttcttagttccctaccctggcctaatgaatcaaaatttctggcccctaggctggcctgagcagtagagtcccccacagcagttcaaaacctgattccgtccccggacccagtaggcacgcagggccaagctgttgggtggacggaggggacgggactgccgggaaggtccctcacttctttctggcccctggcaaatgttatgttctctcctctgagaagccctccctaaccatccctggccaccccccgcaactgcttacccctttactttgccttaggtgtcttcctcgcgtctctcagtcttatacgtgggctaggttgaaccatatgacattgtcctttctataaattaaaaaatggttgaaaatggggcatttcatgcagtccaattcaagtgtttccctctaccagaatgtcagctccaagacggagctgggaagtggttcacagccgtgtccccagacaatgcctggcacacagtaggcgctcgataaatgacaggtgagtggccgagggaaggcgcccacttcgaggagttccgcagcctgaagaaaggccccgccgagccggaggaccccaggggactccgccctgtcctctgcaatctcgggtgccttcccggccgcgacgatcgggcggggtggggctcgccgtcatccatttaccagcctcgcctctcggacgggcgcgccgttaatgagattagcaatttaaaaaccagctagctgcgtcggcggcggaggcgcggggccacccccaagccgagccggggtgggacggcgcgcctggcgaccgcgcactgagactgccgtgccggacccccgagccggagccgagcgcgccgaggccggggccatggagaaagcgcggccgctgtgggccaactcgctacagttcgtgttcgcctgcatctcgtacgccgtgggcctgggcaacgtgtggcgattcccgtacctgtgccagatgtacggcggaggtgagtgcccaccgcgccccggccccagcccaactctgtgcgcgtccccgccgtgtgtgcgagccggggttagacccaagttacagaacggcacactgaggccgggaaagcgagcgtgatttgtccgaagttacagacccgggagtgttcccaggacacctcgttccggagccggagctctctcccaagccgccctcccaagccctcgggaacccctcgccccatcccgggggcggccaagcccccaaccctcacccttgttggccaggctgcggctctgagagcgcaggggacgcggtctccttcttcgagagaagtgtcaatggtctgacgtcttagtgagtaaaccttacgtttaggtgtaaaaagtgagtaggaaattgtcttattcaacagaaactcgttatacaactttcagatccgaaacttaaatcaacggtttgaaactcaggttaagagaatcttgagccatttctttaaattttttataaggagattggtttgagtttggaacgacagaaagcaggaaatgcaaatcattctgttttgttttgtttttcttaaataaatgtttcctccgaagcatcatgcacgctccggggacagccagccagccacgcgctcttaccgcactcccctagcgttgcggaaagctgggaacaccttctacacatgtctataacctcgtgaagcccaagtacctttttggaaggcaatgtggcaagagggatttaagtctcagcatctaaaacactttttttctcggttgtctcgtttctagaattgtatctaaaggaaattgtcagagttctgacagaggtagaaggatggtcaccatcatttaataagagcaaaacattggcaacttcctaagccctcaaataaaggggattggttcagtaaattatagagcatccattcaaggttgctcttcgcagcctttaaggcggcattttcaaaaaaaaattgtattttctcgtatcctgtattaagtggagggaggagaaatcagattcaaagctatataaaatggatttgacattttaaaacaattacttaaaaatatgcagagaaaagaatggggaaaagacatcaaattgttaacaaaatttctgggtgatttttgtttaccttgtcgtgtgtgtgtgtttttgtgtgtgtatgtgtgtgtttgtgtattaggacttctataattagcatgtttttttcaccataaaagatcatggaagatgttagaccaaagtatttacgaaaatgaacccatttgagaagaccaagagctaaacactgctccctcctccccttaccccaaatcaacaaaaggttaattcatagagtttttaaaacagtgcattcttaatttcctgattcctttttaaaatttgaagtgcataaatacaccataatgatgtgaagggcatatgttgccatatgctctaacagcattaccatgtgctctaacagctctataactgactcttaaaaagaattatttgtcagaatgagatttccacatcattctgtgctcagtagacctacccatgatacctttatcctgggtacatgtttcccagtcatcagtccaggtgagcctcactgtcacatgactacttaattccttgtttataataccaccatcacctgaatagtctgcagagggatgcatgtggggctgatagttctggagttgaatatgtatcaaggggttgctagggaaacctcaagaccctcaggttccaagaaaaagaaacaagaagtaatcctgtgcctggtgcagaggatgcttcggctggatgggtggatagatagatgagtggaagccggacggagcatggattggtggctgggtgtatgcatggattagtgggtgcacagacaaaaggagggtgtgggtctggtggatggcaccctgtcagccacatgtctacagaataaagaccgaacagtccacttggcaccgtaggcacttgaccacctaacttgaccacttgtccaatatttccacctcatttcctgccacacagcttcaaacctcctcctgccttccaaacacttccatgagcacctccttctgtgcctcaacccttcacacaagatatttcctccacctgagaggctgttgttgctgggagaactcccaccattccctccaggtgggaccaaatattgctttctctccgttgtgctctctgactctcctcactacttcacaggccacataagcacttggtcagaagaactgcacattgttcttcagtttctctgtctccgcccggcccaacctctgtgatgtgatggagtcacaggagccatccaataaatatttgttgagtgaatgagcaaggtattaggaaaagccacagaataaatgacgctagaggatgctagaggctttcccaagcctttcactgcacagtaaagtcacctttaagaagtgatttgtgttgccccaaacccaggcagtttacaacccatcccttaccggaaggtaaaaatcagccacattatgaaaggctgcagaggggtgtataacttccttgtaagcagagctgcaaatacccccagcaaacaaagaatttgtttataaaccacagagccaggctgtgccaaaatacttcccagaataagacggattagggatctgtgcccctctccatgggactctgcccgtgactggagaggcttgtttccttcctgctccccaggccaggcccggcccggcatgaggaatgttaattctgaagattacattccaggtaccaatcatctctgtacagccctggctgcctgctctagaaaaaaaaaaaataaaaggcagctcaaagaacttcacaaaatctctttttgaaaaagtcagcaggtcttgggcaaccatgtcaaaatctaaggcagtagttgttcaggaagaaatcggggatgcaagtgtgtgtgcactaaggtgtaaaaagcaaatactgcactaactattttacataaacatgtgcacggaagaaacatggagagatgagaacagttgtgtgactggtggaaatatggatttttttctcttaaattttctctctgcaatattgagggggaaatcagaggacacctgactatgcagtgggacagtatcactctcagactggaatgctccacatccctgcaaagcccttgctgtctgggacaggaagccagctctttcagctgcctgtactgcttaccccaaattgcttagagaattgcatgtcaaactgtagcctacctgagcatcttcataaactgcaggttgctagaccccacttccagggattctgatccagacgcctgtgggggaggacaggattcttcatttctagaaagctccctagcaaggctaaggcttggtccatggaccacacttcagggaagggtcagggttgcttctgtggccccaggcccggcagtagggtcccagtaaatgtttaacaactggctcttggtggaacagcaagacccaattccaagaatttgcagattaccttgatgtaaatcctcccaccatggccagtttcagactgccaacgtattgtgccggagtgtggggttggggagaggtggggccggttggctcttgtgagccggcctggagctgcggtggccacagctcttcaggccagcacccagcctgggactgattcacagcaggtcagtccatggatggatcagggaacagtgctgcagctgtttacctgtaaagtgggtgagggcccccagtagttgggaaataccatgatcaggggcccctgctgctcacccaagttttccagactcaatcctggtaacatctgccctgttgggctcctagcatgtgccaggcatcatgtgaggcattttctgaaggaattcaatttggtcttcacaacatgcccacagttggtcctgtcacccccatttacagataggaaacaagtcagagagaacaagacttctggagaaatagctggggctcaagtcacttctgtgacaagccagggctctctccccagcaccctgcactcatctgctacaggcaggacaggactcctcaggtgtccaggcctttctaggacccccaaataagaattgccgtggctcagggtacttcttcctgtggttctcctgtgacactcacccatggctcaccttgacattggaggagggcctggccaggagcctgtgcgatgtccacctgcaaggatcccttgtcccttctgttctaacctcctctccacctctgcccttccctgaatatacctcaaaatgtttggcatcttcccagtgtgctcttcatcctctccaggaaacctcctccctaaattaaaggtgacttcttccacaaagccctcctttgatccccgggctaaatccatctgatatgagtttggtccccacccaaatctcatgtcaaattgtaatcccaatgttggaggtggggtctggtgggaggtgattggatcatgaggtaaatttcccctttggtgctgttctcgtgatagtgagttatcagtgagatctggttatttaaaagtatgtagcagcttcctactctctctcttcctcctgctccagtcatgtaagacgtgcctacttccccttcaccttcttccaaaattgcaagtttcctgaggcctccccagccatgcttcctgtacagcctgtggaactgtgagccaattaaacttctttcctttataaattacccagtttgaggtatttctttacagcagtgtgagaacagactgatacaccatccctcctgtgcctgttgcattgtggggtctgacatgtctcactcccacttggtagggaggaaaagtgaccagtcaggaacatagagtctgcctactggtggagaagcctctatttgtctgtgtgttggaatcagcccatagctttaaaaaatactgatgcttctgtcctatccccagaaatcctgattggattggtctcagatgtggcctaaacaggagttttacactccccagagggctctactgtgcaacccaggttgagaatcactaccttacaaacaatatataatataaaccttctaggcaatttaagtcattcagtaaatattcactgagtatcttctgcaagccagggactacgctgacggaagtttacaaatatggtgattatagggtacaggggttgggggtggaccaagcaggaaaagctttaacaaagcactgttcagaggcttcgctgaaataactcaagaaggactaactgctcaagaggatctagaaagccttccagcaatggcaacatttaatagcagctgtgaaagagaagtcaaagctcatcatgtagaattaggggtgaaaatattccaggcagaagaaactgtatgcaaaaggcacagaaaagcacacatttgagggaaatggccagaaaccccaggtggctgtgagaagtgaggcggggactagggcaatggcaggagaggaaactggagatgaaaaaggagtcagcatgtccctaagggccccaaataacaggctaagaaggtggagcttagctctgacagcaaagccagattttaagcagggaagtggcacagtcagagctgtggtttacagagattgccagcatggaggccaaggatgcactgggtagctggagaaggggtgatgctgcccgaggggatgagcaaggagagcagagaacagatgggagggaattctaggaggtttaaaccagtgacagtcaggaagagtaaagacggctttaatttttctcacctgtgcccttgttcttggttttcaaaaggttgactgggtttgactccaaatgggaaacttttgggggaagaccaagatggaggcgagtgaatgaagagaaggaaggcgctggggtggagagtctcacagaatagagcagtggttcccaaagtggaacccccaggccagcagcttcagcatcccctggtgtgctcggtgttccttacattaaacattacattaaacattgtgtatatgcacacacatacacaagcacacacatgccccagaaagaaaaaaaaaaggtttacaaaaaatccctgctgtgttttttgtttgtttgtttgtttttgttgttgttgtttttggaaaaaaagatatgtaagtggagggagagaaagagtttggacacctgagtaagctttcccatgaaaggcactgactcgggcgggcatctctgtggccctcaaaggagacagattatgatgtgagggcttgcagtgatacatttcatacagaaaggaatgtctcttctagtgagattcttaggtttagcaaatagacaacgtactggctatgataattagaaaaataagcaacaacatgctctagaataacatatggtgtgagtttgggggttataaatgtaatgagtgttcatcgtagaaattgtgtaaaagggccgggtgtggaggctcatgcctgtaatcccagcactttgggaggccgaggcaggaggatcacttgagctcaggagttcaagatcagcctgagcaatatagtgagacctcatctctactaaaaatataaaagttaggaaaaaattctgtaaaatgcagaaatatacaaataataaaatacgaaatcaccagaaattccaccacccagaggtaatgactgttaacattttttgctgtaaaaaattagaaccatatttttatatgttgacttggtatttttgctttttcaaaattaaccttatttttatcatttccaaaatcatgtaatattttttgaaaatataagcttaaatagctccataatattccatttacagaggtaacataacttacttaaccattctccagttgtggaagtttaagtcacgtaaagttttatgctgttataatccagtggtcctcatgttttagtggaggaatttgatccgtttatatttattatcaggttatgtttgctgttatttttcatcacatttcgtactgccttacttttcctttttgttagttattattgttggattttgttttgatcttttacattatgaagtatatattcttcactttttttctcaagtgatttagaaggtataattcctattttttctattagcagttaatttaaatttgaggggaaagtatacttattttctctagttatcactgtcaagaatgaaatgtcatctgttgatatcaccctatgaaagaaaaaaattttagcacacttgtacttcttgcttctttcctcacccccattccagttaacaacttttgttgatataatctaggatttcagacacattatgatgattattttactctttatattttgtttcttctcattcagaaattacattttccatttgtataactttacaatgatattaacagtatgattttcagacttgattctgttttgttggtttatttaccactagttagttctactataacacaaccccatatctgagttccttattttgatccaacactggttggatgcagttcatgagcacttaagtttttcaggaatagtaaataggtggttcgctttctcagcatgtctgagaacatctgtcctttgtagccacatgagttagctacaatgttttttactcaaaaatctatagatgcttttctgttgttttcagattttcatttctgcaaaggagaactctgcagccaattttattttttattagttattaggtatcatggacctagaatattacataaatttatatggtattatgtgaatcttataatttctgaaagatcacaggctatatgtctaagtattaaatgttttcatcaagttaacctaggactagtgagtgctttcaatgtacacaactgggaaaatgacttgtagaatttgtgattgtacttttctaccagttgtgtctgcagtgttctttctgcaggcacaactgctgaaactgagtaacgcttattagacatagagtagcgcttgggtttgctgtccatgtctcttctcttcttgtaatctccatctctttatccttttcttctgagctgtgggatagctttctttttcttttttatcattttttttttttttggaaacagggtatcaccaagagccagtatggatctcccctagcaaaaaatatggcaggaccaggtgcagtggttcactggttcaccctgtaatgtcagcttaggcaacatagtgagaccccatctctacaaaaaattgaaaattagtcaggcacagtgatgcatgcctttgggcccagccactcacgggggctgaggcagcaggattgcttgagcctgggaggtcgaggctgcagtgagccgtgatcgcaccactgcactccagcctgggcaacagagcgagaccctatccaaagttattccacagttcagaagaacaggataaagagatggagattacaagaagagaaaacacatggacagcaagcccaagcattacgctatacaccacagtagagccagttactcaacaaacatttactgagcacctactctgtgccaggtccttccttaggagctagagatcaactatgagccatgcagatcccatctctaccctcaaggagctgactgtttaggagttggaggtgtggacagagcagtagacattcagtgtagcggcaggtgcctcaacaacaggggcttgcaagacaagagggtgggtcttagttttgagtgatctggtgacacttggaggaagtgatgcatctggaagatccagtgagaccctaaggattctttcctgcattcaacaaatattcaatggactctggctctctgcccagtgctgttctaagcagagcagagaacaagaggagagcttccttgctagtagagaggcagacaccaagtaaacaaagaaaattatagcattattcacatagggaaatgttcagaaggtaaatcaagcagggtaaggagtccaagatggcaagaaggctgttctagtgagggtggacagagaaggcggctctggggaagccaagtctgggcagagcactgaaagaagagagaaagcatcctgggcaggaggaacagcaagaaccaaggtgctgaggccagaccagcaggaaggccagtgtgactgcagtggatggagagaggccagcggcagggaagggaaggtgggagccctgttccccaagcctcagaggtcaagggagggagtatgggtttgattccaggtggaaggaggagccaaggaagatttgaccaggtgagaggctagggatggaaaaggcaggtgtgtcacaatctgagaacaaactgcagggaggggactggagggtggaatcacaaagacctgcctggagggcggtgcagtggagatgtgacagtgggtgccagggaggtggtgatgagtaaggattcaccaggctgagctgagtctacatcttccaataattctgtgactgtaagcgtcccactcatctggggtaatatggactcacagtggcagagacattaccacagggctcaatgtgtgcctcagttacctatttattcataacaaaccacttgaaaactccaggacttagaaggaatgatggaattaggaaatcgccatctggcaaccagtgtggcaataatcgttttgggcaaaaatcttcactggatgccaaaactactgggcaaaagtatgagaaataggatagttactgaggctcagaatatctccaagaagataattatttctaaggggagaatagtaactctcagcagagaaatccagcagacaccacctcaaccaagtgagcaaaatctacatcaccgtgaatggaacacattgacatcttgtgcctctggacaaggacacaggataactttagtgtttctgccaaaactccaaatgagggacattccacaaagtaactggccagtgctcctctaaagcactgtgaaaggtcatgaaagacaaagaaaggcaaaaatgtctaaggaggtgtcccagattaaaggagactaaagaaacctgacagctagaggccttgtgggcttgtgagctagagtctggatgcctagaggacatcagtgggacagtcaagaaaattgcaaaagggctgcagataaaataatagtttgatgttggtgttaattccctgattttactcattgcactgggattatataagataatgttcttgtttttggaaatacacactgaaaatattgagaggtaaaaagaaaaaaaattagtgacttaaagcaacaataattaatcatttctcacagttctgtgggtgcctgagctgttcctttactgtttgtgtctggccttgctcatgcagccagaaggtccctcacacacctggtagtgggtgctgagctggctggtctccctcggttctcctcctcgtggcctctcatcctctggagcctggtctggtatctgtacatggctgtctcaggcacactccaagagaaggaaggtgaagctgcaaggcatcctgaggcctgggctctggtaccaacatggacaccacattctactggacaaagccagccccaaggccagcccagcctcacagtgtggggaatagactccacctcttcaggggaggagcgctgaagaatgtgtggctgtatttaatctccacacatgcctttaaggcatgtagttgtattactactgtattagggttccctagagggacagaactaatagggggaagagagagagagagagagagagagagagagagagagaaaggggagtttattaagtattaactcacatgattacaaggtcccacaataggctgtctgcaagctgaggatcaaggaaagccagtctgagtcccaaaactgaagaacttgcagtccgatgttcaacggcaggaagcatccagcacgggagaaagatgtaggctgagaggctaagccaggctcaccttttcacttttttctgcctgctttatattcactgtcagctgatcagattgggtccaccagattaagggtgggtctgcctttcccagcccactaactcaaatgttaatctcctttggcaacaccctcacagacacacccaggatcaatactttgcatccctttatccaatcaatttgacactcagtattagccatcacaactaccaccaaaatcatgccccttgtagtcaaccccttcctactcccctactcctggccaccaccaacctgttttctgtccctatagttttgccttttccagaatgtcatataaatggaatcatcctactatggtttgaatatgtcctccaaagctcatgtgttgaaaacttagtttccaatgcaatagggttgagaagtgggaccattaagaggtgattaggtcatgaggactctggccttgtcaatggattggtatcattatcccaggagtgtttttgttattgagagagtgggtttgttataaaagagagttcagccccctcttgctccctcttgctccctttgctccctcttgccctcccacctcctgccatgggatgatgcagtaagaaggccctctccagatactagcaccatgctcttggacttcccagcctccagaaccatgagccaataaatttctgttctttgtaaattatccagtctctggtattctgttatagcagcacagactaagacaggcattctttggtgaaatgcctgttcacattttttttttacattttttgaaagggttatttttcttattgagttttgagaatcctttatatattcttggcacaaagtttttctcaagatgcgtgttttgcaagtattttctcccagtctatagtttttgtttttattctcttaacagtgtctttcacaaagaagtaacgaaatccaatttctcaatcttttcttccatagatagtgcttttaacattgtatttaagaaatctttgcctcaaactcaagttcataaaggttttctcctgtattcttatataagttttatagcttttagttgttcatataggcctgtaatccattctgagatttgtttgttataaaatttgagatatgggttgagtttcatttttctgcatatgaatgttcaattgttctagcatcatttcttgaaaaatttattgcagagcaaattcacccagattatgtgtttatttgataggttgggtcaggagtgacagaaatgattaatgcctagggccaaacagcccccatgttcccacttggcatcaggttttagatttccaccctacccatgggcactgggcagtcagaccctgtcagagagacagtcgtccctggaccttgccaggccttacatagttactgtttaacaccccgcgtaaaaacaggattatcttataaccactgagggtttgaatgtggcttcaaagtctcagtgtgtgaacccaatctttattgtcagatatttcatgattgagagccaccaatgacctcttggactcctttgatattgagagaaaactcacaaggtgctgaaacaaggttctgaaggaaaggaagggagcctggcctagaggagttatagcagtgtctggacatgagagggcaggatttgttctaggcccccacatgagcaggatgaagctaggaactccaagcctggtggtgtgggcactcatccacccatgcaagcggctcatgcctttctttctgtggtgtggccatgggggctctgcctggtctttgccccagccattccacttctgggatttgtatcccaaggaaatacacaaacaagtggaccaggcttcatttcacagctttgtttaggatggcagaaagctggaaacagcctgagtgtctaacaattgattaaatgcattctgggctcattttcagagcagaacatcatgcagctctttaaggggtgatgcaaaggtctgtgattgggagagtgcctggggaatgccatagggtgagaagagtgggttacaggacagcacgtgtgtacaatggagacatttttggtaaatattagatgttcatgtaagcatagttattttgttgtttaccttaacaactgaggatccagtttgctctgtaatcagcccttaatctttgcagttgtagtgtctgggttttatttgatcagaagtcctgccctcttttcccactggacattttgttaggctcaccctgacaaaattcacactccctggctccccaccatcaccaacagcagggaacctcaagggcagggagcagagttgctactctcccattccacaccagccaggggctggcccagagtaagtgcttagtaagtgtctgtttcatacactacctcatgtggagcaccatcagggctgtgcacaaagcccaaaggaagtgcatagaggtggacagctgaatgcatggatccaggcatgatgtctgacatatttaacaacacaattgtcttggccctgatcaactattagttgctgaaatagaagatggaatgtggggtttggcagaagggctgggacagtggaggcattgagaaaggcattcaagcagcttgggacagtggcagtttgcctcccagcgaggatgaatttaaagagttcaacaactgacatggctgcatgtcatccacagatggatggacgaacagacaggtggctgagtaggaagataaaaagatgaaaggatggatgtaaggatgcatggaaggatggacagatgaatggatggaaggatggatggatggttggatggatggatggatggatggatggatggatggatggaaatatggaaatacggatggatgaatggaaggttggaaatatagatggatggaaggaaggaaggatggatggatgtagggtggatagatggaaggatggaaagatagacagaagaacggatggatgaatggatggttggatggaaggatggatagaaagtgggtgaatgaatagtagatagatagatgagaggaatggcagcaagagggatggatgaaaatgtggaatgaaagaaggatgaaggatgagtagaaagaggaggatggatgatggaaaggtaggagaatgcatggacaagtagaaagacaggaggatggaaggatgtttgcacagaggttgagtggtcgtggagaaaagccttttggtggtggcctggctctcagctctggacatccacaggtagtttcctggtcccctacatcatcatgcttatcgtggagggaatgccgctcttgtacctggaactggctgtggggcagcgcatgcggcagggcagcatcggcgcctggaggaccatcagcccgtacctcagtggtgtcggtacgtggggcccctccagtcctctcccacccagagacccgggcagcatgggggtgtgggtgggatcccatcagcaaagctgctggatcaaggggcgagcacaaggcccaagagagagctcttgcctggggtgaacaaatggcctggtggggatgacatagaatgtgggctgagaggagctgggtttcctacccacagggcggtaagacagggaggatgcatgccccttggggaacagatgccaccctccttctcttctctggacctcagcttggtcacctgtaaaagggaaacagctgtaactccaagtcctagctaacaaccattctggaaactcaccaacttctccctgctaaataacagctctcttttagcaagcacctactacatgctgggagccagcctataggatatatgtgcatgagctcatttaatcttctttacaccgctgaggtgttgtggagtgccattaatgtctctggggtgcggaagctgaggcccgcacggacagcaggagaggactgtttcatctcatgcttctcctgagtgaccttgagccagagccccaggcacttccaggacaacctccacctgccctgcacattgcttatgacccagggctgcctctgcatgcagaaggaaccctgaccagaagtggccatagcctgtgatgctcacccctcccaccccagaaaggaaggcaggcaggaaagcagagtgacgtttcaggagcaaagagggtggaagcttatatgtgacctggttgcagatgcagaagaaatgtgtccagtgttctcacaaatcatctccaaacccagactgcctccttgtcttgaatggctattaatttttttttttttttgaggcggagtttcgctcttattgcccaggctggagtgcaatggcacaatctcggctcactgcaacctccactcccggattcaaccgtttctcctgcctcagcctcctgatgagctggaattacaggcacccgccaccacacctggctaattttttgtatttttagtagagatggggtttcgctaggctattaatttttaacacagaagtgtgtagttttacaatctgcctgaataagcaatcacagaggacttctcagaggcatcttctgcatcataggaaagataccagatatttgtgccaaccaggggatgctggtgaatatttaacaaccagtgctcagagtggagtgggggtggggaggggaagccctggtttatagcatttgcggatgcctatggggtaaatacaggcaccatggccggtttctactaccgagtgtcccagcacttgcggctggggagaggaggggacgctggttctcaagggctggtgtgggccagccccagagccctgctgcctcccacccctctctgtgctctcaggccgcaccctgggttttgtgcaggcctgaccgaattacgggcagccccctccccaccgcctcctcacaccccctctcctggctaccaggtgactcaaccgctggtgagccaaggagggagcataactgtacatctggacaaggtagcacttcacagcaacagtgcttctcacagcatgaggttgtgaacccagttctgccacttaacagccgggtagtcttgggcaggctccaggcctcagttttctcttctgcgatatgaagataatactgttgtaaggaccaaaggtaaataaagtacttatttagcacagtgcctggcagttagatctcaaaaacatgtcatcagcctcctgtcccagaaggtgaggagggaggttggagaaaaagaaatcacccttcccaagtgttcacaggtgcctggtctcgcttaatactcaccacacaaacctggtggagggaggcctcgcccaccccggggcggtcgccacaggtgtgtcctgggagcacacgctgggcctggcggagggggaagggccatcctcggtcctcagcgcggccctctgcttcctcgcaggggtcgccagcgtggtggtctctttcttcctctccatgtactacaacgtcatcaacgcctgggccttctggtacctcttccactccttccaggtgagccggggggcccgtgccagaacaggagtaggagcgagaaagggagagaaaaacagggccacccgctcggggaagggggtgtggggcaaggtgagcagcctcggggcggggagccggtgggtggtgtgaggtggaggggaagccatgcaccccaaaccacgtgaagggcttctgaacccgggctccacgggccccttacgctgtaagcaagagtccaccggtgagagtgtgcgtgttcttggagagaaggtccctggctttcagtggattctctctgatggatgtgaccccacacacacactattaagaactactgcacagtgtgcctaggaggaaatctgtggagaggactggtggggagggattccctcaatccagcaagacagcaacggcctgtcctcttcctccccgtccccttctcccgctttcctcagggccactcgtgcttccaggtttctgactccagcctgagcctcttcttttccctgcagacccctaagttctcctagaaggaccattgtcaccctgtaacacaatagggccattcctaaacattttaaaccacacatttctgatgataactacagctgacactctgtagaaaagtggaaggggctagaattgtagagaagcaagaactccaattccacacagagagctggtgtacattcaggacaagaggaattttcctttccactgctcatgctcatttctgttacctggctcctaccgtttcactctcaggaaccccatcctccactgcccccacctgcttccaggaaccaccttcaccttggcttcttcccagttgggaacagtggaggaggcaggagctaaccaggccaatgccttaccctttgcccctgagccaggccttcatgggacatgcctgtccccaaggtccgcaagcaagatagggctggcatggactatggactgaactgggtttgcctctggggtgcttgggcatagccttgactctgtgggggcgtgaggaatgcttgggtgaatgactttaataatcctgatttggcataccccactctggcttcccaatgagctccaccaagcttgccccattgcacgtatctctggcaagaaagctgtaacctgagcttagttgcagtccctccttctttccctggttcaacctagagtttcatgaacactggccacaactctgcctctccccagccttctcagtggaaacagggcaactcttcttactctatagcctggtgactgtttcctgtcctctgtgcagggctcatgtatggttgggcagcttgtgcactgcacaacagtactgccaactaagggcttgccatacacattgtaagcattatagatttgtatacttattaagacaagtttccaaaagtggaagtaatgtgtcttgtcctaacaaaatcagaataatttgctcatcccccaaaagcaaaaataaagtgcctcaagaaaggggcatctttttctaatagtcagaagtatgggggccagcgattcatgaaaatcacttaaatattcattcattccatccttcataggtctgtggacttatcccttagtccctctactttgaagccctcctccatggtcccataataatgagaggaatagtagctgcagacattcacttacatgtgctttgggccagacataggtcccagcactttagaagtgttcactcatgtaatcaaaacagccaccccacgaggctgagcacactgagcacccgagcagaggggagccgagtagctcatagctggtggggttggactcagggacctggccccggagtctgtgctcctgtctactcactccctggccaggctttccagccttgtgtccagcccttctcagcaggagcacctgggctgttatgcacacaaatgcggggatccttgtcctcacctgctggttcagaggtgagtgagggaggtcagactgggaactggcccatttaacaagttctcctatacgctaaaccttcttcaacctggctgcacactggggagatgaagttgcggggtgcggggtgcagggtggggaggtgtgaaaaatccaatgaccaggccctatcccaaacagatgaaatcagagtcactgggggtgcagcctgggcatcacccccgggtgccttagtcgtgtagccaagcctgggaagcaggcccggtctggcatcagcaggtagtccagggaacagactcaggtcagtcccacacaggctgtaaatggcccaaggggatgtcagcctaggcagctcaactgggcttcaggtctaccaggacccctgtcacctgcctgggacttggtgctggctgccactgggcacctcagttccctccacgtgcctccctctccctgcacccgcatcattcaggaagctagcctggatgtcccacagctggtctccaagagggtgagaggctagctacagggttctgaagtcctgggccgggaagtcactcacacagcatctcttcaccatattcagttggtcagcttgcatcggaggacagcccagactcacaggctgaggcaagagacaccacttctggatgggagaaatgtgcacatgggaaggggaaggactgttggtggccagctttgaacacgatatgggtcaaagcaagaaaccagctcacacattccaataggctagggtggcctggggaggtattgcaggggtgggcgtggaggtcctcaccaggacagtcctgagcactgtctgggtgtgcagacctgggctccagctgcctactggcacagtagccatgacccattaggtgataccccgggccttggttctgtctcctgtgaaatatgggattgagcccagtggggtggtcagacttgcttccattaatgatgcgtttttgtctaattaaatctgggcttgtagaacccagatatgtgcaaaactgatcaatgtggggctggtcctcaaagagcagggttggggtctcctaccccacagtcagaagtaacttttcctcccctccctcccatctcagcaccactgtttaccacttggcctcgggtcatggtcatgatgcatgcaccattgaggctcctttgttcataagtgacacgccagcagcctcctatgggggcacacctggagccttctcttttctcactaacaagctttcccaatccccgcctgccttggagccccgccaaatgcaagcgatgctgctatcgcccttgctgtagcaagtcctaagtaaacagcctctgcttgttctcacttgggtggtctttgctgatttcctcaagtcctgagatgcgtaagtctcaggttctgtgctcactaagtgctggtggcgaatggcatttcctgcaatgtacattgggtttggaagctagcaggagatgaggttcaggccccacagctgtcctgcatgtctgagcccgagagaacctggtgctggtgacttctttgagctagagtcaagctatacctgaagcagttagactcctggactttgcagggtggagccagtaagactctcatctgcttaagctactctgaactgggctctctgtcactttctctggttggttctgagttggccaaaaaatagggactctctcaatcattgaccaagtcctaagcaatctgggccagtgctgcagagggtgtggtttaagtgcctgagctgattgtgcacaggccgtgggtcggagttccatcatcagggctggcctggctgtggtccatttgctattcagtctctgggacccaccacagagttcagtagtcctcaaggaacacccgtagaattgcaacgagagtagagccccctcctccaaccccttcctgcctcacccgtgccccctgacaaactctccaactcccagtctgccttcaggggctccagccacctgcccttcggggaccagcacccttctcttccaagagtctccgctcagggccacctccctcacccctgccacagcctttgtcctcagccttcacctccctggataacacttgctttggtcccacaggatcccctgccgtggtctgtctgcccactgaatggtaaccacacgggctacgatgaggagtgtgagaaggcgtcctccacacagtacttctggtacaggaaaaccctcaatatctcgccgtccctccaggagaacgggggtgtgcagtgggagccggcgctgtgcctcctcctggcctggctggtggtgtacctgtgcatcctgcgtggcaccgagtccactggcaaggtgggacagtgaggcacagaagcccggtgctcctggtgggtgggagggtgcaccaaggggcagctgcctctgtctccaaccctaggcaatgccaagggagtgccctctgcagtggaaaggcagcagctatgttagggcagagggcacagatggtgttgctgggacaagtcacctactagatgactatagagagggccagagatggttaaagttgcaaccctaaatctcaaaacaaggactttcttagaaaaaaaaagtttttctgtagcagtcagccccaaatccataccacccagacaaccagacagtgagtttgcttttctttaagattgtatgtatcctcgagacaccctagccactggctctccaactcagctgcacattggtattttctggagagttttcaaaaatctcatgccttagccccgccccccaaaattctgcagtaaccagtctggggtgtgtcctgagcactgggtggggaggcaggggaggtttaaaagctcgccaggtgattctaatttgcagctgagtttgagaccctttgttctaagctgcttccaatcaccctccagagctgtcgggcttgatctccataatcctttcttggtgcatcccaaggctcacactttcactggggctgacatgttccttcatctctagtctgctccacgtagaaggtttgctttcagtgttcccatcacccgccacctgcctgaagcttcagcagatgtctcggagcctagcacaccctgtctcattcactgtcacttctcacagtagacccaccacggcttgagcacccacattgtgtcattctggcaacagcctttcatggtagatttcatgatcccagttacctgaagcttagagaggtaaattgacctgcccaagggcacagctagtgagggcaaagcccagcctcaccccaagacttcccattgtcttggtttggtagccacatagctctctctatgccttaatgatgtcatcaattccaactgtcacctgctgagagtcctaggagcccacctgtcctcaccctctgactacctgagttgtctcctccagccacaccccaccccccatgtatttcttgaggcattagaccagagctacccatggtattccagggcccatgggacaactccagtatcatgcctggtagggcattttattttggtttctaagagcccctgatgaccagcctcttagcccccaaagtcccctgtgccatggctgaggaaagggacgagtgagcacaggtgctctttccccgagagagcttagaacctgcagcagcccactcagtcccatcgtagagcctggccatactgtcatgctcataaaaaatgtttttgtaatttatgtttgccagattattatgatcatgatccaagagatcagagggcaacatctgcagaggtagagattagagaccattccttttcccaatcactttgaaatgtgttgcataagaccatgtcatgccataaaaacttatttattcttatcatctatttcctctgcttcagctacacccttctccctgggaaaagtaccccaacagctctatgtaaatagagctaatcttgtcacagaccatgtgccatttcctggcatcctctgttggaatcgactttgtttcctgccagaatctctgcagagtggtcagaattggtttcttccaatagattaggctggatcacgtgtccagcaattctgcccacttagggactccatgagcctccaggaaacttgctcaccttgggggaaggagggaaattctcggggctggccctaagggcctgcttagtgcccattgtgatggatgttggtcacgagtgagtgctctgtcttttcatctctcttacctggtttcttataatcttgggtggatttattactcttctcaagttacaacaacctcagctaagaagcagtgataaaagacacaccccacattccacctgccgtcccctgggtgacagcgtacagagtgccattctggtggccttggaaatggatgagaagatgatgccacacctcaataggaagggggagggccaagtgtaattcaagcccacctgaacataggccaccagccatatttctcacagagagactcaaactttaagggaactcttacacaaaagacaatcttgcaaaatatttatttcctttacaaatgaggctctggtacacatatgagttgatttacagaaaaaaatccattcctggataggcacacgtgcacttgaaggtctgtattctatggctttgtaacagttagaatcacccagagcatgacaggtgactactaaagctaccatgaacaccaaagatattaacaaaacatcattgaacttacgatgcatgtcggtggagaaagaagatctggttgacaaaaatgtccattcaggtgtaatgttaaagcctaaggaagtaaaccctttctggagggttgccataaaaatcagatctgaatttcctattgtgtttattatggggacattgtcctctacgctacacctcgctgctttcctgtatgagcactcgtgaccaatctgctctcaggccccagtcctggggaaatctgtcctcctccaagctgcagatttttttttccttttaattgtgttcctgctttgtgtgtaggccaccaggaagctcagagctgaatctggctcagaaactgggtagagacttatgcacagattctatgggctgctttttcctgtgggctcattactggattgcccatatatttttttcatgctgatttctttagcaattttgaaatgttaacgtgactgatgtgtttttgtgggtaacctcaaatcctttccagaataaggtcaggttgaagggagggtggaaggcagaggctcggtacctgtttgcctcttctctactgaataagaaatgtcgtgctggtcacagctgtgagcgaccacatcccaccagcccacttccccagccctaacccagagcctgtgtgtgaccaagaatctccatgccttttccagctgtcagcagctgggcggtgcagcctgaataccccagatgtggtgttccatggggcatgggtctgtcctgtggaccccactgctccgggaggccaactctgccctctgatgcccgcaggtggtgtatttcacggcgtcactgccctattgcgtgctcatcatctacctcatcaggggcctcacgctccacggagccaccaatggcctcatgtacatgttcactcccaaggtacgggctgaagcggaagggccctacgggcacccctcacttatcctgccaccttccaggatgggtgggaagagggaaaggtggagagtgggccaacgctgtacctacggaagctgatgtgagcccaccagggtgtggcaggagtgtggagtacctgcagtcactggatcacctcctcagccaggtcatccccactccctgttaattctggagcattaagtctttctttcagcttctcctcttcatcctcactgtcccccaactgctgcacccctgccactgcctcacctcaagcccctttcagactgtggaccaagctttttgccatgagcaccactctggtcatcttgcttgcctgcttacatggttccacgcacccgtttccctacagagtttcccaacccacccattctccatgcaccccacacccagggttcatccatggagggtgcactcttgcctttgggatggggcaagttcttcatttggcaaatgcagtccctagaaataaaatgactgtgtcatccttccccttccccattccagacgccaccgatgtcagtgccgagagtcaacccacacctagacctcccctgccaggccacaccccctccatctctgaatgcccagacctgtgcagtaactgcctatgaatcagggccccatttgtgttttaattattttaccctgcagtattccattgcacacctccgcactggcgtatagtggtgagcatagctgcttctggttacacacctcctatggctgaggtgctatggaggatacgtagcaccttatgtcctccacatagcacctgtattctccacagcaccttagccctgggaggtgtgcagcttgaggtgtgtgtttcatctgccagggagtggatggggccaggagagctggtctccagccctaggggtgcccctgatggctgcgtgctgtaggtgagctccttcccctctctgggctactctcctgttgcgggtctgagcatttgggattccacccagggatcatcagccctgtccctgctggccttccagatagagcagctggccaaccccaaggcctggatcaatgcagccacccagatcttcttctcacttggcctgggcttcggcagcctgatcgccttcgccagctacaatgagccatccaacaactgccagaagcacgccatcatcgtgtccctcatcaacagcttcacctccatatttgccagcattgtcaccttctccatctatggcttcaaggccaccttcaattatgaaaactgcttgaagaagtaagcctgggctgtcccaccgagtcccaggcctccctgagctctgagctgaagggtcgcctgggcaagggctggggcaaagtgcaccagttttggagtcctcaatccagggctcacatttggactccctacaccaccaccagttgctggagggcctggggcatgtcaacatctgcctggcagggatgagggcacgttagcgtgttgtgagcacttagcataataggacatacaacgatcaaattttgtttcttctaccccatctcccccacctcagaagtaaccaagaagcctctagctgagccacagagattgcaggattcactttctgtggccccttgcccaaaatacaaagacatcatccaggaggtatgctgtccagttgggtagtcactagccacaagtggctatttacaaatttacatttaaatcaatgcaacttaattcacatttaaataacttaattcatatttcagtacattcccttgttactttcaatcagttgctcagtgtccaccattaagtgctcagttgccatatgtggccagtgagtaccaaattggacagcccagatagagagcattttcatcagcacagaaacttccgctggactatgttggtccagaggttaaaatagcctagctgtgtgagtttggtgcctgttgtcatcactgttcatatctgaggcttcttcagtgccattcaaaattaccctgccctttaaaagatcaccaagcaacagactccctttcctcacctaatcagaaaagaagaggctgacgggaggctttggtgacagctgcctttctgatcagtgaaggtcgatccgatggtctgctctgcagggtgagtctgctgctgaccaacacttttgaccttgaagatggctttttgacagccagcaacctggagcaggtgaagggctacctcgcatctgcctacccaagcaaatacagcgagatgttcccgcaaatcaaaaactgcagcttggaatcggagctagacacggtaagatgcccaggcaaggtcaaggactggcttctctccacacactcatgggaaccttggtgagctgctgacttgggagataggcgaggtctgtaaaaataaagaaggatcctgaattacttttcctgcaactccaaggggaagagaggctttaacaccactctcttgagggctgttcgagaatgctagttataataaacttcctggcggacctctctgtcctttctctctttttcttttgtctttctaagcttttaaaatacagaaaagtagagagaataacaaacacccatatataccactcagaaagatcaattgtaaacattttgtcattttgggctcagatttttttatataaaagaacatttcagagatgaagttaaaaagtccccctttttttccctactcaccaaaggcaagaaccttcatttttatatttctattacccatctatgtattcttaaataatatcattgttttgttggcagtttttgttttattttttcttttttcaacaagccttttgcactcctatgtcagcagtttttaaatgggcataaatggtctggaaagatacttctctcattcagcattttaattttgagatctgtccataataatacatgtggaacctcatttgttcatttaaatgctgcattttatttatccattcccttactaatagacatttggagggttttttttttaatttttgctactgaaagtcacctttatttatattttacagaattatctctgctgtgctgggacctttattttttcacattgttttgaggatcagtttgataagtttcattggaaaaaaaaaatctagggaatttttactagacttgcattgattttatagtgtaatttggggagaattaatatcttttgaattgtgatatttgactcaggaacatactttctcttgttcagtcaagtcttttaaaacattcttcagctaactttctctatgaatgtcttggcacatctttcattagatttctattaccttactgttttattgtattgtgaatggtgttttttcccctcatttctatcatttgtttttgttgcaaaagaaagctaaatattttatatgttgaccttgtatctagcaatcttgatgaattctcttattaattctcatatttatgtatagatttgcttcagttttctatgtaaactatcatatctcctgcagatcaaattttgcatttttcttttcaatgcttatatctcattccctttttcttattgtattcactaggacttctagcacatgggagtagaagtgatagtgggcatatttgcctaattcttatatttaatgcaaatacttctagagattattcctagagagtgttcctaggtaatgtttttcaaggatagggagtagggagggcctgtggctctggttgctagtaagctactttggaggttgatatttttggggtggttggttggttgggtttggtttgtttggcactttgtttcatgggtacaaccactgtaggtcatttcatgggtgggacaatgcttttttctcctggttgttcagccctagctccatgcttgttattggcctgtggcatgagcctgcttccccaggcaggcatcagaccccagcccacaaaccccagccctcaaggcctaggtcctgttcaggtgacccatgaggtcctttggcttcagcacttgttcagtgctctcacttcaactttcctttatggatggcacctgggagttttcctcacttacttttgagcttggctctacagccaagaattacatggttggttattgatttatctagacttcatttttcctgttgctttgttcttttttttttctttcttttctttccccattccactttattccctgctgtttggaatttggttgcttgatttctcttcttgaaattttcctttcatatttaacttaataaagtctaaagttaaacagtatcttgacctccttcccaaaattcaaaaggactttagagtactttcattttatctcccattttaaatgattgttttctagttctgtctccttaaccccatacattggacatgacattatggttattttatacagctcttgtatttacctacatgtttgccattttatttgttcaccattctttcttgcatcccagcatctccaaaggtttttccttaaaatactttcatttagaacagttttcttaaattttgttctataattggcatctatcttttaaagacattgttcctcggagtagaaaattccaggttaacaattattttctctcaacactttgaagatgtttgccatgtgattcaggcttccattgttgctcttgatattttcttttattctttgtaagcaagcagctttttctctttctcatgatcttctcttcgtctttggcctctgcaatctagacatggcatgaatatatttttatttatccactctaggcctgggtgaggttgggcttcctggatctaagggtccaatgtttcttatcagttttggaaaattcatacctattatctcataatcgttgtctctgattctctcatttttctccttttggaacttcattagatgtgactttttcatcctgtcctacaggtctcttaacctctcttttatttttcccatctttttatccttttttattttattgattcatttctggatatatctttcagttcactaactctcttttcagctgcatctaatctggtatttaactgtcaattgagccttttaattcaataactatattttttatatagatgctatttttttcagatttacttgtccatcccaatagtttattgatacatgtttatttttgtaatgttatcctttgtttctttaaacatttcatacgtaactgtttcagtggtggccataggcaagagaaggagagcagtattttaacactatttagaattgctggctcatgataatcataaaaagtatatcaactttttgtagatttttactattgtttttaagttctctacaagtgatcactcccttgttgtcagcacataaagccaactattttcagtatgcccctgagcaactggtatactatagaattgacctgtgttcttatattagtcagtgcagcctgccataacaaaatataggctgggtggcttaaacaacataaatttattttcttttatttacttttagtagagacaaggtcttgctatgttgcgcaggctgatctcaaactcctgagctcaagtgatcctcccacctaagcctcccaaagtgctgggattacaggcatgagccgctgtgcccagcaaaaaacaggaatttgtctctcaatcctagaggctgagaagtccaagatcaagggccagcagggtttggtttctgatgaagacctatttcctggttcgtgaacacctatcttctcactgtgtcctcacataatagagagttctctctctctctcttcctcttgttataaggctacagtctggtcagattagggctccaatattataactcaatttaaccttaattaccccctaaagaccctatctccagatacagtcacattgggagctagggtttcaacatacaaatttcaggtggacatggttcagtccatagcaattctgaatctgacagtccaacatctgccacctcggggagggatgttctaaatctgatttcttatcttgctagttcttcactcatagtgacttctctccttgtgggtttgtaaatccctgtttatgagcactttgctcaatctctgggaatcctgtgcatctaaaccgggtgggggggcttctacccagggagggcttgtttttgcttcttctgtgggtagccagagagtacgcacaacctattatcccttttgagccccttaggggatttgtctttaagcaggagttccagcctcaatttccatagtttaacatttccgcaacagagttaccagcacagggacgtgaccgctgagcacctgcccctcctggttgcctgctgaccaagctgtctccctacaattctgcttcctgctgccctggccccgccctccctcctcaggtcccagccacggaggtttcaggacacctagtcggtcatcacattagaagcagaaattatccattgttttattatctttcatccagaatgtacgtaagttggggcaggagaggggaactcagtgttgcaggctggctacaagttctcacgtgctttgcatatatgagctcctggcagctcccatttcgtttcagcccagctgagtgtaaggggttgatctgcagatggaagctccaacctcacaatgtggcttctcatggccacttccaaggtcccccatgttgcttagtactgagtgcgtgaataagactataagtccctcttgcatgtaactggtgtcttctcaccctgggcaggccgtccagggcactggcctggcattcatcgtctacacagaggccattaaaaacatggaggtgtcccagctgtggtcggtgctctacttcttcatgctgctgatgctgggcattgggagcatgctggggaacacagcggccatcctcacccctctgacagacagcaagatcatctccagccacctgcccaaggaggccatctcaggtcagcggggccagccagtggaggaggcaggggtcaggagggccaaggcgtgggggtgaacaggggagagctccctcaggggtcatgggctggttcaggtggctacagggggttgcagccacctcaccacggtcctgccatgtcttctcacaacctgggacctgggccatgtgattcaccctgtgcgttccattctccacatcacagggaagtgaagtggccaccccaacccaactccccaacctgacattcaaagttctccaggctaggagagaactcgattttgtttctgttcattttcattgaagtatattatatatatttcagacggagtctcgctctgttgcccaggctggagttcagtggcgtgatcttggctcactgcaacctccatctcccaggttcaagtgattctcctgcctcaccctcccgagtagctgggattacaggtgcacgccatgacacctggctaatttttgtatttttagtagagaaggggtttcaccatgttggccaggctggtctcgaactcctgaccccaggtgattcgcccatctcagcctccgaaagtgctgggattacaggtgtgagccaccacacctggcctgaagtatgaccattataaagtgtacatttcttaagtacaaactcagtggattttacatatgtatccacccaaggaaccaccacctaggtcaagatacagaacattttccacaccctagacagttccttcacaccccttcccaggcagtatgcacccctggagttcacctctattctgacttctacattttaggggtttttttccttttttttttttttttgtttttaaagaaacagtctcactctgtcacccaggctggagtgcaatggtgcgatcttggctcactgcaacctccacctcccaggctcaagctattctcgtgcctcatcctcctgagtagctgggattataggtgcacaccatgatgcctggctaatttttgtattttagtaaagatggggtttccccgtgttggccaggctggtctcaaactcctgacctcaagtgatctgcctgccttggcctcccaaaatactgggattacaggcatgagtcattgcgcctggccttcctgttcctgaatttcatatgaacgaagtcctattgtacacactctacgtctattgtcttcactcagaatctacctgtgagatccactcatgttgtttcgagcagcgatcgtctgcccctttttgtgcctatacaataatccattgtaaggtgacataccacagtttctttatccattctgctgttgatggacatttcagatcttaggaaatgagctggcttttccaattacatctctcatggtttcactccctggcccatctgctccactccaatcaggcagtgcctcaaggaccctgtggcctacactactccgtctctgaaaacaccattccttgacatgcaggatgaatcaaacccagctcccaggccatctccttcaagccccgaccactccagttggagttgcccccacctcttcagagtgctgcagcacttagaccccctcctcaggcctggtctttgtagccaacactaggtgtgcccatagccttcagccagcgcatggcccctttctccttgtgtgtccccgtcgggatagcaggagggctcggtagctggcagtgtacggtgtgctagtggaaagggcaggtgtgggctctagactcagacatgcatggggtccccagggaaggcagctggaggggcctgggatgaaggcccaggttctggaggctaaagggcctgggtctgaatcctcactctgccatggatgtgctatgggatgtcgggggagccttagacatctctgagccttgccttcccatctgtgaaagggggctccggacacctgcctcagaggcctaagggtccaacgcattgcaagtgcctggcacaagggaggatctgggtggacatttgtctcttccctgccccaccctcttctgggtggaggcaagtcctctctaggaagtcctgatggggccactccatattcaagcctcctcccctgattcatttctcatgagctccagggctgagttgttgggataaacagcgggggttataattgtagacccacagcctgggcgggatcctggaatgacagtgcccactacgtctgcttgttcattgagctttaagctctgccacccctgcagggcagctcagtgagtcaacatcagtgacccctgccaacacgcttcgggacaccattgtgccccctgccccacacacgtggcacacaccttcagagagtccaaaccatgacagctctttcaacccatgtggatgaagcaatcagccaaaattccctgagggccgacgaccccactgtcctgtagagaactggtaagcagtagtgggggggtctcgggcaggtgagcagctggtcttgtggcccccaggtctggtgtgccttgtcaactgtgccattggcatggtgttcacgatggaggctgggaactactggtttgacatattcaacgactacgcggccacactgtccctgctgctcatcgtgctggtggagacgattgccgtgtgctacgtgtacgggctgaggaggtgaggaggcccaggaccctcatttgcatagggaaaacacagccacagaggccacgcccctcaaggaaaacagctgtttcttgatgcacatcttcacctcttctttaagcttcgcatcatgactcaacgtttgttctttgcccgcagatctcagcttatgctctgcctctattccatgctcagtttgcttcagtgaatatctttttctctattccctgtacttttgctttgtatcataggctgttttagggttgaccctgctggacccccacagcttactggggcagggaattgtgcctccaggcactggatgctctgatcatcggccaacatcagtattttccaagaaccctgaccaaagtccagttgataacttagaccttagaaaatttggcagattcaaaatttagtcagtgaggttctcaatcccagtgcacagcacgggactggaatgttttagttctccccaggtgatggaatgtgcagctggggcaagagccactggtctagagcaaccttcaaactcgagtgtgcctcagagtcccttgggctggtcaaacacagctgtgagactcacccccagggttctgatcaggcaggccaggggagggccaagaattcacatttctagcaggttcccagatgagtctggcacccacactttgagaaccactggcctagagagctttgctacctcaagtgtggtccctagagcgggagcagcagcaacaaggcgctcgttgggactgcagaagctcgggcccaccccatcctgctgaatcagatcctgtatcttcacactatgtccagggggcctgaggcacatcacagtttgggcagcgctgctctagtgggtgcggtttgggcgaggaggctgtgccacgttgttttctgccctcttccccagtctttttgatcctctgtgctggttcagggtggggagggagacattgacaacactctgggaggcaggcatccctgaagcagcaatccctgctgtgtccccggaaaggccagggtcccgtgccatgctgagggatctcccatgatccatcaggacataagttaaacaaagccaaattgatgtctttcccgtaggacttctcagaatcttaaagacagttgtggatcccaaagagagggttagaattgcagcatttccagacttacttggtcaaggaatgccttttcaccctcctctcacccgactcccacccttagctactaacattttgaggacactagtgttaaggggaccaactctccctgtttccccaggattgaggggttttctgggacgtggaactttcagtactaaaattgggaaaatccctggtcacctaggaaatgccagtctagagggagaaagagattggtcactgagagggtgagtgtttcaggataaaaagagaaggttgggagagaggaacagaacctagggcccgctggaggtcactagatgggtgaggggcacaagtccatcaaaaaggggctggtgaagggagacagaggcagaaacaaacgtgccttggagatgtcgtaggtggactgaccatgtaagtggcaggaggggagtgcttcggcttgctcaggtgacaccgccatctagtgaccacccagcaacagtgtcctggggcttttctgcagccagctcttcccaactttctccatccaggaaaggggggggggttatgggggtgtgaagggacaagaggacccccaacactttttcacctgtctgattttgaaagccccaggttttcgtgtcacatacatgagccttcatggcctgcagcctagagtccaactacgtcagcagcagcaaagggcaggtggtggtcgccacacagcctcgcatggacacccaggacatgcagcaggtcccagggagggaggggctgtggctgcagctggtgacgtcacacccacaccaccccagcccctcccgccaaggctgcctcttccgctgtagggagcaggtttaaaggctctgggctggaggcaggaggccaacccaggttctgggcctggtctttaccaagccctaaggaagaaggcatcgcagccctgggccttggttcctcctgtgtgaaatggggagtttcgttgggccaacatctcccaaaatgccaaagatactttttatactgtgtacgtgtattcaaaaacacacgtacttagtttgtcaagtcgatgagaaactggctgctgttgtgctgctgctaaccgtaggtttaaaagtaaagaagagggaaaagagagctacaggcatgatggaggtggtgatggtggctgtgggcaacgcctttgggactcactgccctggccactctagaccagctccagcaggccagggctacggtccttcagtccgaggttggctcttcctctgtcccagaaaacctgctctggtttcaatggaccaagtgattctgctccgtggtgtttctactgggaaagggagtcactgattgacaggggcgggctgggtaggggggtgggcaaagccgcccaagaagtccctgtcattgatgaccagcctgacaaatgtccatcccctgctgcctgtgcccaccattcctggaggctgccctctgggctatgccagcagccttcatctgaaggctggcattaggaaggcgtcttctgatgtccactctctgcgggttgcttgctccgtcatcccttctgggcagcctcagcccttctcccctccccaccgcagcactcgtctctcaagaaggtgtcacagaggagcccagtggccaagctcagacatcctttaccacctagaacagaatgttcctttgtgaatagggacaggcaagctggacgccctgacctccgcagcctggttaatccagactttctctccctgttttccaaatagatttgaaagtgaccttaaggccatgaccggccgagctgtgagctggtactggaaggtgatgtgggctggcgtaagcccactgctgattgtcagcctctttgtcttctacctgagcgactacatcctcacggggaccctgaagtatcaagcctgggacgcctcccaggtatctactgtctccgtagggctggcgctgggcccccatggccactgaaaagcatgggccattcattttccgaaaccaggggactatttccatggtgtgggtaggttatttgtcacgacatggaaatatcactgaggtattttagaaatagtccagcacggaggagctgggctttgagcttttaggtatgtgcttcagtggggcgagaggaaggcactcctccagagcttccccatccacctgtcccccggaagctgagaaaaactcccgctgcaaaggcgccagctcctgcctcctgagcagcgctctcctccgcgcctaccgcagcagacagcactgacagagaacgttgctaccttcacgggaaagtcccattccaggctaagagtagtcgcctacagtttaggttccctgaaagttgccttagacataaggtgcttgattattaccatggttattcattatgggtagctccaaacaatagctctacacccactggttcaagtagttactattattcctagtttatggaagaaaaagaaggtgagggcagttaggctcctggcacatttgctagtgaattgcagagcccgtggccccaggagtgaggacaccggccccacatgctctctgcccacgtcacatcacctccccatcacggatgggccctgaggcccaggggcagtgctcagcaggtgctctctgctgacactcagtctctcctttcagggccagctcgtgaccaaagattacccggcctatgcactggctgtcatcgggctgcttgtggcctcctccaccatgtgcatccccctggcggccctggggacttttgttcagcgtcgcctcaagaggggagacgcagaccccgtggcctgagatgtgggcttcccagccgctcacggttttacagatactatttacaggcggaaactcctcggctgctttttcaaatgcttaagccaggagtgctcagcccatcaacttcctgagtgtctaaagaagatgaggaaggtgtgcaggaagaaaactcccttgggagaacgcacaccctcccgtggtggctgttcctccctgtcacctgcctcctcatcatggaagggggtgggctatgaaagccggtctcaaagataactgcatccttcattccaggaaagccctagaattagggcacattgcaaactgaaatatgactataattcttatgggaccaaatttaagcaatttttgtttttggctgaagagacaccaaaatattagaggacaaatatttttagatccatttaaggagttttgaagtgcctaagatgacctatttgtcagtggtgcaaaattaattctcttcttttttgagttgtagtgaatatgcaatttctgtgttccccttccaccctttaaatcttaggatgacaagttataaagaaagaagatctttgtctgggacccccaaagggatcctttctctaaggtctctgacagtgggtccaggaccagacctctctacaaaaaattgccccaactacagtttgcaaccccaaaccacattagaagtctgtgcagacatccctccgtggtgtgtgtcttggtgcattggaaaaggagtcaggagccactgtgaggtgagaatgaaagtggatctcagctgggcacggtggctcacgcctgtaatcctagcaccttgggggtcaaggtgggtggatcacttgaggtcaggagtttgaggccagcctggccaacatggcgaaaccccatttctactaaaaatacaaaaaaattagctgggagtggtggcataggcctgtaattccagctactctggctgctgaggcacaagaatcatttgaacctaggaggtggcggttgctgtgagccaagatcatgccactccactccagtctgggcgacagagcaagactctgactcaaaaaaaaaaaaaaaaaaaagtggctctgactttcccataggcttaatattacatttggacatcgtggccaactctatcaagaccacaaataccacttacaattaattttaaattattcatctgtacatagttttctaaaatgtatataattcaaacagagcatcttgtaactgaagacacaccatatctatgatatcgcattagtccatgtggggaaaagaaagatcagattgttactgtgtctgtgtagaaaaggaagacataagaaactccattttgatctgtactaagaaaaattgtttctgctttgagatgttgttagcctataactttagccccaactctgtgctcacagaaacatgcgctgtaatgaatcaaagtttaatggatttagggctgtgcaggatgtgccttgttaacaatatgtttgcaggctgtatgcttggtagaagtcatcgccattctccattctcgattaaccagggacacaatgcacagcagaaagctgcagggacctctgcccaagaaagcctgggtattgtccaaggtttcccccccactgagacagcctgagatatggcctcatgggaagggaaagacctgactgtcccccagcccgacacctgtaaagggtcggtgctgaggaggaatagtgaaggagggaggcctctttgcagttgagataagaggaaggcttctgtctcctgcttgtccctggtaatggaatgtctcggtgtaaagctgaccattcccattcgttctattctgagataggagaaaaccgccctgtggctggaggtgagatatgctggcagcaatactgctctgttactccttgctacactgagatgtttgggtaaagagaaacataaatctagcctacgtgcacatctgggcacagtacctttccttgaacttattcgtgatacagattcctttgctcacatgtttccctgctgaccttcttcccacctgttgccctgctacactcccctcgctaagacagtaaaaataatgatcaataaatactgagggaactcagaggccagcgccggtgcgggtcctccacatgctgagcgccggtcctgggcccactgttctttctctatactttgtctctgtgtcttatttcttttctcaaaaaaatttttctttttttaactgcaataaagtaggtcgttacccctaaagtgagcgagtcccttcctgctctaacgtccagtgcttccttgagatcatggaattctggagagtttctgtggatatatttgcacagatatctttgaagacacaaacactcacctgggacgttggccggagatgtctttttatttttgtgctgtaaaattctcttacagcaaaaataggctttagaaaggtcttctactgtcttcagcaaccatctcatcttccagcttcacctgattgtccagttatcatacatttgactttcaaatgtatgaaccagcatgtaccccatggatttaatcttatctaccccgtggattcaatcttcttatcagaaggttcttttatgtcaaaaaacctgctgtcaaggcttgaagagccggcacactcaatggcaaacacagcaccgagtctgctctgaatcctggaggatctggccctcctctcaacccccactcacagtcaccgtcttacaactcagggccacctgggatcagtcatcagtcagggtgcgtaagccttgaataccaggtagcctcaggagtgaaaagataaatgtcctagatcattaccttattcagtgtccccaccttgcagcgcattccaaccacctgggagcatttaaaactccagatgcccacaccacaccctggggccacccatcagaccttctggaagcaagacctgggcctccatggccccaaaaactccctaggtgatccgatgtgcagccaaatctgagaggccccatttaaaaaagaaagaacatgggtggtacattgaggagtatttacattttataaaatgacttaaaaatttgaaggcatttttgagcatttccaattatatggaagagttacttctacggaatagtttttgctcatggaactcaaacagatgaagcaccactgttacagaataatgtgctccagatgaaaatgtctcgtttctgtgaatttcatgaagagcagaacatttctcaagaatcctcttgagccagtaatcaatcctgtctcaaaaaatgttctttgccatttcctagatactgcacaaaagtggccatgtcgacatttgtccacccaccctccaataagctggagcgacaaagggacattccatccctgtacccttagtggtagccatgacacgatggccagatcatggactccggaaagctttctgtttttactggaaacatagcaaaccttgatttagctccaagaaattgagtagggaaatatttgttttttagcaattgtcatagtaaataaaactctaagcaaatgtatctacagtttttggttttgggttttgcttttgtcacttactggatacagtttaagacttctctcaacacaagattttctctcatgtagaaacacaagctaattttgaaaaaatggaaaataagtgggggggacaaatccatccaacctttttttctgtcacccttttctgcgtttacctcttcatataacccgtgagaccgcaccaatgcagtggatgaagtctatcatgggaagatgagagatagatagagtccacaagaaaagttagaaaaaaaatttctaattggctggatttaaaacagaatgtgagccccttggaattgctgcagaatcttgccactccttttgagagtgtcccgggcagtcttgcccatctcagcgtctctttttggccagggccatgcagaaccacattaggtttgaatgtgacctcagagcctcacctcagaggggggagtgtgtaaactattgtatttgatttttgtatgagttactttacatggaaaaattaacttatgccaccttataggtagaaaagctggggtagagaattaactaagccgattttctgccctacatcagtcaggggaagaaaaaaataacagatttacacatccctttgcaaggcaaaaattgcatctacaaatagcaaattcttaacctgaatttcctgaccagtctcttacatgtggatcacttttctattattcaccctcctgtagggtgggtggatcagccttttttgagattacccaactagtatattacaaaccagtcccttggtatgcgccgggggcaatggtgaacaggatagacacagtcgctggcctttatggcacttacattctggaaaaggagacagacaatgatgcataacaaataaatcatatgattacagactgtgatcatgtctaagaaggaaataaatggcccgatgtggtggcgttaacaggacagtactttaagcggttgaggaacttcgtgaactgaaatttgaagaagaaggaacgagtcattaaaattcctagaaggcctgtccaggagaggtgacagcaactgcaaaggccctgaggagggaaagagcagagaggaggcctgtggttggaatgggaaagtgagcgatgggaagtgagcttggaggagggagcaggggccagatcacataaggcctcacaggccacagcaaggagcttcattttcgttgaagagaaagagagtgccactgagggttcactgtggggtctggcaagatctgatttatgtttgaaagatcactgttgccatagaggatggatgggagcggggcataaagggaggctggaaaatcactccagaatctactgtagtaaagccatggaagatgatggcagcatggacgtgggaatggatatggagaaaaataggcaagcttgagttatactttggagggaaagttgccaagtcttgctgatgggttggattcccagctgagggaaagggggataaagagctttacctgctggggggatgctggtgccatttccggagatgaggaaagtggggaacagagctggcctgcagagtaaaaatcaagagtggtttgaccatgtgaagtttgagatgtctgtgaattaggtggaaatatccagtaacctgttgaacacaagaatctggaggttgggttacgtctgggctagagatatacatttgggagttacagtggagagatgctatttaaagccacaggtctaaatgaggtcatccagggtgagtatacacaaagaagagggcctgcgaccaaggcctacaggaactccaatgtgttttcggacatggccacatgtgattttccacctctcccacggagggatagggtctgtgtatttaggtgggcttgtgattgcttcaaccaaaagaatatgatggaagggacaccatttgacattcaaggctagatcatgtggccatgcagcttcaacctggtttgttggaacattcacctggggagccctaagttgccatgaat

SEQ ID NO: 14833 - DNA, 44999 bp, Human; identical to SEQ ID NO: 14832

SEQ ID NO: 14834 - DNA, 107140 bp, Human
gcctcctctggttattactaaagctcaaaaggagctttaaaaatcctgatgcaacagctgttttcccctctcaccgtctttaaaaatagagataataaaatagcctgaaaagttgtcaagttcaagtaagatcatgtttatgacaattttttgaaaattgcctggttgcagcttttacttacagcattttcaaacagttctgccaactctgtggctctttcatcatgtttcaagtgttcagcaaacgatggtgttcgtctccataaagtcaaagtttaaaaatacaagggccgggcgcggtggctcatgcctgtaatcccagcacttggagaggcggaggtgggcggatcacgaggtcaggagatcgagaccatcctggctaacacggtgaaaccccgactctactaaaaatacaaaaaattagcagggcgtgatggcgggcgcctgtagtcccaactactcaggaggctgaggcaggaggagaatggcgtgaacccaggaggcggagtttgcagtgagccaagatcgcacccctgcactacagcttgggcgacagagcgagactccgtctcaaaaaaaaaaaaaaaaagtacataaataaaaaccaagtaattggaggacgccattcattgattttacttaggactttgggcataatctataggtttaaaaatttctgctgctaagaaagtgggaacacagttatattcccttacattttaccgaagagaaactagacctgcagaggagtacctttctgtttctatataagcagaggaattctgcacaacccaaatcacgcagaaacctcctggtaaggactccacgggtagttattgccggcattgtattctgagagatgagctgcatatcacttttggaaatgccttaaattaaaactcgtcttgaaacaacatgacgtctcaaagaagctcccttctcaccttggaacatcagcttttaaaataaaggtgtcatcagaagtgtgtagacacccactgcatcacaactggaactgatctctggttatgccaatctaggtctgcctggcagggtgagtctaccgctcgaaagctgcacagaggaaatcctccctcctccaggttcaggcccggagttacgagcggagattcgcggcggcgggtcagagcccagagcaaaccaggctggggaacgcacctcgcccgcggctccggaagcggctgcggccccgaccggaaagcccccagcatcgcccgaaggaatcgcggctggcctgcggctccggcccggcctcgggtaccacgcgcctagtgggaagccgcactgacgcctgcagcatctcgcgagatttcgggctcagcccaagtactgcgagttcaccaaagcggggggaaaaaaaaaaagccagcgtgcgagagcctctgaagccgtggctggggcgctggggtggcagctgccgcgggagcatcagctaccggcgtgaggcgaggcagggcacgcgcgccgtccgcagccccgttgcctgggctgcaggtccactgacgcgcggcccctgggtggagagaggggaggtggcctgggagcccgctccttttcgccgcagagcgcggcgggggagggaggtgaaggcgtgggaggaaggcggcggaagaggaggtagccgcgcggagatcctcccggcgacatcactgaggcggagcgtagccgcgcctgctccccgatcgcgccgttcgtgctgcccgcactgcccgaggccctttgcggactggctggccgcgctcttcgcacggggcgcttttgcgtggggtcgcgcaggagccgcggagggccggatcgctgagggagcgtcagccgcgcgccgctgcgggaccgcgggtgggcgggctgaggggcggaggagcctccggccccgcctcccgcgtgctgctgccggagccgccgccgccgcagccccgccgaggctttaaacagcggggcccgccccgcgcccgccacactcgcgcgctcgctcggctgccggtggcctctgtggccgtccaggctagcggcggcccgcaggcggcggggagaaagactctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccggctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggtgagctcgcccagccctcccttcttccccagcccctggtgcatgccgaccgcgggatgtggctgcagactcttcccgagttgaggtggcgggagtagtagacgtgcacgacttgctggcatctctggattcagctgtcaagggtggaattgccgaggaatgttaacttaatctctcaaaagtttgtagcgggtttggctagttacgtgataccggagggctgcctctaacaaccttccccatccagttaggtatctcgtgtgcactttctttcccacccacgctcaacagtcaccatccctctgaatgacagtagtgtttgtgggccctttagaggagaatgtgcagtgaggatctctcgagagaggttggagagcacctaccatctgtgtcgttttgaaagattgtgttgtgtggcttatgtacgcctattagggatcgcaagagtgggaatgttgctgtttgaaggaaaaccttaacagggtgtgtttatggtctatgagttattaaagctcaattcttgcaatcttgaatatacaaaggatcatagagatcttgtcttgggacacgctgttcctaataatggcataactctttttttttgcgatgaaaacgttttgggagaggtgtatatttaaaaaaaaagggacagaggcgagtctttaaagaaaaaagggaaacaggagaattggtttttctgtagaggatgaccagaaagacctgtggggtctttgccataagcagttacactttgtaaacagaaaaccatccccataaactcattgatttttgtaactattttttatggtcacataagacttatttcttcagcgttcaatgtcactgttttgagataacattgatgcttttgagatttcgttaatgtttaacttttttatgagccgggattacttgaagtcttcctttacaagtgtgtaatgactacattgatggaatttgtgaacgcaagaggatggtaccacataggttgaaatgatcacagtttggacaagtttaaatccagtatgtgatttcttttggatatgattatttgatctcatacagtgatttcatacaagattgtacttgtcccagtgtttgataatgtaacattcacacagaggtaattacagagctcttacagcttattgattgtttaaaagcctgagatcatttagctttagataatactattcttgttattccattgtggtattttgtcataatcagaagcaaaacaatgtctaaaacattttttattcatactcctgtagtttctatcaagtctattcttttttcttttcaaaactcaaaaatcattgtagacaaaagtagatatggagctggcaattttcattatcttaggacagttttactaatgaaaatattatacagatatattttagatttattttaccaaagccaagtatgtgagcagtaaagtgatctgtatttacccataagttttagaaagacatccaattgaaaggtatatatgttgagcttatatgcttcctagggaagtttttgctactttaaattaaattatctcaataacaaagcacttcaagttctccaaaactttagatttgtgtgtttgtgttttttgcttggctttttggttcaaagtatctaaaaaacaacacctgtactgttagttgtatggtagttgaagaaatcacccaacctcttagcttcagcttttcagggttatcatgaagattagaaaaaaagcgcaataaaaatgaccatgttcagtgcctggaaaataatacctagttgttatttccctcttatattggcccttcagaagactctaggatctcaattttagattctgttaattcttacgttattaggtgaatgtagtatataaatattatgttcagtttcatttatgcaacaggtactttaattctttgtagtttaccttctgccactcataatctttatggccactgttttattggcttaactaataactacatgttgaagataattttgcttagaattttagcagatggattaaagaaatgggtgttaagtagtacaaatatgactatacatcactgtcgaaagaggggcagacaggaggggttataacaggttggctggatccccagaagttgtcccttactctgtctaaattgacttctacctctctaacaccttctgtaatgtttctagccttcagtgaattataatatttagaatttttataacacctaattctagcagtcgattgattggcatatactctactttggtctactaagtgcataattatctaccatgggactaactctgtgttgggaactacagaagaagaaaagaagtaaaatacttcagaaacttgttagggaaaaggactggattgtcttccctccagttgaattcctttcattatccatcactgactttttaaaagtattttgtctagatgtccaactgtaggggaaaagataaatatccttggtgcatcttgctatattatatagccattctaggaccagtaggcatgagttctccatttatgagttattggggaagggggtatcttagatgttgacaacatgcttgtgacattgtgggattatgtggtgattagcaaaccagttactgcttctgcctagacagacattaacaaagtagttggacaaataacatagttaataactgttttttaagtgttacgaaagaaaaggatacttgtaaagatagaataggacctaattttaattgggttttgggaaggcgtttttttgagaagtatgacattgaagctgagacctgaagggtaagttgatgattgggtggaatgacagtcctgaccaaagggacagcgcacatgaaggtaatggggtgagaaagagtggtatattaacataactaaaaggagataactatttttcattataaatgtagtgggacgctattgaagaattttgtgtggggtagccacatgacccattttgttttaacatctttaggctctgggtggagaatggattggcaggggcaagaatggaagcaaagagactcaagtgattactgtggtctggttgagagatagtaaaggttggtggcacaaaggattggatgtgggagtgagaaagaagctgacttgtagattttgaacttgagaaacttaatagatgttggtactgttgcttgagatgagaaatactggaggaggaatagatttggtggttgggagaagtttgtatttgaggctattctgtttcagtagcctataaagacaaagacaacttattccaagagtcgtggaggaggctctgtgtgtgtgtgtgtgtgtgtgtgtgtgtgtgtctgtatataaacatatgtaaatatatatatttacatataaagatttggttgcttaaggtcatggactaaattacttagggagagtggtagataagagaacagaaaatagggtctggcattggacttggagattgtttaaaggtctgttagagattgaggagccattagcaaaggaaattaaggaagagctgccatactgtcaaatagcctggagagcagtgttgggggaagctgagagaaaagagtttttggaaaggcagaaactcttcaaagctgatgctaggaattgatttaaaaatgtatatacgtacacacacagagtgaaaaatcaaagtatggatttttggccctacaagaagaaataaaaggtggagggtaacaaagtatttgatggacatcttcaacatgtatgatggaatgctagattatcaaatgtggaaagtggagtggtagacaatccatactagctcctactggatttaaagcattattaaagtagttttttgtttttgtttgtttgttttttgtgtgtgtgttttactattttgtgttttactattttgactgctaaaccataatttctaatatttttgtttttaaaggtagcattaccattgcagttgtccttgggccaaggcttaggagccttttgctggtggtatgtcaagggtttctatatgattcctgtatttttgcctttctcattaacaaggggaaaggtcaagggagcaactatattgtctttcatgtgtcactttgcttgttggattttcattaattcctaagaaataggtcttatacacattttactcaagatgaaatgagctaatagaaacagaagaaattggccaggtgcggtggctcactcctgtaatcccagcactttgggaggccgaggcgggtggatcacctgaggtcagaagttcgagaccagccttaacaacatggtgaaaccctgtctctactaaaaatacaaaattagccaggcgtggtggcgcatgcctgtaatcccagctatttgggtggctgaggcaggagaattgcttgaacccaggaggtggagattgcagtgagccaagattgcgccattgcactccagcctgggcaacaagagcaaaactttgtctccaaaaaaaaaaaaaaaaagaaagaaacacaagaaattgcttaatagccacttttacaaaaagtgcagctggaggacaggcaccatggtaggagcctgttgtcccagctgcttgggaggctgaggcaggaggattgcttgagcccaggagtttgagactgtagtgcactgtgattatgcctgtgaacagccactgcgcttcagcatgggcaaaacagcaagaccctgtctaaaaaaaaatagtagtacagctcaatttggacttcacatccaggtttttctgactttaatgctaggacatagtagcagcaggttcttctctctttatcttttctatcccttagacctgttctaagataacaaagatgttgagggggaccccttggggattaccaccaccatttctctaccttgaactcctgagagttgaatgattatataactgacagaaatcaagagatgtgatgatgtaaatattattatgacttcttcactagcatctgtataagtgtttatcttcatacagagaataggcacttaataaagatttgttcatggaatgtacaaatcaggtgagcagttcctgtcacttaacaaggactttaagtaaaacactaaataattacagaatctcctctaaccatgagctgcttctctgagtgggctgtgttgatgcctagtcaagaaatttcacacactattaatcatttcagtgtatagctttagtccttgaaagtcaccctgggggaacaagaatgtgtctctcgagggtgaggggaagagtagagtagtgtccagaactgggtaaaggtgggaccctgataagaaatatttacatgtggcaaagtcaaatttggctgatttcacagttttgccaggggctttgccctgctaaacccatgctacttgccattgaagtcaggcttacccataatactaaatgcattcccccaggtgtacactgactgaagtagttctacaatgcggcaaacaggtaaaattgcagctactgctttgttaaatagaaaacagcttttaatttttagcataaaaatttcctgggtagaaggaaagaaattttgggatttaaaatgtagcaaaaaatcagtacactgctaaattgatatcttctctgtgtgtatttatgttcatacattttaaaatcctgtgagactagaatttaaaggaccaaaatagagtttcttggttcttatgtgtggagtgtgtttgctttcaatgatatttcattatatgttacatatatatatttgggaagtctatagtatagtcctatgctgaagtgaaataaatgtgaacctagttattcaacaaatccttgttgaacatcaacaacaacactgttctaaatgctggggatatagcagtaaacaaaacaaagtcatggggctttcattctagcggtaggagacaataaacaaacaaaattaaagcagggcgaggaaaattaaaggtggctagatgatggctgggtgatgctgttttagcattgttagggaagacctctgatatgtgagcaggctctagaaaggggtgacccccatgcagataccagggaaagaacactctaggcagaggaacaacagataccaagaccctgagatgggagtgtgcttggtgtgatggagagacagggaggtcagcaagaccgaattgatgaggcagtgtgataaagtcagggggtagtgaggaccaaatagcgcagaaccttgcagatcatgataaagacttaggattttactctgagtgatttaggggaaggcattgtagggttttgagcacagatttgacatgatctgacttatgttttcaaaataccacgctgattgttgtgtagagaatatactgtaagggggcaagagtagaaggcaggaaaccagttagaagcctactgcaatggttccattaagatgataatgacttttactaaggtagtagtgattgatacaatgagaggtgttcagatgctggatgtgtttcagaggtagaattgttgggatttgctgatggtttggatgaggggatgtatggacagagtaatactagggttttccccctatttagaatggagttgatattaatggagaagtctgtgagaagggcaggtttgggagatggactcaagatagggtttcattctacaaattagttctccaatgaggcaaacaggtaaaattgcagatactggtttgttaaatagtagaacttaagaaaacagctttcatttttagcgtaaaaatgtgcttttgctcttcaggtaaaaccatgaaaactagtagtctttcaaatactgtacaaaggggtagggaactagtgggttgattccacaaagtgaaagcccactgagggtgagcaacaaggaaaattacttaaaatactgaagttaaaaacattagtggtgtctcatttaaaccatgaaagctactatcagctgaggccctcctttgtctttttccattttcactaggatctctaccaacactagcttaaagctattatgaaaaacttggagctggtagagaacttgggggtttctaattggaagaagggggaaagccaaaaagaaaaaatagcttagtggaatgttgactctcagcagaagctaattatggctagtacactcatagtatcattggactcagaaatttccctgcctcaatttttaaaaaaattctgtgctttttctgaatagtcacaaattagatattcatctaggttcagaattctggaaacctgtgggatagttctttgttgggtaagtgtgaattagttcttccatcagtttagtttcaaacagaatttggtatggtatgctagccattttggagacttttgcaagggagcgtaggtggtttggcagggcaggcttgagtattccagtggggaaagacttagaggaccctaatcattagagacctgcccttcccacagacttctccattaatatcaactccattctaaataggtattactctgtccatacatccccatccagactatcagcaaatctgaacaattatacgtttgaaacacatccagtatctcaatacctctcattgtatcagtcacaaccactttggtaaaagcccattatcatcttaatggaaccattgcagtagccaagatgagaggaagggggtgattaaaacatttagctgcaattcaagaattgggctatagggctgacggtcttggaaagaggtaggaaacttcacagagcatgtctggactgaggaccccagtccgaagtttggactagcagttgttgtgattatggcctgttaccatttaaggtctttatcagtgctgtccgatagaaatataatatgaactacatatgtcatttaaaaaagtaaagaatcaggcaaaattaatttataatataccgtattttatttgacactgtgtctaaaacattcattgcagatataatgaatattaaaacatttataatgagatatctcaatttcttttttttgtacaaagtttgaaaccccgtgtgtttttcacatacagtacagcacatctcaattcagacaaacatttcaatggtgttgaagtagtagctccttgtgacctttgattactatattggacagtgtagatgtaaacagtacttggcagtttggttctgaggtcctatgattttcatttttcttcttggatatttaactgttcctgtcaatagtttacttctgttaaagaaatttgagtagcttctatctgacagaaaaagcggaatattttatttaactctcattcctttccaggtacaagctctttccttccttcctcagccagacttgttgagagtattgtttataattgccgtctttccttccttaccttttactcaaactgctgtagtgtggcttctattttgcataaatagttcttgttaaagtcacaagtgatctccattcttatcacaaatttcaggaagtttttgttttgttctgttttgttttgttttgagcagtgttcagctttcaggcagcatttggtgttcttttgaagtgttttggtcacttccttggcttcttagttttccttctgcctttctgactctttcagcctcgcatcctttgcagtcgcctccttctctaacctgaacatcctcaaggctttatttggacttttctccttccttgttcctcttttttctctccttatgctacatcatctgtagtccaatgactcccgaaatttcgtcttctacccacactcctctgagttctgggtatccaatgcttgcttgacatttttgttttatgtctcaaagataactcaagctcacaaacttagtatttcttcccattccctccagaaacaagaatccaggccctctgccagtgtgtgctatatctctcggaatggtaccactattcatcatactgcaaaagtgagaaacctatgagtcatccttgacacttttctctcattcccccatccaatcactgagttctgtcaacttgaatttctaaatattcttttcatctaagctgctaccatcctattaggttggtgtaaaagtaattgcattttttgacattgaaagtaatgccaaaaaccgcaatgacttttgcaccaacaaagctgcagcaatagccttgtaactgggcttctcatattcactgtgctttcccatcactattgtgcccaaaacaaaactgatcattgttgcccaatgctccctgcattgtctatttctggtttgcctcttcttcagtgtttcacttactcagtggcacaataattctttggtcacgtggcctttgtacatggtactctccatggactcttcctctcccttccaccattccatacacccactgttaactttcagtttaagatttcacctcagtccttatttcttttgagaggaggccttcatcctccagtctagaacaaactcattttcccttaatggctttagttagtggtagtatatctattaacatggttgcttgagtcaacttaagctaacttcaagctccatgagaagctgactttgtgattgatcaccattatgtcctttgctatctagtataggcctgacacagtagaccctcaatcgatacatattgaataataggcctaattctttacatattaatgtggtacaaaagaatcttacctaccttatatctgttgtctagattctctaaagaatgtttggcagagaaattgccctgttttgcgtatgtggtgtttaagacccaaaagaactaaatgacctgtccaaaatcatagacatgcagagctagcattggaaattggggcaggcattactgagtctcagttggcattcatttcaatatcctacagtttaatactgcataagctcttgttattttggtgactttttttttcttttttaaatactcatgacaaatgtttttatatccattgaatataaaatagaaaagatttaggctgcagagttctagtgtatggatgtatctcttcctagtagaaaaatgttcaaaaaattaagaataagaaagtttcttatacatggaatcttagttttttgtatttcctctgccatcccctgtccatatcttccaaaagtatgatataaatttttaaatgtaatatgggttgtactttccagtaactcgtaacttgtggctgttaaatttaactttaaattaacattgtgttaaaaattcagttcttcagttacttgagtcacattttaagtacttaataaccacatttggctagttgttatcattggacaattgagataccaaagatttccatcatcacagaaagatatattagatagtgctgtcaagggaggtgatatctaaaataactcttttccttcattcattctttcttttcttaattccttttcttccacattagtgactactagtttaaagtcattagagagtctaatgttcttctaattttgcataggatccttccttaaataaaagtgtctggaacattaggttctcaatgaagtgtttcaatcagtggaatctgttttctttgtgagagtggagatttgggtctttaaaggcctgtgaataatttaatattgtattgttagaaatgttagtttccaaagcattcttaagttacatatctgcatttggtcttcagtctcaggagtaggtgggtttttttagaaggtcctggagtaacagtctcattttgcaaggctgtagtttgtcttcaagataatacctggtagggcagaatctttttgaaaccaggtctcggtatcccaatttttttcttttggaccagtgattccaaaatttctaaaagaaccacctggggaaaaatggctgtttcccatttcccaaagaatatgtgcagtgttttgtttttataaacaggcaaagtatgttttattcaacctcttagagcaagtttgaccaccttacaacctgcgggccacatgtggcccaggacagctttgaatgtggcccaacacaaatttgtaaactttcttaaaacattatgaaattttttttgcaattaaaaaaaaaactcattagctattattaatgttagtgtattttatgtgtggcctaagccaattcttccagtatggccaagggaagtcaaaagattggatactcctgtcttagagtatttgtggtttttagagttttcctggtgattcttagagaggctggtttgagaattggtgacctagaccatgttgagtctttgattaccatattgagagtacagtcatttgttttcattgatgtgctgattctcaattttgaaataccctgatattgacaagtactatctatcaaagttctggctttaactgttagataactgtatactgaattaaattaagttgtcagttattaaacatctgataggtttcagtagttttctgtagcctgggcacaacaaccttgcaagctaggtagttgacagatggacagactcagaagctagtatcaacttgtaagtggtaaacactggatattaggaaaggtaataggtattaatacctaattatttagtagcagacactggatattaggaaagatgaggtattaggaaaaacatctatgtttttactcattaagtatgaacaaaacatggttatgttgctattaagagtcctattcaaatgctgtagggatatcagacatacaagtactaagtgataagtttgaatcctgatgagttattgcagaatagttgggtctagatattaacctcttttttataaaacctaatggtttcgggcataacttatcagacttgatattttagaaactaatgttatggcaaataactctttataggaagatttttttctttgaaaattaaaatgtgaatttgctttttgtttatttaatcaccaatttgaatctcattattttagtttaaaataaaaccgtcatgagaattgtgtactgagagcatttgcaaataagtattttaaaagagaaatgttttctggcaaagctgggcaggacatagcctcagtactaacttacctataaatttctagagatttgcctaaggttgggtttagagaaaatattacactgcctctcctgtatcaattccaattatcaggcagatttgctgatcagaaacaaatttaagaaaggtaattaagcaaaataacagcaataacaacaaataggcattcataataaacggctttgtggtatcttgcaggaacagaagataagaaaatcatgaaaagcagaaacaaagctctcagaaaatagcagtctgtaataaccctttagatataagaacaggacctgaatttcaatcattataacatcttcatctagcataaatgctaaggaaattaacaatgttttaaatctcaatacaaaaaaagagtcagtgaactatacaattttggaaaatttcagtctcaagccttcctagaatattagattttaagagtctgaggattaacctttttgaaaaccaacactttaaaattttattcaaagagtttcattgtactttgcttatttcaaatgtttattgtttcatgaggaagagaaagtaatataagtttgagaaatagggaaggtaacttaaatatctcaaacccttaacctttttgcatttctgtgcatttttaaactaaaattttatgtcctactttctctatctagcattaagtaacattagtaaataatcagtttccaatgctgcctatagaatattcatatagttataatactttaaagtatatgtaccataacttgccatttcatgctctttgtatactttttagtccatttacatttattgtgatttggttgtaattaggcctgacattgtgttgttttctattacctgttttttgtttctcgaattattctttcctgccattttttgtgctaagattttttagcatttaatttaattcttctgttgaatttctagttatatatctttgcattattttttagtggttactttgaatatcattgaatttcttcagctgaaatataggaattttaaaacagtactttctctttcctcagtgctcttgtcatctagatgataaacatgttgttcttgttgctttcaatagttacatggctttaaaaaacagataaaagaaaaatatgtatggtttttaaatattttcatttatattcattcttttttgtttatcagattgcttcccttccttgggcacttcttgtaatggaggtcagttggcaacaagttctcttagtttttttttatctaaacatgtctttattttactggagttttgaaggatagttttgctggatatagaattcttagttgacagctttcttctttcagccttttcagtatgccatttcaatgtcttctggcctttggtgtttctggtaggaagtcagccaactgtgtaagatgttatttttctcattgctttccagattttctctttacctttggctttcagcagtttgtgcttcaagagtttctctatttgtgtatcctttgtcagtttgttaagtttcttgaatctgtacgttgatgtttttcactcttccttcttctgccatttccattctgctattaagtccacctagggaatttttcatttcaaaatttttttcatgaatttctgtaaaaatttattccaggtctagaatttctaacttttaaaatatagttttcatttctctattagattccatctctgttactcattgatatatttacctttgcttttgtttaacatatttattgcagctgtttttggagtctttgtctcctgaatttaacatatgggccacatggaggaaatttctaatgactgcttgtttttttttgttttttttgtttttttttcttgagtgtgtgttacattttcctgtttatttggatgtctagcagttttttatatggaaactggccatgcagacactacgggttttggggttggtttttaaaaatattcttctgaaaattattgttgttggtttttttttgttgttgttctaaaaggcactttttatctaggctcaaactgcagactttccacccccatccactcctctccccatacaatagctgatatctctgttctgtattttatggtttccagctacttatttttaggttggcccctggggagtctcccctgcatttgtgtaatttggtggccagcagagattcgggggcttacccttgccatcattatactttttctgaagattttcacttaatttccaattcctctgttgactttgggctctatttcctgatatttcaagttagtagggctttactctcagccatttaagctatccacagttgagaaaggctctcagttaaaaagcagcaaagtcagggatctgacaaaagtgcagctacatctatcatgagtattttctttcctgtctttgcttctttttcatttactctggtttcttttccatgcacatacagtcgtatgttgcttgacaactgggatactttagagaaacacattattaggtgattttgtcattttgcataatgatacaaacctagagagcatattccactacacacctaggctatatggtgtagcctgttgcttctaggctacaaatctgtacagcatgttactgtacatggttggaacataatggtaagtatttacatattcacacatagaaacctaaacagtaaaaatacaatataaaagataaaatggtacacatgtgtaggatacttactattgaatggagcttgcaggactagaagttactctgagtgaatgtaaaggcctaacacattactgtacactactatagacttacaaacactgtaaacttaggctacattaaatttatttaaaaaatatttttcaataataaattaacctcagcttgttttaactttttactttataaacttttagattgtttaaaactttttgacacttttgtaataacatttgacttaaaacacagacatattgtacaagtgtacaagagtattttctttgtatccttgttctacaaacctttttctatttttaaaaattttaggtttgtttcttttaaacatctgtttttttgttaaaaaggaagacacaagcacacacattagcctaagcctataaaggttcaagatcatatcactttcacccccacaccttgtcccactagaaggtcttcaagcactataacacgtggagctgtcatttcctataataacagtatacattccttcttctggaataccttctgaagtatctgcctgaggctgttttacagttattattttttttaagtaagtagaagtaagctgtaaaacaataataaaaattgtaagtacataaaccggtaacatatttattattgttatcaagtgttatatactgtgaataattatatccgctatacttttatattactgtcagcttagtaggtttgtttattccagcatcaccacaaactcatgagaaatgcatcgcactgtgctcttagaatggctaccacgtcagtaggagaggaatgttttagctccattataatcttatgggactattgtatatgcagttcattgttgacagaaacatcattatgtagcactcgagggatttaactcttggcatttctacttaatagtttgtgggacatctaggaaaaggacttcacctctgaccctcagtttccttatatgaaaaatgggaaaggtgacagagctagagtatccctaatctgaaatgctccaaaatctaaaactttttgagtgctgacatggtgcttaaaggaactgcacattggagcattttggattagggatgctgaactccagtagatataatgcaaatattccaaaatctgaaaatatctgaaatatgaaacacttctggtcccatgcattttggacaagggatacttaaccagtattcacagtgagaagtatcaaattcctgtgagaaatacatgaaaaatcaagtgtatcttatgtatccaggtgtatactaaaatgtagtttttaattacatggttcttgatacatactgcttttccagtgttttacccatttatgatgctactagacatatacttctctatcttcttaccaacttttggttcatctttaaaataatttgaaatagaaattgtacagttactaattgatactggaaggtgtaagttttctggtactcgaattaaaatattttcaagcttttagtttattgacattagcaagttgtgtgggatttgaagcaatgctatttctaatgcattctgttgtaactcagtcttgaatggttagtaaagaacatgatgggctaggtagaggactgaattctttgtaatcagcagttctgacttggttcattgtaaagtcacatggtcacaccatccacttttatctgtggcacttgagttttgagctttgcattaataccactggatattaatagagcattgttaaccagagcagattggattcctgtaaaacaatactttgttttgaaagagtagtctgtatggggagcattacactgaatacaccaatcaccgacagcacggataggaaatgttggtagctttaggatgatataattggccagtacttgattaaaaaaaattgttagaacaattgttagaataaaaccggccactttggggtcaaaatttgcatatgtatgcacatatttttagttgctaaatcacctatgattcatgatagtaatttaacgctttgacttaccttagtattaagcagatgctgttaaaccatataagaaattttgatctttaacgtatctttaaaaacattttaattcagaagtttgtagggtgtaaataaatggcatttttaggtggactttaacatttttgaaatataattttgggtttatttaaatcaacaataagctacttgtcaagaaagtaatacacttttgtatgttaacagtgccctaaaataaagatccccactctgctggctgtcattaaccattatttaatttgctgaaataatgctatgtccagaagttttgtttctgttctcagactaggcaatctcatattaaccctaggcgttccttttgtaaagtgtgtatcagtgccactaaggcaaataggaaagagtttatcatttattaaatttttagtgtcagagaagttgtgaaacatttctagtactgtgaacattggtcattaaagccacattcttgtgctatactgtgttggcttggcagatggtgtgggtgataaatcctttaacaccaccatgtggaatggtgatttcatatttgtatgcaaaagtccttttttttaaagtcttttagaggtaatcttaaactctgccaatatcaaattataagaagctatgtagtagagtctagattagtaatgttttacagtatttatttttatgtatttttttcaacatccagttttcagctcacagtatgggcagttgcaatagtagatcacttatttgtttatagtaacagctaaaatttattgagctcttactttattaatgtcaggcagtgtactaaacatttaacacattttctcatttaatgttattaaagtattttttattgtggaatctaaaaaaaacataaaatacaaatgtataacgtaagttatcaagtgaacatctgtgtaatcaccacccagatcaagaaatagaatgttgctggcaccctagaaattctctgtgcacccccttctaattcctccacaaaatagccactaccctgacttatggtgatcacttctttgggtattggtgttattttttataatgatttttgtcacctttatgtattcctgaagactattagtcagtttttcctgctttaaaaatgtatgtaaatggaatcgtatagcatattttcaatctgacatcttttgttcactcttagtttgtaacactcatttatactgtgtctttctgtaattcacccccccccccgccttttttttttttttttttttttttttttttttttcttttgaggtagtctcactctcttgcccaggctggagtgcagtggtgtgatcacagctcagtgcagcctcaacctcctgggctcaagttatcctctggcctcagcctcccaagtagctgagactacaggcacgtgccaccatgcctggctaacttttttttttttgtattatttattgaaatggagtttcacctttgttgcccaagctggtattgaactcctgagctcaagcgatccactggccttggcctcccaaagtgctgtgattacaggcatgagccactgtgcccatcccttcatttattcatttcaattgctattttcttcgattgtatgaatattctacagtttctttattctgcagttaaggatgtttgtgatgtttctagtttttgacaattttaaacagtgctgatatgaacgtttttatacgagtatcttgcttcatagaagtattgtatatctctaaggatatgctgaggagtagaattgctgggttaaaggtgtgcattttttcaacttgaaaataatgcccaaacttttctttcagaattgttttaacagtttatattctcaccgggatcatatgagagtttttgtgttctgtacaattattgtattttctcacttcgtcttctcagacagtatggagtggataatatccccatttcgcatatgtcggaactgaggaccagagggattaaataacttgccaaagcacacattactagtgagtagcagagctgggatttgagcctatctctgacttgagaacagacactcattttgctctactatttcaggacattatttggaaaacagattcctcatgaaagctcaatattcatttaccatatctttgataaaaatgacaggaaaggtctgtgctgttgtggaccttccattttaatacttactgagggagtgcatagattacaaaacaccaagtaaataaaaaagataattacagagtatgatatgtgtcatgaaagaaataaacgggactaagaagaaacaatatgttaggtgttttgggaagaagaaggctgcatttaaactaagacctaaaggatgagaaagagccagccatcttcaaagtgcatttaacaggcagagggaaaggcaagccaaaagtccctcaggagaaaatactttaaaaccagtatttcagcaaaagaacattatatcaaattaaacattttagttagaaccctcaattatctaatttaaaggataagagtttggggtattataaaattcaaggaaaattaaataggaaagtggtctatggaaaaaaatagaaatgtcacttctataacagtcagactaatatttgccttttctttaatcatgtcaaaatttactatgtgtggtaacaacatatttatgacagatcgaaagaattccttgggataacattatttttcaaggcttcctgaaaaaggcatggatgtacggaaacccaggggtctagaggttgcagtgggaaagtatctaagggaagagaaaacctagtttgacctggaacattgattaaaaggagatgctatcttgagcagctaatgaggattttttaattggaaaaaatcctagataatgtagaaacggaatgattggcctattttaccagccctctctaccagaatagcctccaagtaaacttccaaagttaaataacacaaaactctatctagtacacaatttcatacttaaaacatttgaatccgggtgtggtggcttgtacctgtaatcccagcactttgggaggcccaggcgggcagatcacttgaggtcaggaaagttagagaccagccaggccaacatggtgaaacctgtctgtactaaaaatacaaaattagccggacgtggtggcaggcacctgtaatcccagctacttgggaggctgaggcaggagaatcacttgaacccgggaggcagaggttgcagtgagcccagatcgtgccattgcactctagcctgggtgacagagcaagactccatctcaaaaaaaagaaaaaaaaatatatatatatagatatatagatatatagatatagatatagatatataataggtatgctttctcagatggattttctggacactatagcaattcttctttaaaggtagtctggtacagctatttgtaacaatcctgtatagcagtttcatagatgctgtataccctgggaggtatttctacaaagtatagaattttaaaaatctcctctggagctatacagtgcagaacttctgctgtcgtttttatgaggaccatgttagaagcccttagcttctgtagatttgggaacaaaggaatgagggaaatagatacctaaaaatagataatctaaaataatttaccttgactcattataacatgtggaattctgtcatttggaaaatggttaagtgttttcactgaaaccatcaggaatttaaaactagatccaaaaagaaaaatttccctctccattttgacagaagtcactgtttatagtatattgacaagttctttttatcttttggtgaggattagaatagtaaatgtaatgaaacatcctaagtggtaagatcaatattttatacccagggctgaaactcacaaaagaggactgaacctaagccgtcacttacgacttaacacatatacacgatgtttagagctatgagtctggtacgataaccatggaaaatacgggatgagcaagggaggggggtataggaccaagtgctaaaggaactcctaccacttaattgctgggtagaagagtgtgttgtttcaagaaagggagtggctgacagtgtcagatggtactgtaggagttcagtgagacaggaactgaaaaatgtacattagatttagcagccaagaagtcattggatgtcttaataaaacgattttggtgttgtggtgaggggaagccaggttggcttgcgtttaagaatgtgctgcactattagaaactttggcaagagtcagagtgcagtaaaaagttaactctggttaaaggagagggaatgatcaagttgaggtggaaatttgaatatactagggaaagaagagatcatccatagtgtaaaaattatccttttctctacatcctgcaaggaagtaatgatgatggagaccagagtttccatcttttttgtctattttctacatactcagaaaagtgttctgctccctatggtttctgtttttcttttcatctgtttgcatagcttctttacctactagctttttatccctggcccctctcctaagttccagtcacacattttttaactgctggataggactctaattgtcccatagctcctcagattcaacatgttcaactgaatcttttcctttttgattactgagggcctaaatatctggatcttccattctttcctttatctcttcctttcttccccctttttttctctgtcctaccagtccctgctggggctgggaaacttcaaatcataatgctactttttgaaagattattttctggaataatactaaatttggtcagcttcatttaataaaccattacccataaaatatttatgttgccaatttctactttttatccattagtgtggaatatacagtaaaaaccaaaaatctatcatttctgtgaaaatggcaggtagagtgaagatttttatttatgtacttttgtatcagcataatttatagttcataattgcacacttgaacctccttgattatacagtttttatacttttttgtgtgtgtggaccaaataccatacttgctaattctcttatttctctgaaacaaatttaaagaaacaaaagatgtgtcttccactttggtttcctggtatttcaggaaattaatacaattatgaacccaattttattatatttaagtctactaattgaactacaaataaaaagttatttgcttttgacttttgaattttattgtagagataactaaaacagttttaaaaatagatctgccagaagatgatagagaagatacattttttattttgtgtggacatacctttattttaaaataaaatactggaaaattttactttgttcttacaacatagttgtatgtagtatggtggagagctagttgcaaaattattgctagttcttctattttgaggtggaattctgataaacacccacagcaaaaatttttggatgcctgcatacttttgcattgttaaaaagacacccacatgaaatcttagccttagaaaaagtagcctactaagtacatacatctttcgttttcttttaacacagatgggaagagagatgcctttttgtgtatattatagacattatattttcttgtaatacttggaggttatatattttaaagtctgcttccattaaaaaaactgaagagcactatgtattctatggtgaaagataagggaactcctccttaaagtttgttgaattaactggcagattttcttgttctggctttatttgaataattgaacagttgaatcatcaatccctattcagagtcatttcttattatttgggattgtccctgactctactgtctgaaacacattaaacagtggtggaagtacagctgaagtgggttgttattgtgattgagctacacagtcccctagtcatatttttttttcttttaccgtttatgcacacttcttatttttgaattatactttaagttctagcatacatgtgcagaacgtgcagttttgctacataggtatacacgtaacatggtggtttgctgcacccatcaacctgtcacctacattaggcatttctcctactgctgtccctcccctacccctccctgccgcaacagaccccagtgtgtgatgttcccctcactgtgtccatgtgttctcattgttcagctcccacttatgagtgagaacatgcagtgtttggttttctgttcttgtgattgtttgctgagaatgatggtttccagcttcatccatgtccctgcaaaggacatgaactcatccttttttatggctgcatagtattctatgtgtatatgtgcaacattttctttattcagtctatcattgtgggagtttgggttggatccaagactttgctgttgtgaatactgctgcaataaacacacgtgtgcatgtgtctttatagtagaatgatttataatccttttgagtgtgtccccagtaatgggattgctgggtcaaatggtccttctggttctagatcctggaggaattgccacactgtctttcacaatggttgaactaatttacactttcaccaacaatgtaatttctccacatcctctccagcatctgttgtttcctgactttttaatgattgccattctaactggcatgagatggtatcttaattgtggttttgatttgcatttctctaatgaccagtgatgatgagcattttttcatatgtttgttggctggtttatgcatacttctaacaagtttaaccgttaatggtttctgtgttcataccagcaagcagaagaagaataataggcatcttcattttaagcaggaagagggctaacaataggcaggcatatttgctgaaatgggaagtgacagtttgcagtctcatacaaaggaagagatgagaaaaatgaccagaagtagtcacttcaagaattatattatggtccagcaattccactcataggtgtatcctcaagataaatgaaaacatattttcacccaaaaactttagacagctgttcatggcagcattattcataatagccaaaaagtagaaccagcccaaatgtccaactgatgaattaaaaaaaagtggcatatccatactatggaatattatctggcaataaaaaggagtgaagtactgatacatgttataacatgaatgaaccctgaaaacatgctaagtgaaagaagccacacataaagcccacatcttgtgtgagtccatttatatgaaatgtcagaataggcaaattcatagagacagaaaatggttggtgattggcaggggctgaaggaagggggaattgaggtatttcttttcggggtgataaaaatattccacagttgattgtagtgatgctgggaataagagtacaactttgtagatatacgaaaaatcattaacttgtacactttaaactagtgagttttgtgatttgtgagttatatctcaatatagcttaataaagtttaaaaacaattgcaaatttggggtaattttaaatttttatggggttggttagttccattttccataagcctgggggcatcctttttatagtacagtaaaataatcattggttgataatagttatgaaactgtgtgctgtaaggaaaatacttaatgtgttttaggatctcttttgaaaaatgtatgaactactatcctaaatgtttaacattaaacttcatatgtgaattcctggttatcttaaaatgactcattttccatgtatttcacatagctgaggttatagctatgtctattaatgaaaacatgaggattaattaaaaatttaattatttttctcaccattacaaagcctagttaaaataattttcaaaaaatatacttaattaagttcatcattgtcctgagaaagaggagcagcgcagttcttggccgggtcagcagaatccctggtgaccctcacctaggcgtgccagggcacaggttgtgattgtcctggggcggcggaaacccacgtgcctgccctgcatgcctgccctgcatgccaggcagcacgctttggagtcgctgtgattggccggtgtgcccctgccgaagcctcggctgcttctgtccacgtcttacacttcttcatttatccatggatcatttcgagagtccgtcttgtaaatgtttagcattttgctgctttattgcttctttctggggacagttccagcacttgctgggtggagaaaggcagctgagtccggagaagagcaaaatatggggacccaggttaaaagcagacatcgtccttcctacccagtatttctatattcagacagtggatacatcagggaatagcttcacatcttctccaggcgaaaaagtcttccaggtgaaagtcccagcaccagaggagcaattcactagagttggagtccaggttttagactaaaaggatgggtccttcatggtaagatacagaatgtgtgcaggctacaaaaatctgaagatgggagttaaattccaaggtcaagatgtggccaaatccccatgtattttaaaagagccagtgtgccatgagaattgtgactggcctttgcaagatagtgcagcctggctacgggggatgaactgcccaactggaaaccattgctcagattcagagagatctggcacatttccctactgtggatccagaaaagattgcagtagaaatcccaaaaagacttggacagaggcagagcctgtgtcactacaccttaaaagataacaaagtttatatcaagtctcatggtgaacatgtaggttttagaattttcatggatgtcatactactttctttgactagaaaggtgaagatgccagatgtagagttctttgttaatttggcagactggcctttgctttggaaaaaaagaaatccaattcaaacatccatccgaccttttcctggtgtggctccacagattccaaggatatcgtgatgcctacctacgacttgactgactgttttagaaaccatgggctgggtaagtctggatatgatgtctgtgcaagctaacacgggtcctccctgggaaagcaaaaactccacagctgtcttgagagggcaagacagccgcaaaggagacttgagctggttaaactcagtagaaacaccctgaactcatagacgctgctttcaccaactttttcttctttaaacatgatgaaaacctgtatggtcccattgtgaaacacatttcattttttgatttcttcaagcataagtatcaaataaatattgatggcatcgtagcagcttatcacctgccatatttactagttagtgacagtgttgtgctgaagccaagactccgtctactatgaacatttttacaatgagctctgcagccctggaaacactacattccagtgaagagcaacctgagcgatctgctagaaaaacttaaatggacaaaagatcacaatgaagaggccaaaaagatagcaaaagcaggacaagaatttgcaagaaataatctcatggatgatgacatattctgttattatttcaaacttttccaggaatatgccaatttacaagtgagtgggccgcaaatctgagagggcatgaaaagggtagaaccacagactgagaatgacctcttcccttgcacttgccataggaaaaagaccaaagatgaactctgatatgcaaaataacttctattaaaataatggtgctctgaagactcttaactaaaaagaatttttttaagtattaattccatggacaatataaaatctgtgtgattgtttgcagtatgaagataacgtttctacttatgcagtattctcatgactgtactttacatttttagaattttataataaaactacctttattaaaaaatatatatacacacaattattgcatctggcttatacttctattgcttcaaaaatcaaagaattaacagtaattaacatatgtaaatatggaatctaagagctaatctaggttgatagtactttaaaaaagcatatagcaatattgcattacatggaattgagtgagtctatttggctgacagatgttggttaagggaaaagggaattttgattatcatgtagattttgcactgtggtagcacagaacttgctgcatctcatttctgttaaaagaaaatatatataggctgggcacggtggctcacacctgtaatcctagcactttgagaggccaaggcgggcagatcacgaggtcaggagatcgagaccatcctggctaagatggtgaaaccccatctctactaaaaatacaaaaaattagccgggcttggtggtgggcgcctgtagtcccagctactcgggaggctgaggcaggagaatggcatgaacctgggaggcggagcttgcagtgagctgagatcgcgccactgcactgcagcctgggtgacagagcgagactccatctcaaaaaaaaaaaaaaaaagtgtacgcatatatatatgtgtgtgtatatacgtgtgtgtgtgtgtatatatatatatatggagagagagaattcactaaaggatgtgaagtactgaaaatatgttttaaaaatttagttggttcttctgcatttaaagaacatctgaaatatagccacattatgttctctgctgtttagatgtgggtagaggaagaaccacaggatggtgttagagacataattctaaacccagaacatctatttcctaaaccatctcccctttcctttcatgacctttttagggctcggttactgctttggaaatgtgtcatatattgggatagaacaaaactcaagaagcactgaaagagaaagagagaagttagagaacaaagaattatggaatcagctatgaaacctaaaaacctaaaaaggaaacactggttgtcaaattcattatgtcaaccagtacatgtctgagtctgagaaaaactacaaaggaaagcaatgaaaagcactgagtcactgcagacaaggaatgagtaaagagaggagctatgaaggaatcttgggatccatgggattcctgctgtcatggactataaaaaaaacatattcgttggtgatgaagaggagttttaagttgttaatgttgaaatttcagatgtaggactggtggcaactaggtgatgtaaatttgtggcttgagagatggggtctgaattgatcgacttagctaccctgtaattagcaaacaggagtcattgtttcctccagacactaccaaaagtgtagctagaatttggaattattaaaatggatttactgtcatagtgagacttaaattttaagaaatttcagtaattaaggttttcttctagtttattgttttgtcctttcctggggtaaaatatttggaaacccttgattcttggaaatctgtactatgccctcttaaatatggttagatgtatttagttatgtttgtttttatcaagtgattttaaattttaaatgttaagcataattcatatttctttttataaccaggaaccttttgaggatggctttgcaaatggggaagaaagtactccaaccagagatgctgtggtcacgtatactgcagaaagtaaaggagtcgtgaagtttggctggatcaagggtgtattagtatgtatatatagacttaattttatagttacagcatatctgttggttataaaatcttcctaacgttctcatcagttctcaagagaactctttttttctctatgttaactgtcttatctgagtgctgtggaaaaccaaattaatagcttgtacctcctttgcttttggatattaacttcagcaaaggagatatgccatttattttgccaaattattcttgattatattctatgtaatgtgttactgatggtattaaattatatttcattgcctcttgtgaatctcatgcactgtcacttttcagaaattaaatatgaagactatcaaattgggagcatcagaatcaagaaggctgagcagggaatagagctgaaatatgcctgcttcctttcacattccccccattatatttcgaagagaagcgtatggaagttaacaagcaaggaatacaggagaaatacttaaatgttgagttcactttgtgcatagatttaggtggttaaggttcagatttacttctgtttttctgtgtttgaataagcactaaggatctgactaaaataggctacattgccttctcattgggactttggaagcacttaataggggttgtattggaatttcagggagaaatagagggaaaaaaatcacagttctagtattaattttattgcctaatccataaggtgaatgtgaagcttcaggtagtattgtttgccttagattttagtgttttagaagactatgttctatgtatgaacatagcaaataaaactgaaaataaataggggaaacttttacaactaatttgaatttttaaaaatgtgaacaattggcattttgtatcgacaaatattatgtaatacttaaatctgctgaagaaatcatgaaatgaggatgttataaaagaataagcaaaagttaaactttgactgataaaagggaatatgcactacttttttaaagggctgaattttaaaaatatatcttgtatctttcttgttctgttgcttctgctgcttcacacaattgtgatgagtgcatttattttcatacacacttttatatgttacattgtgtttatattagctcaaaagtaagctcttttaagctctttataaaaactgttaaagaaaagggtggggtaggagttagatttaaaactacatatcttctgtagtttcaaatgcatgttctactttgactggtttaatgcttactatataatgtttgattattcttcttcctctgtgtcttggcctctttttccctctttaggtacgttgtatgttaaacatttggggtgtgatgcttttcattagattgtcatggattgtgggtcaagctggaataggtaagtgaagttatatcctgcttgatttgagaataagcaaaataactgtgtctgagctcttaacctcatgaaactcaagaaattagagtcatttttaactacgttttcctttatatcagattgttatcttgatgttccttttttcataattctgatttggtttttataaaatgagatcaaaattgggtaatttataacttaaaatgtagattcagtattcttagaccaaccagttttagataccgatgagcttaaacaagagtgtaagtattctcattgtctttctttcttcgtaaaggtctatcagtccttgtaataatgatggccactgttgtgacaactatcacaggattgtctacttcagcaatagcaactaatggatttgtaagaggaggtaagtagaatctttttgaatcatcatcatcagattactcttactaaacagaggtctaaattgtatttttaattattttttactttaactgaagcaacatattaagtctatatagacaagaaagttgctaccgagcacttccagactagtatatttcaatgtaaaattttatgtcaactcatacacataagcttttaagttattcagtgtgtctcgtagcaagaatggagcatctactttggtctcttatccactgggctgcatcttaattgcctcctccaaggcttgcccttggatcagtcagcaacatgctcctggcatttgttcaacattgtattggggtaacctcattccccacctccatcccctattgaggaaaactgaggcagtataccttccccatgatctaatagcattgcgtgagctatacctgggactgtaaattaattaatatatttatttggagatggagtctcactctcacccaggttggagtgcagtggcatgatcttggctcagtgcaatctctgcctcccaggtttaagtgattcttctgcatcagcctcctgagtagctaggattacagacgtgcaccaccacgcccggctaatttttgtatttttagtagagatggcgttttgccatgttggccaggctgggcttgaactcctgacctcaggtaatttgcctgccttgacctcccaaagtgctgggattacaggtgtgagccaccgcacctggccctgggactttaaattcatactttcaagtctagctttctgtgggcactatgaggcctctcattagagtctataagatctgccttgtgagatttttaccctccctaggaagaggacctaagagactacgggagaatggaatcaggatccctgaaaacaagaagaaaagaattccattttccaaatcaaaactcttcagtcagagtgagaagatccctggagaaaggagacaaaatgtctgccagcacctgtaaagtcatggtagcaaatcaactgagaaaagatctatttcatctgcctcaactgttttgaatatccctttttgacattatataacacaatttccactttacctgcatcaagtatttgggtgtgggagggatagagacagagaaccagattgagcttttcatttttcaccattgtctttatatgttttagacaccagaggatccaaatcactgtgacccttggaggctggtatcttgtatcaatatgattatgactatgctgagcattcatcactgttgactgaagttttatgcttctgttagcctggattgagctatattgggatatacagtgtggatatgttcagcagagttagtcagataatgttgagagattctttttggcttctcgtgaactgggtactccatgcttcatttctctctgccacaactggggaatgaaagtgggaagagaaatgggctgggatgctgtgtatttgtaggggatcagcaaatcatcaaagaatttctccttttcctcagaccttagaatctaggctgtgagcctcaaaaggaatggggcatgaagccactggcaacattaacttcatgcttttcccccatttgaatcagatttttggaaggtagagattttgcaagattgtgaccaaaaagccatttcatttttcaataataccatttgtagtttacatatatataccattggtagtgtgtatatataaatatatatatatatatatatatctctttacaaatacatctgcctgatagactttgtgtgcagtcttctgtcctggactgccagggaaagtacgagagtgtggaacccacacagatctgtcccaaaaaatgactatatattataattttgcatgagtttcctgaaaaatctgttcacaaaggaagaacctagagggtaaaaaccacttgaaattctgttatgaggtgttcatacgatcaagaaggtgatacatttggtgaaataatgaaacccatagaagataaaagagaaagttattaatttaaagagtgaccagatactacgaagctttcttagaaggcattcatttttcacttagtgactttggacagctggatggtctttatagaatatgtatgagctgcatcatctgcaattagtgttttcaagagattcttttagtgaatgtaagccccttctgtctcctctgtatctgactcagatttggaaacccctaacatggtttattttggtatcatgaaaaaaatattttccacgtgggagaaactagatacaggcataaaactgagatcacattacacctgtattcaggattctaaattgaaagtattagtcttaaaatttatcctgaaagtacatattttttagttttttccattaaagtgacctataataaatgaccagctcagtggcaataagcaattcttgtgcccatgttgtgtatttccactcaaaagaaccaacggactttagagaaaaaattgattccttatctgggcaggaaatgagcttagacaccttttcagatccaaagtattgagcactactagtttcatatcaaaaggacctaagagtcaacctaaaggagctaacactggctaaagtttggataatttgaacagcagtaatgatgataactgatttggatgaaaatatatgaaaatatggatgtaaatccataagttaacaatgaaacaaaccaaaaaatctcacttttcacctttgaaacatactcgggaaccatcttatgaaaattgataaataaatagtgttgaatcaaactcctgaaaggtttctttcctcaactcaaggtaaccaagaagtcgatgagatttgttcttcagataattgctctacataatgagtaaaggaggaaagagacttagaatattccaactttgtatggttcaaagacttaaatctaagacctgaaaccatagaaattctaggagataacattggaaaaactcttctaggcattggcttaggcaaagaattcatgaccaaaaacccaaaagcaaatttaacaaaaacaaaactaaatgggacctaattaaactaaaaagcttctgcacagcaaaagaaataatcagccagagtaaacagacaacccacagagtaggagaaaatatttgccaactctacatctgacaaaggactaataatgcaaaatctgcaaggaactcaaatcagcaagaaaatatcaatcccatcaaaaaatgggcaaaggacatgaatagacaattctcaaaacaagatgtacatatggccaagaaacatacgaaaaaatgctcagcatcactaattatcagagaaatgcaaattaaaacctcgatgagataccatcttactcctgcaggaatggccttaattaaaaaaaataataaaaataacagatgttggtgtggatgttatgaaaagggaacacttttacactgttggtggaaatgtaaactaatataaccactatgtaaaatagtatggagattccttaactaaaagtagaactaccatttgatacagcagtcttcctgctgggtaatctacccaaacaaaggaaaataagtcattatatgaaaaagacacttgtgcacacatgtttatagcagtagaattcacaattataaaaatgtggaaccaaacttaaatgcctatcaaccagtgagtggataaagaaaatgtggtatatatacaccatggaatactattcagccatcaaaaggaatgaaataatggcatttgcggcaacctgcatggagttggagaccatcattctaagtgaagtaactcaggaatggaaaacaaatctcatgtattctttcttataagtgggaggtaagctatcaggatgcaaaggcataagaatgatataatagactttggggatgcgggtggaagggtgggaggtgggtgagggataaaaggccacacaaccacacattgggtatagtgtatgctgcttgggtgatgaatgcaccaaaatctcagaaatcaccattaaagaacttacccatgtaaccaaaaaccacctgttccccaaaaactattgaaataatttttttttaattccaacttctgtaaagcttttacttgataagaatacctgtgaagtattgtttcccaacaaattaaatctgaatcacattatgccaatatctccaggaaacattttatagaatatccagaggagagaggaactttttaaatgacagcatagggtgatgacagaaaattccagactgggaatctctatggagcaaggaacccttcttattcaaggctcgaaaaaagatggagaggagagttaatggtttaaaacaaacttgggattcaatgtgtaggtatgagttttgtttgccattttagctataaactataaactatacttcttggtggtaccaagaatccctgagttggatttcctacagctcaactgctaagatttgattttgactgcctaccttgtaagggctacttagagaggacggtaatagagctagaattatccagaggactggtgtcttaaaaggaaatggaaaaatgctgtgggaagagtgatgtctggtgaacccatctgaactttttgtagactgaaagttgactattaagggaattaatgaggaaataaattttcttaaaatactattcaaaggttggggaacattatgtttattgtttagtaattttaattcaaagagccccattttaaacttgatgcatagtttttaaaaattaatgttaactagtttcagctttctacatgtggctatccagttttcccagcaccatttattaaatagggaatcctttccccattgcttgtttttctcaggtttctcaaagatcagatacttgtagatatgcagcattatttctgagggctctgttctgttccattgatctatatctctgttttggtaccagtaccatgctgttttggttactgtagctttgtagtatagtttgaagtcaggtagtgtgatgcctccagctttgttcttttggcttccttacaccttataaaaaattaattcaagatgattaaagacttaaacgttagacctaaaaccataaaaaccctagaagaaaacctaggcattaccattcaggacataggcacgggcaaggactgcatgtctaaaacaccaaaagcaatgacaacaaaagccaaaattgacaaatgggatctaattaaactaaagagcttctgcacaacaaaagaaactaccatcagagtgaacaggcaacctacagaatgggagaaaattttcccaacctactcatctgacaaagggctaatatccagaatctacaatgaactcaaacaaatttacaagaaaaaaacaaacaaccccatcaaaagtgggcaaaggatatgaacagacacttctcaaaagaagacatttatgcagccaaaagacacatgaaaaaatgctcatcatcactggccatcagagaaacgcaaaccaaaaccacaatgagataccatctcacaccagttagaatggcaatcattaaaaagtcaggaaacaacaggtgctggagaggatgtggagaaataggaacacttttacaccgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaataacaaagacttggaaccaacccaaatgtccaacaatgatagactggattaagaaaatgtggcacatatacaccatggaatactatgcagccataaaaaatgatgagttcatgtcctttgtagagacatggatgaaattggaaatcatcattctcagtaaactatcgcaaggacaaaaaaccaaacactgcatgttctcactcatagatgggaattgaacaatgagaacacatggacacaggaaggggaacatcacactctggggactgttgtggggtgaggggaggtgggagggatagcattaggagatacacctaatgctaaatgacgagttaatgggtgcagcacaccagcatggcacatgtgtacatatgtaacatacctgcacattgtgcacatgtaccctaaaacttaaagtataataataataataaataaaataaataaaaattaatgttaactaatttgagataatgcctgtttatttatcttgattcttaactgaattataacgtgtttatattttattaattgaataatgttttattcttatcttgaaaattatgtgtttgcagctttgcggaagtgtgaattcagtgaattttccctagtgttatgtacattttgccataggagagatttaatattactaattaattttaactttggctttaacagtacattttagagattaaacagatatcaatctagaaaagttgtactttgttattaacttgtaaacaaatgtaataatgtccaactttaaagtctcatgtaatggaaacatgcaaggtttctgaaaaagtcaaaatgtagaaaataaaacatgcttagtttcaggcttgattcaattttagtactgatgtggggtactatttttttatttttattaccgtttttttttgagacagagtcttgctctgttgcccaggctggagtaaagtggcacgatctcggctcactgcaagctctgcctcctgggttcacgccattctcctgcctcagcctcccgagtagctgggactacaggtacctgccaccacgcccggctaattttttgtatttttagtagagatggggtttcattgtgtgagccaggatggtctcgatctcctgatctcgtgatctgcccgcctcagcctcccaaagtgctgggattacaggcttgagacactgcgcccggctgatttggggtactatttaaagttactggaagcagattagagaatcatcacttaagttctctgccttccacataagaatagcagtgccaaggaactgataacgtttactttatttctgtcataatccctgcctgcaagacacattaatgcttttcagattattgcaggctacagggattttagagccctttcctgttctacgaatcatagcagtgttcttgagagcttggattttatagagtttccacggatctgtacaacaggttttgcaacttggatggtgctggccagcagccaccttcactcagatctgcatttcctagattacacagaccagagttgtcccatctttaattaatccatgaatttagactcattcatagaatagaggacaactgcaggcagccgttcataagatgaagactgtaaattcttggttttaattaatactgtattatatgaactgagcaatacaaaggaaagtttcctcaaccactttttgcttgggggcatttagttgactaagttaaaagcagaggtcagtatcttttcagataaaagccttggttacataaaacttcagataggtagttctgaagtttccaaaatctaaaatcaacataaacttgcctattccatgatgaagttttatgttacttgtactttagtcaatcagctgacaattgttgagcattttgtgacagacactgggtttttaacagtgaaagacaaaatgctatgttattggagtttacattgaggtaataatagtagctattattttttgagaactaactgctaggcatgatgccatggtgttgacatacattatcttatgtaatgcaacattgtggttagtcacatttaacatttacatggatagtgagaacaaaaaatcaattatacccattttttaacaaaattaatttttatgcagattctgcttgtgaatttttagaatgtctacataagtcacaattttatgtactcatatcttttacttttctctgaaataattgagtacctcctcatttttgtaaatagataaagccaaaaacattggaaataaggaaaaactttttccacgtactgtgacagaaaagtgctttctgcatttgaaaaatcagattatcattgattgtcaaatttttttgttttatccattgtgtaactattagttcctaccattatcaagcaaggagttctaagttagaattcagctccatagttcctttttttaatagctagtttctttgaaattataacttttcagatcaatgaaatgtttgaagcagctgtaaaacacagttgtattatgaggtttattaaatttaacataactttatgttttcagttcagtaaaacactatttgtattctacaaatagctcagatacgaatctggcaagtaatagaattttcagcatgggttttttctttactcattggtgacctttcggttttgccagtttatgcagtttattattaatacttcagcttggttccaaaattgtttgctgcagaattagggttatatgtctttgcctcttgtatcttaaaatttaattgaattattctggtgatcattcacaataagataacacctaatcctggttggaagattccatgtttgtcacctcacctttccctatttgataaaataatggcaataaaatagagaaaatttgccaaacattaagaggcaaactccttatttttatttgtaaaccaggatactggaatgtatttcattattgtcaccctttgattctttcctcaatacaccaagaaaactttatttttacaaaattttcactttctattccaaccaacagtgagtttcacttgttccgtatctgtatcctcaccaacagttggtatggtcctttttatttttcattctagtatgtgcgtagtggtatcttaggatagttttcatttgtgcttccataatggctaaagatgttgggtatcttctcatgtactataagtgtctactcatattttgaagggttatttattgtattgagagttcttactattgagttttgagaggttctagatacaactactttatcaaataaatgatttatagtttttttgtcttgagtatatggcttgtcatttcattccttcaatggcatcattagaaaagtagcttatagttttagctatgtccagttcatcactttttcctttttggattgtgcttttggaatggtatctaagaaacctttccctagcctggggtctcaaagattttcttctgtgttttcttctagaggttttacagctttaggttttcagctagatatattaccatttgtagctagcttttgtatatattgtgaaatgtgaatcagtattcatatggatatccagttattccagcaccgtctgttaaggtgatctcttttctgtttacttacctttgtgcttttctcagaaattaattgaccctacagtgtgagtctatttctagactctgtgccattccattcatcttggcaaaagcccttgtgactcttaacaccattcatgaagttctgcacattaggtaatagcaatactactaggatctgtttcttgttttacacacttctgactccaaatgtgtgggttttccccacacaaaccaattccccaactttctggacactaattgggtatccaacaatttgattaaaatttgacactaatttcccagagttgttgcagaccctataggttaagagctgcatctcacaagactactcccacttcaaatgccggttgcaattccaggcctcctgtacctctgaccaactggctatatattgggggtttccacagccccttcctcaggtttgataatttgctaaaatggctcctagaacttaagaaaacagcttactatcatcagtttataataaaggctacaacacagaaagagccaaataaaagagttgagtaaaggatggtatgggagaagggatgcagagcttccatgacctctccaagtgccatcctcctggcacctctgtgttcaccagcctgagttctctaaacccctttgtttatagttttccattatatagccacgattgattaaatcattggccattaatgattagctcaatttctagtgcctctcccttctcttctcccctaaggtgtgaggggtgggagctggggtgggtaatgggggtattgaaagtgctaaccctctaatcacatagttgttcctctagcaactagcactgtccaatccggaagctatgtaagggcccaccaagtcaccttattaccgtaaactgaggtagatttgaaggggcttattttaaataacaaaagatgcttttctcacctgatcagtaaattccaagggttttataagctctgttgcagtaaccttggatgaagaccaaatatatatttcttcttacatcacaacatcacagcaaggaaaataatttcagtattttgcctgagtttaagatggaattgtgatcgggctttattttttccaaaggattttaactcttaaaacaataataagagataggtcaggcagtcattttagttttgattttagttatgggactaaataacagattgctcgagtcttctcacagctttactgttcacctatggcttaaagtcacagattctgaatctcagccttactgcgtgtgaaatgagaagtttagtaccaggattctatgaggccacacctacagaccacagtggaagtgtatggagagagtggtaggtggcaaggaggagtttgggctatttgcttgatgttcaatgatgaggagcatctttttatgtgtttactggccacttgtacaatcttcttttgggatgtagtcacatctttagccaatttaaaaattggattgtctttttgttactgatttgtagatttttctatatatctagttatgttattcggtttgacatatatattgtgtgtatttgttctcagtctgtggcttgtcttaccatttttatcattttcttaatcatgtctttcagtgaagagacgtttaccattttgatgaagtccggtttctctttttttttatgctagtgctttgttcatggtagaaatatttgcctatcccaaggccatgaagatattctcctatattttcttctagaagctttatagtttcagtttttagatttttatctgtggacaatctcaaattaattttggagtataatgtgagatggagagtgtagttgtttttctccctacccttcttgcccccatccttgtacacatatccacttgttttggcaccattttttgaaacagctatctgtttcttattgagttgtttttgataccattgttgaaaaatcagttgtctatcatctggactgaattctgttgcattgatttgtttgtgtatcctatgctggtactatcttgtattgattgcttagcttcacagtaagtcctaagtcttctaactttgttcttctttttcataattgttttggcttttctagatctttagcattttcatataaatttttgacttagatatgccaatttctgcccaaaaaattggattaacaacctaaatatataaggagctcaaacaactctcggaacaaaatctaataatccagtttaaaaatgggtaaaagatttgaatagacgtttctcaaaagaagatatacaaatggcaagcaggcatatgaaaaggcactcaacatcactggtcatcagagaaatgcaaatcatataaagaaatcaggcagtaacagatgctggagaggatgtggagaaaatagaactcttgtacactgttggtgggaatgtaaattagtataaccgctatggaggacagtttggaagttcctcagaaaactaaaaatagagctaccatatgatccaatgctgtgtatatacccaaaagaaaggaaatcagtatattggagagatagctgcactcccatgtttgttgcagcactgttcacaatagccaagatttgtcatctgaatagagatggtttttactttttctttcaaatctctaggacttttcctctttttcttgccttttgaactacctaagacctatggaacaatggtgactagaagtgttgagaataaacatcctttccttgttcctagtcttagagggaatgagttcaatatcactgttaactataaggttttaaaatgtcatttgtcagatttagttctatttctgagttgctgagcatatttatcctaaatggatggtgaattttgtcatgattctcctgcatctgttgaactgtatgttttttttcttcccttattctattatcacaacctacatatatatatatatatatatatatattttttttttttttttttttttttgcatctaaaacaacctagcatttgtaggataaacttcaccgggtcagagatattatcgtttctgtcgaattttacttgctaatagtttaacaatttttgagtatgatcataaggaatattggtctggaattttttttttttttttttttttttgagatggggtcttgctctgtcacccaggctggagtgcagtggcacgatctcggctcactgcaagctctgcctcccgggttcgtgccattctcctgcctcagcctcccgagtagccgggactacaggcacccgccaccacgcccagctaattttttgtatttttagtagagacggggtttcaccgtattagccaggatggtctccatctcctgaccttgtgatccacctgcctcggcctgccaaagtgctgggattacaggcgtgagccaccgtgcctagcctggaattttctttttttataataaccttactaggtttttatgtcagtattatgctcatcttatgtgtttccttttcctctattttctgaaagagtttgtgtaaaattgatcttatttcttcctcaccagtgaagccatctctgcctatagttttttttttggcaggagtgcttatcacaaatttaatttctgtcatactatagggttacttcagtttcctgttgcagtcacacttctgccacattttgtttttcaaggaatttgtgtatttcatctagttgcaaaatcattgtaatcaagtcatttaatatattaccttcttaactttttgatgcaataggatttgtaatgacatgtccctgctttcattcctaatttacttttttcttctttgttcttgattagctattgtttatcagttttttttaatatttaagaataacttttggctttcttcttactgttttttccattttagattttatttactctttttccagtttctgaagttagaagcttagattattgatatatcctcattttttagtataatcatttaaaacaaattttactgtaatttctgttaggtatatctcactaattttatgcttcacttttcgttatcaaatcagttcaaaatactttctaatttcgcttgtgatttatttaaaagtgtgttatgtaatttaaatatttagggatctttcatgcatctaatatagttctgttgtggtcagtaatatacagtgtgttatttcaggtttttgaaattgagacacactttatgactgaaaccagtttttaatgttaggcttttgattagcctagttagggttttgattactgattggacatttaataagaattaccagggcatatatccccaaatcaagatgtaataaagatggaactcagtattgtcactacttagtatctctggcatctgactaattatgttctttacagtcagagtttagggtagtttatggccaattatgagaccccatcaggactttttttccatattgatgtctgtgtttgcttgatcaacagatttttttaataaaattattttctatgtcttcagcatttttagcgataacagaaaggctgatttacaagagtttatcatacatactgtattggtaagcaattaagtcaaggagacctgagtttaaatacagttctttacttagctgcttacatgaccttagccaaattacttaacctccctgagctgtaattttctcatttgtaaaatgaggatgacaacagtactttagtagaattaagttaaatgtgtagtatttaacaaaataaggtgtatacctagtctgtgctgattagtaaaaaaataacacagcctttcagagtggtagatctttaaaaaaaaaaaaaaacctctaggaaataggaatggaagtgggaaggaatagggcaaataactgttgattttcataagaagtaatagatgatgtgcagttgtttttacattcttatccatgtgtcacttcctttttcttgaaaacaatacaaatcttttaaaatgtgagttttacattttaagtttctgtatttgtgaaagacttttaaatcttttgaaatctcacattttataaaatcaaaactttaaggcacataacatgaatttcttgctttaataggtcctattggtgatatttctgattctaaagtttgtattgtcaactactaaagacaagagtgttgactaatttcaataacttttctttgtgacttcattttctcatctataaaatcaggatatactttgttttaattcatttttgctattgggagtagatgaaataattcattaatttttaaaacatacgttagataaaggctgataattatactattgtagggattttacttgtgattaattataatgtgatgtaatatagtcaaagatctttgacaaaattgtcattatataaattaattggagtttttagtgttcaagaatatttcgtggaaaattttaagtcatttttatctcaaaatcatgaggctaatgttaaatggttaggttgcttttttttttttcattttcaggatcatgaaaactaagaaagttttatagtggatgggtttaaagtgtagaatattttgagcaaattgataggaatcaactagaaaacctgttacaggtgttttccaaaatgaagtttgcatcattagtactttaactgtagaatttttttgttggtgcatttaccttctttatactgggtgaacaatagaaacaaatattcagctgtttaatgacatttcactatatggtctcaagtatttaatcagttaatagaaatatgtatatagctttatgtaacttcagtagtattaaaaccaagttttgattgtgacctaatggccaaatttaaattagaattttaaaagagctcttagagacttcaggtaagcattagattgtctctgaatcataatactgatttcttttttaagttagaaaaaataacttgcttcttgatagctcatttaatatctttgtttattctgccatttagacaggatttactgggatacaaactacatctctttggaataccattatatgctcttgtgagactttgttttttttttttggtcttggtattcacattaccacaaattgtcttaattaagtaattaaaatcataccaactgtgatttagaagttacattaaggctgggcgtggtggctcacacctgtgattccagcacttttgggaggctgaagtgggcagatcacttgaggtcaggggtttgagaccagcctggccaacatggtgaaactctgtctctactaataatacaaaaatcagtcatgtgtgtaatcctagcgctttgggaagctgaggtcaggagattgagaccatcctggccaacatggtgaaaccccgtctctactaaaaatgcaaaaattagctgagccaggtggcgcacgcctatagttccagctactcaggaggctgaggcaggagaatcacatgaacccagcaggtggaggctgcagtgggccgagatcacaccactgcactccagcctgggtgacagagcaagactctgtctcaaaaaaaaaaaaaaaaaaaaagtccggtgtggtggcacgcacctgtagtctcagctgctcaggaggctgaggcacgagaattgcttgaacccaggaggcagaggttgcagtgaaccaagattgcaccactgcacttcagcgtgggcgacagtgaaactgtttctgaaaacaaaaaaaaaagcataaaaataaaagttacattaagattaaatatattagaaattcattgggaaatgatctcttgggatctgtgaaggggaggaggctgtggcccattttaatctaaactttaaaagataaaatgggaattcaaataggatgattttatatttgatattgggagcattatctggatgttgtgaattgttaatacgtgttttgtgaaatattctttttaggtatttctgaaaatacagtcactcacttgcctctttaactgctctgcttattgggggcatctgctttgtgaattcatgtataattaaaggataatttggcattttaaatcctaactttagtacctgttttttttgtttgtttgtttgtttttaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggtaattcaccttccttctagtcattcgtttaccaaatctttattgagggattatatgccgatcaccatgttagaggttgggaaagcagtgatatgatgaccaagagattcgtccttcataaagtttactacaggagataggcaaagaacaaaatactattagaatgtcagcagtgggccgggcgcggtggctcgcgcatgtaatcccagcactatgggaggccgaggcgagcggatcacgaggtcaggagatcgaggcgagcggatcacgaggtcaggagatcgagaccatcctggccaacatggtgaaaccccatctctactacaaatacaaaaaaaaaaaaaaaaatcagctgggcgtggtggcaggcacctgtagtcccagctactggggaggctgaggcaggagaatggtgtgaacccaggaggtggagcttgcagtgaactgagacggcaccactgcactccagcctgggcgacagagcaagactccgtctcggaaaaataaagaaaagtacagccgggcgtggtggctcatgcctgtaatctcagtactatgggaggcagagttgggcggatcacctgagttcgggagtttgagaccaccctgaccaacgtggagaaacccggtctctactaaaaataaaaaattagcctggtgtggtggcgcatgcctgtaatcccagttactctggaggctgaggcaggggaattgctagaactggggaggcaaaggttgcggtgagccgagatcgcgcctttgctctccaacctgggcagcaagagtgaaactctgtctcaaaaaagaaaaaaagaaaaatacaaacatttttgtatggttcaagcacaaaagcagcaagacatttaatactagagagagaaaaaataatcaggagaagggtcttatttccattgaagttagggtcttgtttgggattggggggcgtgacatgctcagatttgggatgtagggaagtatctgaccatggtacggagaatggacttgaggaatcacaaatggaaatagagaccatttagaaggttgtaggtgtcctgggagaggagatggtggcttatattaaaacagtgacttgtggagcgggaaagatgtgggcgaatttgggagattttaaagaatttgaaggattggatttgataattaatgggatgtgagaaattagagaaataggaggatttcaagtttatacacaaatttctgacttttggatttagatggaagataatgccatttgcggtgtgatggataacacaggacagtctagtttgaatgtgttaactagaagaaccatgagtatatccaaatagagctggctgtattgctctggagtataattaaagaagagtgcaataggattcctcaaatattattaaatgagaggaacctcaagtgacacctataattgctcatgttaggttaggttgtaactattctacagtagtaaatggtacataaggaagtataaaatctgacaaggattgacacctgcgttgacattgacctttacatgtttacaccaaagggatgaagaaaaagggctataataccatgagtaagcaatgtactcattagagtttatattctttcattgtttaatttagtgtatatttttatttgatagtcaaagtttaaggtttactctatgaagtcttatcaaagtatttaattagggtttatacatgtttttgtttcatggaaaatttaacttagagaaatatgaaatttcaaacattttaaactacatttattatataaaatattgagctatagcagtagtcttctattacaatcatagtccatgaatctaaaagccagtcaatagatacatttacactagtaccgttttttttcaagtaattctcagatatgattttccaaatgctatagggaatttcaacgatcagattaattcaagagatgtcgaaatcaaatttaaaaaaacactaaaaaatttttttgcaaagtaaaaagtatgtagctttatgaaattgaatgggacccttgaaggtggacaaggttgggaaatgacttttcctactgtgttgattaaatattaacactttctatgccttcagttgacaaaagcatctttggatctttggatctaggggtttttccaccctaatatttgtattaaggtcatttatctggaattcaagtaatttttttcctcccttgtaattgacttttatgaaataatttcttttgaaaagcattaacaagattgctttttcttaaaagaagcaaattgataggattattataatctgtactttagtcaattgcacagaatatagtcgtcctgagttatcaaaacaactaaattatgttttagtttttttgtgccttttattaccttatttgagaagtggtagtaattgataaatagcttttgcttagttaactgggatatcataatctttaattttatcctagatgggaatcttttaaaaatgccattgatattaaactacaaataattttgtttgcagagtggaaacagtgtgtttttggacagcagcaggaagttgtgcttatcacttactctctcacagtataaaagacctttaaaagcatgagttcactaatcacaataaatacaaaatatatttctgctatataacttaaaattctaactagcagtattagttataacttttttacttctttgttagcaattccttttttgatttattgagtctatattaaatatagaagcattaataatcatacatttatgtcatcagatgcttgaatgactaacacctcagtggtaaatagtaatttgttcctttaggtcttccatttattccttaagcaaccatttattcaacttcttcatgtaaggcaccgtaatatctctaaaatgtttcaaaaggagtgtgaatgtgtataaaaataactagtattgcttattatatttatgattcctttttctaggaacattccatacttatgatagatgaaatcaatgatatccgaattattggagccattacagtcgtgattcttttaggtatctcagtagctggaatggagtgggaagcaaaagtaagttatgataggaacacctgtaaatatttaatacgtaaacttttagagcttatgttttgggaacactctgaagtatggtaatatttccagattctaatggtacctaagtggccattttcacaaatgtttatgtataaggttattttctacttgacaaggcagagaatctttggagataacactcagcctaggatctagttaaacacagtactttgtaaattttgaatttcccgccttctcgcccatcctccagttttgcagtatgtaaaaatgctgaggtcagtgtgttagtccaaattaaacgtttggctttgtaatttatttaaaagttcaacttagacatggggcagtaaataaaagttattgcccacatgaggttagagaagttattcttgctattgaaatttcagaagttaggactaccaaagccagtatcattgtttctggaaaaaattgctaaagtcacatgttacccataagcagagcacccagaagtgtttttgtctctttgagaattagagcatcatagcacagctgtagtttcccaagtaatggatatccacaaaggtgtttacttttgaagaccttataaaagtcacatatttgtgctatatatgatatgataatgtttaccaaaccaaaaattaggaaagcctgaaagaataattttttcaatcttgttctttattgtaaagtcatattagtgtaaaattaaatcatttatttacacattttacaaattgactgtatgaaaataacagaattttataccacctgggacatgattagcatgtatgtagttccatttcccacagatgacaccgtttttcatgagtgttcaggtttattgagaggttgagagtggagaaggggaaatggtagttttcatagattgttctttccttccaatcccattgctacttgaatttccctcctgtatattgtcatcttctttctgtactttttcttattttcctgtagcaatcacacactcaacattatgtttggaccatgtataaaacttgtgtttgtgtccagcatgttctccatgtcaagatggtagtgttaaggtggaagagacaggaatgaatgatctagaatgaaagcctatattgttttggaatttacagtgctttatggtttgtgggaaggcatgcacatctttaactcatttcagaaatatggcatgatctcacttttactatcttttttttccccagatatttctttaaagatctctttgttcattaaacaaggatttattgagcagctgcttggcatatggcattgtttaaggcactggggaatcaggcaaaacaagacagaaattctttccctcatggaagttatattctaggggaattgaatcaagatatagaaacaagatacttgattttaatttttaatgtttaaaattgcaggctcagattgttcttttggtgatcctacttcttgctattggtgatttcgtcataggaacatttatcccactggagagcaagaagccaaaagggttttttggttataaatgtaagtaaaaaagattcaatattttttaagggtacctatttatagaattctatcatcaattaaattttgtacatttcagatattttgtaacagaattgactatggtttggtgattcaccctaatttacaatttagttttgtcccctttatgctgtacagttggagtaaaaattacttctatttacatcttttctttttcattattagcaacaaaaggtgatagaatatggagaaatcagtgctgctaagaaaaggagattttattctctactagttttgggaatttgtaactgaatttctaacttttgttctaatatgactttcattcttttaacatatttaagcacaacagtataaaagcgcctaagattgtgaaagcaattattggtataattgcatttttcaagagtgcaggccatttgatttttaggagatctctccagttgggtttgtcttatttgtttttatagattcaggttatttatgtttgtcaggaacgtaagtgaaccgtgtctccttctcagtccagcacatttggagggtgcatgatgcagttttttatattacttagtggtgttagttttgatgacttagtcaaggttatacctgcacagtttctctattgtgaagttgctgtttttttctttgcagttagtaagtgatctgtggaagaatactctgagactgttcatagccctgtcaaacttctaccaaatggcttcatccttaacccctctcacatctggcttttgttggttaaaatatgtcagatggtgatagatgcactatgaattttttgtcctctgcttcatttctcttagtcattccttctccttcttgaaacatgtctattttattcgatgtcagataccctaggtgcctaactcactggtcactatgtccattactcctgttaccccctttaaatgcagaattttacaactattatagtgctgaccttctaactatacactctcccttgggtggtgtgtattctcatggctcaaaatgctattaagggactgacatgtttctattcctgaatctctcctttaaagtccaaacataaatatatatccaactgattatttgaagtctctcctacttatttcttctcaggcttttccatctaagcaagtagctgaaaccaggatcttagtgtttcccgtcctacctgctcctcttaatttctaatcctttcctaatcagtgtatttattctcccatctctagattgaacctctgcagcaacctcctaatgggcctccctgttatcagatgttgaatctttcagtccattgtccacacaacattaatagtatatgtcatttgcgtgtttatgaccctactttggttttccattttatttaggataaatttaacttttataaaatattcacactctgttcctcagtggtcactccaatttcatttaatttttctccttactataagaattttatcttcttttatttcctcagaagagttaaacctttttctactttggggtcttcatatatgttgtttctcttttctggtatactctttttccctgatgatcacatggctgattcttgctcagcaaactcttagcttaagtattgtctccttccttatatttgcttagccttctgtaaccacattgaattagattctctctctctctcatttgttattcacaaatccctgtttccatcagaacatttactgctgtttataattacctgttattttggtcatttgctattgagactcttaaattccatgaaggcaggaacaatgtctaacttgtttatattgcatctccaagtactttgaggtgctagaaagctctagtacaggacctgacacatagtagctgctgaagtattgaatggatagatggatacattacagttagtcggttatcttagagtcagagatgaaaacactaggtctagttgaagcttttattgttgttgaaatagaaaggaactttacttagggtagctaattgtctgacagcctcaaaaatcaataggtgactagacagcagagaaagctgtggaccaaaatctatacagatagtaaagtaagttggaagctatcaaaaagttgattctatattattatgatgttgcttttgttttccttttttttttttttcttgagatggggtctcactctgtcacccaggctggagtgcaatggcatgatcatgggtcactggagtgtcgactgtccaggcttaaatgattctctcaccccagcctcccaagtagctgggaccacaggcatgtgccaccactcctggctaattttttaattatttctagagtcaaggtcttccttgtgttgcccaggctggtctcaaactgctgggctcaagaaatctgcctgcttcggtctcccaacgtgctgaaattacaggcgtgaggcaccacgccatgcccccttttgtttttctacctcccttcttgcttcttttacctcagagattgaggggattatccacattttgatttgcatttgggctagtcataacaattcattcagaggctcttgaaacataattagcgaggtatacaaaaaatgagacatgaatcagatcagatgatcattttgatggtaaaccattgtctcatacaagaaaagaacaccaaatacttgaactgggaaatatgcaaaaatttactcgttactttaactgaagaaaagttaggggtcatgtatacctattattcttgacctcagttattatagtctaatttgctctccattaattgtcaagaatattttgttctctgcagctgaaatatttaatgagaactttgggcccgattttcgagaggaagagactttcttttctgtatttgccatcttttttcctgctgcaactggtattctggctggagcaaatatctcaggtgatcttgcagtaagtattataaagtgctatatcaattatatattttaaaagtggaatttgtatatttatttttacagatagactttaaaaaatcttcttgtcttctaggatcctcagtcagccatacccaaaggaacactcctagccattttaattactacattggtttacgtaggaattgcagtatctgtaggtaaatagtttcacatttctttatgtgtcgcagaaatttcatgatgtacgtactataaatacttatttttatgacatttgctaacttttttaaatacagaaatatttcaataaaaagacatggagttgctcattataattcaaaaacagtttttagaaaactagtaatgacttctatagacattatctaaaccgccaaatgctttatggtatctccaggatttttattaattatggtaaattaaaaaattatatgaaattgcatctataaactcattccactgagatactgaaaacaatgtatgtgtagaagcaaatgaatttcactcttacaaatttctgtatttttttaagatggttatttattttttttttttacagtatatgaagattctttcaaggctattaagcaatgcttggcaattttttactataaaaacactggttttgaagattaggacatactaagttttacttaggaaaagttttactaaattcttagtaaattgaatgaaagtgatttcaaaaccatgttattacttcatgggatcatggatcaacttcatggttacttcatgggatcaacttgaaaggacttaagtggtcaaccagtctctaatccttttcttacagatgagaggatagaagttccgagatttcactaccaaagatagtggcatttgttttagagaattgttttcatggcaaagaaggtttttttgttgtttgttttaaataaagtctttaaggctattttctatgaattactattagtttacatatggtttgcatttgtcaagctttacagttaaatttcttaagcataatgcaaaagtaaatcttagtttaatactaatgtaaagaatcataaactccaagcccataggctacacaatatgaggtttctattggatttggtaagaaaatttcatttttgctatatattcactgatttgctgggaagtaatagcagaattatatttataaactctactatttgcttaaatgtaattttgaaatttcactacatgacagaaatactaataatatcatggtgagctgaattgccttttttgcttgtttgtttttgtttttgttttttgttttttgagacggagtctcactctgtttcccaggctggagtgcagtggctcgatcttggctcactgcaacctccgcctcccagattcaagcaattctcgtgcctcaccctcctgagtagctgggattacaggcacccaccactacacctggctaatttttgtatttttagtagagatggggttttgccatgttggccaggctggtctcaaactcctgacctcaggtgatccacctgccttaacctccccaagtgctgggattacaggtgtgagccaccgcgcccagcctgaattggcatttacagaggaatttggatttcatttatccttagaattcacacacaaatctctgaaatttattttgaaaacacggatgaatatatatgcctagcaaaatatatgggttcccctaaaagttcctagcatgcttctatacattattgctaaagaaaatttaggcataaagtgacataattgattatgttttaacttgtaaaatagtttgttacagcaaatattttctatttttattttaccgtctaacattgctggccctcatgctcatttcattctgtctgcattagcccttggagcaataggggtaaccccttgatgctgatgttcagtagctaggccagtaaaggcagcctctacaccagtggttgttaagctcaaagaagtggaaccttccccccccaaaaaatttcaggcatagactatcagaatacaaagcacatgaaagtatagttactttagggctggggggatttgcaaggctctattctccccccattccccagttgtttcagaggtacctttatggaaacatggttttgcaaggactgctctgaatggtagatgaaaaaattgaaaaacaaagaactgtatagtctgcctagtcattaaaatatcctcccttctcatacttagttctgtttattcaatttttgctgtcatgcatgtaatttttacctcaatatatgatgaaataatactgaaaaagtgcttcagaaagtaaaaatctttaaagtataaggaatggtaattaccattagttgtgcattacacgttactctgaataataaattgcttgtttcaaggtcacttttaaaatattttattatggaagttttcaattttatggaaaagtagggaggattttcaaattagctcaataattattacccagcttcaaaaaagttagcaaaaatattagtacatggttaatcttgtttcatctatacccaagtcactctgctctatgggttctttttaagcaaatcttagataccatgtgttttcttctttttaggataatcatatttgagacagagatttaaatataattataattcattaacattcaaattattttccctcacagaagagtggtattacctgaagtctgatttttagccacattcaagtataaaatatttggagtataggaaaacatcactgccatttggaactctttcagtacagtgttttcatatttacttaaggacatcttaaccaaataggctaggaaatagtttgctagtataccattttccacaactctttacatggtttttaagtgtttatgtgtaaatactattctttataaaaggttcagtttcatcacatattggggaccatgatgctttacaaattctgttcaaggtaaagtcttaattgtaaatgcaatgtatgctattataagggagtagatatgtagtcactactttggtttctttataaatatatatatgtatataaaattctgaaatgaatgtagatattaactatattattcttgttgtcacttgtgctttaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtgagcattgactttgtaatatacagacattctgtatttatctaggggtgagactactatcaaatatgaccattcagaatatagctgtaacatagaagggaggacagttgttattttttttaatttttaattttttcttgagatagagtctcactctgtcgcccaggctgtagtgcggtggtgctatcttggcttgctgcaagctccgcctcctaggttcaaatgattctcttgccccaatctcccgcgtagctgggactataggcgccagccaccacacccggctaatttttgtatttttagtaaggatggggttttaccatgttggttaggctggtctcgaactcctgacgtcaagtgatccacctgcatgggcctcccaaagtgctgggatggcaggtgtgagccactgcgtctggccagttgttctgtatatcccctaaaactgtaaatatctaattggacaaactaaaatatgaatggataaaatctgaggatgttcaagagcaaagagcccctaggaggtaatgcttttataacagcatgtaatatatatatatatattagtgtgtgtgtttttatatatgtaatatgtaagtgtactgttttagaaagcatggaatcatcttgcacatggtcatatttgtatgggtctgtttttggattcttgattctgttctgttgatcttcgtgtctgtccttgtgccagtaccacacattcctaattactgtagttaaatgataagttttgaggtcaggtagattaattcctcccattttagcctttctaaaaaaattgttctagctattttagttccttggtctttccatataaaaatttaaaataaccttatgtgtgtgtgtgttttaattaattaatttactttttaatatattttcacttcagtagtttttggggtacatgtggtttctggttacatggatgaattgtgttgtggtggagtctgagattttggtgcccctatcacccaagcaccttacgtttatttttaaaaagtcttgggattttgataggaattacgttaaactggtatatcagtttggagagaattgactttgttgagtgttcaattcataaatatcatctctccatttatttgtattttctttgattttctttcagtcagcattttgtagttttcagcatatacgtcctgtatgtattttgttagatttacgagtaagtatttttattttgctcaatttaaacccataccaattaagttcagttttctaattagtgttgtcttcataattgctttatttataaatggcctttaaaaaagcattgatcagtatcaatagtagtgttactttattagatatggctcatataaagtcatgcagcatgaaatcaccatttaacatttaacaacagaatttaattctgaatggatactagaaagctagtgaatttctaaaacatacaaactagacaggttagtagtacttctccagtatttggaggctgtcagtttctgctgtttattgttacctctattaaggtactgaaaatgaaatgaagttttagtctgccagatttatgagtttttagaaactgaaaaaagattatataaggggaaaataaattactaaaattaatttggaggataattttgagttgtttgttaagtcctaggatggtagaaagaacacaaaggtgtagattcaggagattaaatcaaaatattctattgtaaatttatagagtacatggttctgctgatttcaaaagaaaaataaaaattttgctttgtaatttttttcagtattgtataaacagaataatttgtattttaatgtatttaaaattatgtgttttatgtacaatctgtaagttttacaatacaatttttaactaaaatttgtaaaggcattgtttttattataaataaaattatttataataaaattatttattataaatataataaaattatgtagttttaagcaactgactgtactttcagtggttacaaatattgaacccaattatgtaatagaagtttgtgttttctagtcataagactaggcaaaattgtaggaatgaaagaaagtattcatgtccagctaatgattcaggccaattctgacattgatactgtgtatggaaggcacaaacattggtctttgcccagtgactgaaaatgccagtcagatttctgtgtggccttaagatagaaaagtttgttgtctttatcaagtttagttatggactcattcgagcaaagaggaatttggtataagtaaagctgcttttcttatttaaaggaagtaaacttttcaaaaatactttgtaaagcgatacaacatgagggaaaatcttgtgaaaatataaataccttggcatttggagagtgaagaatggtggataggacataaatgaggagtatgtaagttggagtctccatcataagatctatacaagccatactttataatcatcttttcagacttcagggaataaagttatttaggttatcttcttgctcttaaattttaaattgtgtatatagtcttatattgcttgctatatttctacattttaatgtcctctaaaacctttgactcactgttgcctaataaacaaaatgcaatctttagtctaaatcagtcagagcccttcatacctcttcttaagcctcactgccttctgttccgagtggactccaggcactgagtgtgtttgtacacacacacatgcataccctactcttttgctttagtcattgcttcactctgcttggaatgcacctgtggtttattttcccatgtccaaatgtgcctgacttcaaggccacttagttctgtgaagattttcttgaatcccaaatcatcttcaacacacacccccacacagacttttaccattcattttatttacttgctatcttttagcttttattagacttttgtctttttttcccctttagagacaagacagtctttttttcatctttgtttccactgtatattgttgacactaatatcattatttacattgaatatcattatccttgctgctgatattttaccattaaatgttgagaagtgcagaggttactggataactgttcaactatttaatagaaaacagaaaacctattatagcaggccccaaaacatagtatttccagatgaaaagcctggatcattatttacttcaatttataactgatggaagaagggaaaatgtattgtttcctcaacatggaagaggaaaggttatagtaatgctggtggtgtcagttttgccttactcctacaatgcagaatgtatcatatactctgttctctactttcgtccacttatctctttctttgtacttaatttaactttgagatcattaagacagatgtagaattttgtatgatctaatgaggctgtatagcagaaattgggtttattcattttaatcttgactcatctgtcctttacaatctccttccctaaagataaggttgtcagttctaaataatccagcattaattaccatgaaaaatagtgattatgaaaaatgcacagcatatatgtaactactaaattgttattaaagggctgagtagaaaataatcttttcagattttctccccactcttagaagtctgctactgtctttaaaacacttcagagatgtattcttcatatttaaccttaaatctaatggaagatctagggaaagatgtttagtcaacagggtggtttatgtgtacatgaaatcagacttatgcattgtggacagggattgtacccgttgctaactttccattttgtttaaacaattaaattttacagtaaagtgtgtgatagaaacagcttaaaacctgatttccttatctctttggtctcagttgacatgttcttagtcaatataaatgaaagataaaatctccaccaatgaagcagagaatctaggtgatgatcaccattcactgctgggagatttataataccattcacagctgttcaagttgacaatagttgaatccactaaacaactcctccactttaattttgtgttttgacaagtttcacagattcagaagtacacagtgaatacctgtgtacttatccttcagttatatttactagtttatattttaccctatttgctttgtgtgtgtatatatatagtctttttctcctcaaataagttatagacatcatgacacgacgatcattttgaagtatttaatgcattttgtgtaagcacaatatggttatcctacttaagaaattaaacactgatgaaatactgttatttaaatatacatcctatgttcatatttctccacttgtcccagtaatgtcttttatagctattttttctaagtccaggattgatctagggtcacacatggcatttagttatagtgtcattttaaaatcatttaatctaggggagtttctagcccacattaatcttcatgacattgacattttcaacatttgaaccaggttgtttttgaattatgcctctcagtttgaattcacctgaattcatgatcttagtgatcaatcctatgttgttggtgttttttttttttttaagtcttctaagaggaaatgtttgaacatgtacacagagaaagcaatataatatacctagtatctacattacccagctttatcagttatcaatgcatggttaattttgtttcatgtgtaactcttcctatcccagattatttagagcaaaaccctagactttatatcatatcttttcgctggaaatatttccacatttagctctagaagataaaaggttagaaaaaaataaccacaatactatcttaacataagaaacagccttcctaatagaagtacatgatggcacttacacagtattcttgccaaaacttgtacctcattttgattaactgtctagatagaaccagtttactagaattatagaaatgagaagaggttaagcaatacaatgatgatgaagtcagaaaaatccagagtatgagatctccatgggagaaatgatagaaaaataataaaaggaaaaggaaatgtgaacctgttgattgaaaaagactgaagagacgcataaaccaaatataatgtgtaacctttttttttttttttttggatcctgatttgaacagactatttttaaaagataagaaaggacaatttagggaatttgaatgctgacttgccttttttgtggtactgttaagcaattattaagtttctaagctgcgacagtggcattgtagttaagttttcaaaagtccttacctgttagagatacgtactgacatatttatgtgctaaaggatatctgggacttgtttcaaaatattgtggggaatagccctaagttgatcattgttgaaattaggtgatggatgttagcagttcattacactcttctctctgccattgtgtgtgtttaacattttacgaatgaaaaggttttcttaaggtaagggctagtggtaaataaatttgtttcagatatttgtaatgcacatagcgttgttgttattattattataaaatgatccctagtgttaacctccttcaagatgtgaccacataatattgtgttattttctgaattgtttgtgagatttatttttccatttttgtcacttttatttaaggtaatgagtatggtgtcaggatttacaccactaatttctgcaggtatattttcagccactctttcttcagcattagcatccctagtgagtgctcccaaaatatttcaggtaagtgtttttatattacaggctttattaaagggagagttaaagtaatacttctcaatttagaattgttgctattttcaaattatttgcttctatcaaccatatatacatatatatgatatatatatgcacataaagatatacatagttaattttatatgtgtgaatgaatgtgaatgtttatataaatatttgtgcatttgctgttaaggtatattctttgagtctttttagaagtgctgatggatttttgcttttttgacatttttagcatacattttcaagatgtttaaggtataggagtgcagtctaagactgaaaataggaagtagtaaaatatctttgttctagtcagtatgatatcaacctaaatattttattttacaaatatttaaacacctaacgtgatatacacattgtgttcattacttaagggtatgatgatgtataggatagacattatctccttttagtgaacattaaacagctgaatactgatgggaagtactttttattggtaaatcaaataaatgaatgttgattctgcagtcttgttcttaatgctgtatttatagccagtgagtacagtaaaggtagaaaatatcatttaagacagactttagtaatgttttaagaaaggtagttaagtgttataatcaagatttttatctgctttaagatttcagcttgtttttcttaaaataggtcacaactatgtcatatttatcaagcttccaactttgtttttacttgtatgcctgcttctgtgatttcttcttcataaaatttaatttcaacatggggatagggtaaggcagatagaagttttgaccagtatccttctgatgtttgaaatgcttgaatttcctttacattttgtaggtgaagcagtatctgggacaggataaaagagatgaccaagaattagaaacttgaatctcattcctgattaacctattagaactatcagcaaatctgcatgtctaattttaatatgtttcattttaatgttttctttcattaggctctatgtaaggacaacatctacccagctttccagatgtttgctaaaggttatgggaaaaataatgaacctcttcgtggctacatcttaacattcttaattgcacttggattcatcttaattggttagttatataaatggtgtgttattgtagatttttggtgcatattagttctagacgttgaattattaaattattaacaatgttatcttggtatactaagtttctttgtaatcaaagaaagtttataaagtactgtaagtaatagcatgagtacatatttgctgaaattattgccattactaagtcctcattagagctaaagagaattcctaggctctttttcctaaaacaaatatgataatggcataagggaaaggattctagtgtcccctgtgacatcagtgcctttgatgatctatttttttggcactctgcctctgatcataagtgagctctgttgggtcttccactactaaagatgacattggactttttaaggtttaaagaattttgtctaacccctgagactagttgacattaaaaggctgatgtaccacaagtgttgtgggactatgtggaaactaattctcatgtgatgctgttagatgtgtatttggtgtagccacttgtggagaacaagtgggcaatatctcgtaaacttttctgtgatcaagagttttccttctaggtatgtaccctatagaaacttgtatatatacttaaagagccatatacaataatgtttctagtattattcattatagtgaaaaacgaaagccacctagatcaatagaagaataatatgcagcagttaaaaaaaggaataaacttggttttcatttatcaatatggatgaatttcaaaaataaatgtaaaagatcaaatttcagaatgatacatatggtatgctatttatgtaacttttaaaacacccaaaacagtactattatgatgcatatagacgatacatgtcataaaactatataatatgactggacagaatataccaagtttggagatgtgtgagataaagtataaaggggattcaatggtttgcacaggactggatttctgaaaagtaaagtatatgaggcatatatggcaaactctaaatgtttatgaaagctggatggtggttatggggtgttatgttgttatctaaagatttgaaatacttcataattttaaaaagttaaatgtctaatacgtcagtaaatctcgcatgtgtttgttctgcagctgaactgaatgttattgcaccaattatctcaaacttcttccttgcatcatatgcattgatcaatttttcagtattccatgcatcacttgcaaaatctccaggtaattttacatttttaaaaaagtttgtaaatatcatttttgattgcaaagaaaataaaacttttgccacattttcaaagatgttatgtgtggggttagttcattaatgccaagtctgtctttacagttaattcaaattaagctttcaaagatctctttatcagtaagtttactgataatattgtttcttatcttcaaagcatttgataggattaatctctaattctgataacactgaaaaattgttactttttaaaaaaactagtttttcagtctttagctgatttctattttagttctaagaacatcattatgatatagtttacctgtaagaaaatggttttaacacgatgagttctgtaaaattctgaaaaggaattttaaaattttaattttaaaaaaggaacaaaagcattgttccttttaaagatttgaaagtctgagaacagggaacatataaagtatgagaactttggacacaaacattctaacatcaggtttttactttaaatgtataaattctattgaaattatttttttaaaataattttggctttggaactacctaccaatgaaaattgaaaaacatggtcttcaacattttttaaagtgggcttccttcataaatacttcactaaatgggaagatatgtgtttctgtagtcagctcttagtttttctagcaagttgattatgtttttaatgatttttatgaacattttgtttgaaatgttttatatattcattagactatggatatgggtcatcctagaaccagaaaataaagcctagttactactaaggattcaatttgaaacctttctctttaaaaccttctatactttttaacattcacctaaggtaggttgattttttttttatgaagagtttattgaatacagaactagtcaaatacagtaatgtggaaatagatgttaccttttcatagccatcaagaattgtcaaattcaattgtgatcaataatagtctttgactttactattcaatattagacttatacttaatgcttaaagtcctctcagtgtggcaaccataaagaatgttattttttgaatacatatgtaccattgtgtaaagcagatgaggtatttgtgtgacttttatttatttgttattgttaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccaggtcagtagccttttttgtttatatcccaagctagaaaacatctagaagctagaaaacatctagaagttctttgttatttttcattttaagcatcatcttttgtatatttgaaagctactttgtataaaacctaaaatactttatttccaaactcctaaagttttttttttttcaaatacatgtagttttaataaaacagttactttgagattttttattctggtttccattctcactcataaattaaattgatcctatttgtagaaaaagaataaattcatgtaattaacattttgctgcactcggtatatttttaaattattttttgaaaggatccagttacagtactgtagtagctgtatagcctaataagctaggctatttatacatataacctactgtggtccttgaactggagtgagtaccatggagttaacaaaatactagaagacatagtatctttcccactaggttactgtgtagcaggggaaattggacaaacttgttttaactgagtaatgattaatgatttcctagtatgtcgtattgataacagctaaacgtatctccaggtaagatgatgatgctggagtatgttaggattggtcccggtattgagcattataacccgtgacacatgaaagacctgatgagaaaggcttcatctgggctcaatagaatagactgggaagagattacaagagtagtttcaatatagtagttttaaacagtaagaacacattttgtaatccagatatgaaataatgagcttttagattaaagtggtagctccagaaatgaaataaaacattttagaatcagttatttctctaacatacctatcaagtctataaattaacaaatgtctaaaatcatttgaagtccaagttgtttattcaataagaaataaaattgtcctgttcaaataacccaaacagttaagtactataaataagtatttcttaacaattagaaatttgctcatttccatttagacctttggctatatacaaacaataattttaacatatttatttgtgaaagactctttcagagttgtatgcacagcatgtctgcagccctgtcatctcaatcttttctaagtaatactttttctttaaatgaattatagttcagattatcagtcttaatatcttgctgtatatgtgaactattgaaagtacaatagtgtatttcagcaattgactttttaaatgtgaaagcatgtttaattctctatgcctcagattggctattgattggttgttattactgatgttaatgctgcatgaacattatcttcccacagatgtgaattggggatcctctacacaagccctgacttacctgaatgcactgcagcattcaattcgtctttctggagtggaagaccacgtgaaaaactttaggtaagtgataaagaaggaaacatggaagcattttctctttgctggccagtcagttcttatttttcattgacattttcatgtacatttcacatttttaatcggtcttgggcagtttaattattcaagaacaaaattgtacaaagaaaaattaatatctaccttaaaaaatgttatgagggttttggaggtttctcacttgaagacttttaaatgatgggtatgataaagtcaaagtttgattttctccatgttcattaaagttacgtaactgtgtaagtatgagattcataaagattttttgacatgcgttattttgtaacattactgacacactaaaattgttagttgtgtcttaattagtgattaactggaagcaacttatagtgacaaagaatcagtgcttatactaaagagcatttattactattttcctcaataaatgactttaagaatatattatcttttttggctgggcacggtggctcacgcctgtaatcccagcactttgggacgccaaggctgggggatcagttgaggtcaggagtttgagaccagcctggccaacatggtgaaaccttgtctctactaaaaatacaaaaattagccaggcgtagtggcgcatgcctgtagtcccagctacttgggaggctgaggcaggagaatggctcgaacccaggaggcggaggttgcagtgagccaagatcatgccactgcactccagcctaggcaacagagcgagactccatctcaaaaaacaaaaaaagaatatattatctttctaatagtttattaaccatcggtataaactttctttagtcatgagtaatccctccttattggcttctgcatgataaacacaaatcttttccatgtttattagtaaaccaaaagggaaaataatgtttttaaagaaaccctgaaacgtagataaatgtcaaaagagaattgctctacccagtctctctctcagtaagaaaagtaattgtttatttttttgttactcttttgaattccccccttcctttttgctagactaaaaaggtctgagagaccacacgcaggtcttcagctttagggtagacagaaatggagaagaaggaatgagagccctgggaggaaaacttttcacttcagcatattttggatagtgatgtcaaggatgacagaaaatagaaattattattttatgtaaaaagttgtatcctagaactgagagtatgaccaaaagcctatgtttatttgccgtcaattaaaaaaaaaaacaaaaaaaaaaaacctcttgctttggctcattgtagtaaagccaacattaaaaaaaatttatttttgggcatgttggtgcatgcctgcaatcccatcactttgggaggctgaggcgggaggatcacttgagcctaggagttggagaccagcagtttgagaccaggctaggcaacatagtgagatcttgtctttaccaaaaatttacaaaatagccaagtatgatggtgcatacctgtggtcgggagactgaggctggaggactgctagagccaaggagtgtctaggctatagtgagccatgattgtaccactacatgctagcctgggcaacagcgagaccctgtctcaaaaaaaaaaaaaagttatcccagtttggctttttaatttttattagaattatacgtgagtattgtgtaaagaggaaaagctagtctgcaaggtttgtcatgaaaatcaatagttgcctgctcctcatatccctctttctctcacaactacaggtaaccatgttatttacttcataaatagcatgcttgtcttgctgcagagtagtcccctgttatccacaggggttgtgttccaggaccctcggtggatagctggaactgcagagagtactgaatttgattgtcatgagtcagaacacctttttgttgttgttcatgtcttctatccacgaagttagtgccttttccatcttaactaagcccttattgcacattacggctgtaacttttacagtttgaagtgcagcagcaaaactagcatgagtttctttttccttctttacagtttcacagttagaagattcattttcttactgtagattttagtaacctttgcgtaaaattttttttctttccttaagaactttcaccttttcacttaaaggaagcattttacagtttttttttttggcatattcaaattgccagcatcactactcttgtgctttgagggcatcatgaagtaaaataagagttgcttgaacacaggcactgcgatatgcaacagttgatctgataaccaggacagatgttgggcaggcagtgtctgtagcacagagacgctggataaagggagaatttatgtcccaggccagatgaagccggatgttgagaaatttcaccacactactcagaatgatgcataatttaaaacatgaattgtgtatttatggaatgttctatattctgaaacaatggaaaacaaagccacagataaggggggctagtgtactttttgatttttaattttggacattatcaactgatgtctttcatctacgtatgcctaccacatgcatgcatccttacctttataccccatcctcccaatacattttatattatgattttgattagatcatatttggtatttatatttttaagacttttaaacatgctgtaacagctgagccatgtagtaaattattactgttttttctttgctacatagcttttttgttttccctgaaactaataatttttcttcttccttaactgtattcatcactgtcttaaccttcaccaaacttgccaaaagatttttgttgtcttcaccttgtagtttcttactgtttactgtttctttaatttgggttttgggatttagcctggtctgaaatgaagtatctctaatacttggccagggaagttcggcattggtaagtggagcttgtcagttgaagtccttaatgtagattaatgtggctttgctggttctttgaggaatgtgattatcttaaaggctttctttttgatctgattagattttccagaaaagattattttaatcttctgcttgtaggtagagagttctgggagccaagtggggaaaggagcttaaaggtttcagggttcagtatatacatgttctttaaactcttctattaaatgtagcttacttctgcccctagctgttgctggtgactcccagaccagggactctctccagcaaataagccccagcttagtagggttggggaggttcagggacagtggcaatgatttagtgatggaaatgatttagatccatctagttacttcttgtgtaaacttttactttctttaacacactgttcctgccacttccagagggacctactgttcctaactcctaggcattttggtgatttttagatgtaaaatcaggtagtttcatagcttcctcatgtgctttccagatttcatttttttctgatttgtcaaatcctttacttttcttccagttgctttctagctttcagtattccagtgctgttgtgctccagatatttttgtggtttgtgcctttaaaaaaaatctctttatgccgtggagagttttgagaaaggagattacatcaaggtagatgtgcactctgctgctgttactcaaagtcatccctaataaactttgtactgtaccatttttggtatgatcagactgtaccaaattatatctttgtggtttattgtttagtaaagataggggctacaagttaatttctcacaataacgggttctattagggtatgggttaaactactataataaaaagactgaaaaatacagtggctcaaacaagagagacattggtgtcacatggtagtccacaagtagacagatgtttcatagcaggtaagcagatttgctgtactttggtcactcagaacccacgttccttatcagtctgccattccctagctgtttttgttcatgtggtcaaagtcatcactgcatccacagtctagctttctggaaagggggaagaatgtatggaggcagcacagcttccttttttaaaggacacgccctggaaataggaacatacttatgggctataagttagtcattgggccacatttagctcctaggaaggctaggaaatatactgtctggctaaggagttaatgtaacttgctaaagctcgaaagtctggggcatgatttcatgtttgattgcctcaaagcaactctcccagacagaattgcttttccagctcatttgctaaaattctaagtaagatggtattttttgaaaagtcgttatttaggttttcatcctcattttaaggactcctgtaaacgttaacgtttaagtcggaaattgtagtctgcaattcactttctgttatagttcattttgattatataaatccttttctgaaggaatttttgccagtctgtttggacctaccaaatggagacctgtatattttttacattaaatatcagtgatttccatttccagtcagtgaaaatcaagagctacaaatatatgaaaggcatgccactgtctcacatttgcaaaggcaattgaattctgttttggctttcatcattgatagctagaattcagatttctagttcaagtagaaatctttttttcaacataggtgattttactcatgggacgacagtcattaatgttaagctagattagagagggctgatatcatgaagtggtaataattatgaagtgatcaagctaagaaggaaagtgacctgttttgtacatgaaggcaaacctgtgcttgcaggaagttttgcaaactctatgaaagaattattaatagaatatttattacctttagaaaatgaaaaattgttacatatttgaagacaaagcagtgctcgcaggaagttatgcaaactctgtgaaagaattattaacagaatatttattaccttcagaaaatgaaaaattgttatatatttttttaactagcatgataatttctttctgtaatacctaccagaatcttgatgtataatagtacctattattttagagggacatttggcatgatgtttgttccaagattttgtttctgcatttctcatgtaccaagaagtcctggttaaaaatagtctttttgagaatcctgtggcctgtgtcttaaggacagttgtatacagaaagcttcttagggaaacaacttaaaatcttgttgccagaaacacaaatttatctaattttgtttgtcttttcatcttaaattaggccacagtgtcttgttatgacaggtgctccaaactcacgtccagctttacttcatcttgttcatgatttcacaaaaaatgttggtttgatgatctgtggccatgtacatatggtaagtatcaattttgttttctttttcaagtttttttttaaagttttattttaggttcaggaatacatgtgcaggtttgttatgtagctaaattgtgtgtcacaggggtttggtgtacagattgttttgtcacccaggtaataagcatagtacccaataggtagttttttgatcctcaccctcctcccacccagtagcctcaagtaggcctcagtgtctgtggttcccttctttgtatccatatgtacttaatgtttagctcccacttagaagtgtgaacatgtggtattttgttttgtgttcctgtgttagttcacttaggataatagcttctagctgcagccatgtttctggaaaggaagtgatctcattcttttttatggctgcataatactccatggtattacaggtaccacattttctttatccagtctaccattgatgggcatttaggttgattccatgtctttgatgttgtgaatagtgcttcaatgaacgtacgcatgcatgtgtctttatggtagaacaatttatgttcctttggatatatacccaataatgggattgctgagtcgaatgatagttctgctttgagttctttgagaaggccaaactgctttccatagtggctgaagtaatttacattcccaccagcagtgtataagtgttttcttttctctgcaacctcaccagcatctgtgttttttttttttttgactttttaatgattgccattctgacaggtgtgaaataatttttttatactaaaacttttatgctgtatataatttgtaatttatagggctttctagattggaaataatttgacaagccaactttttttttttcaggtagttgtttttttcaaaatatttttgcccctaaatggtcttgaagtagcatttttaaacagttactgaattttgagctctcattgtttttcttattcattatgagtagattttaacaaactgtattgtccttgtagagtggtttggctttttgatacctatggagtagaaattcactgttatttttctcactaatatgtctgaaactgggccccttctttacaccttatacaaaaattaagatggattaaagacttaaacttaagacctaaaacataaaaaccctgtaagaaaacataggcagtaccattcaggacaaaggcatgggcacagacttcatgactaaaacaccaaaagcaatggcagcaaaagccaaaattgataaatgggatctaactaaactaaagaacttctgcacagcaagagaaactatcatcagagtgaacaggcaacctacagaatgggagaaaagttttgcaatgtatccatctgacaaagggcaaatatccagaatctacaaggaacttaaacaaatttacaagaaaaaaaccaccctgtcaaaaagtgggcaaaggatatgaacagacacttttcttatgtggtcaacaaacatatgaaaaaaagctcatcgtcactggtcattagagaaatgcaaatcaaaacgacaatgagatgccatctcacaccagttagaagggcaatcattaaaaagtcaggaacaacagatgctggcaaggatgtggagaaataggatcacttttacactgttggtgggagtttaaactagttcaaccattgtggaagacagcgtggcgattcctcaaggatctagaactagaaataccatttgagccagcaatcccattactgggtatatacccaaaggattgtaaatcattctactataaagacacatacacacgtatgtttattgtggcactgttgacaatagcaaagacttggaaccaacccaaatgcccatcaatgatagactggataaggaaaatgtggtgcatatacacaatggaatactatgcagccataaaaaagaatgagttcatgtcctttgcagggacatggatgaagctagaaaccatcattctcagcaaactaacacaagaacagaaaaccaaatactgtatgttctcactcataagtgggagttgaacaatgagaacacacggacacagggaggggaacatcacaaagcagggcctgttgggaggtgggggggctcggggagggatagcattaggtgaaatacctaatgtaggtgacaggttgatgggtgcagcaaaccaccatggcacctatatacctatgtaacaaacctgcatattctgcacatgtatctcagaacttaaagttttatatatatatgttttataaagtcccaagaacacttgggaacatttacttaccagaaaaaaatgggggttggaagaaataggcaaattgtgataaatatctccgggggaagtaatatctctggtatgtaagaagaacaaagtgaatgctgaatttctaagttcaaacacttagttgccaattcttttttgttttagccagaagaaaactattaaaaataatgaaccttttttaatccgaaagtagtttttagttttttggcattgtgtttattaagaacagactggatgatggcttacctgtgctgcataagaaataggggtatttgttggatcagcttctctctcaatttctgttcttcatcttgtcttgattctagaagtgtatattgtatacctcatgtctcatccccagctaattgttctgcttatacagtggcaaagtcaaggggtgtgtgtttgtgtgtgtgtgtgtgtgtgtgtgagagtgcgtgtatgtagggtggtagaaggatacttggagacactgaccccacttgggacttgtggagttttctagtttgtctctgagctgatcagctaaatcaagccttgagcataagacatttacaaatgagacaatttccccactacaaaaggtaaattatatttttacttatttacatttagggtgtgtactcttaagcttatttttagatttttgttttatatatttgtgtataacacattttgtgtattgcttgcaaggatcaaaataagagttatgagttaacaaagttcatttagtttctcctgttatttcatcctttaacagaattttaaagaaaaatgcattaatattttatagctcactttgattttcagtgatattctcaagttagaattaataacacagacatttgggagtaacaaaaacaaaactagggaaactttctgtagaaaaatagaaggtggttattttactctgtataatctcttcatttttgatagcttctaacctctttacttagaatggaaacttttaatttatttgtaagtctgtgtttcttctcttattctttctactggcatccctgtgccttagctattccatcacctctacctttttgtaatcttatgtattaaaaagactacatggaaataaaatgctattattatacttctgaccctacatttagtcacctgtttcaagccagtataacaggatgaatcatttgtataaatgtgaagttgcttaccttttaattaaatatattattaatatttttattcaaagggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggtaactttgttaatgcttttcaaatgcctacattttagatttgtataagctttttaaaactttttaattctagatttcattcttcatactaataaaaatggcaaatctttttttatgtctttattaaagtaaactactttggctcacctggctagttcagtcagtaaagcatgagacactgaaagtaaactacttggatttgtataattcagaattaaagggacagtagaaatgttgtgttgttctgtgttaattgtgtaattgtggagctactttgttaaagtagaggtgggaggctcagagtattgtcttctgatccgtttctgttgtgtgtttcttagaacttgataagcacagggttaagaatagccaaggcaatctaggaagaagggacaaggtaggcttgctttataggaaagaaagccctgtcaaaaaactgtagtaattaagacattgtggtgttgaatatagcgatagacaattagacgaatggcacaaaacagaggaaatagagctacccgtatcagaaacttaacatatatgacaaaggtgctattgaaagcatgggccagaataaatcattattaacatgaaaaaaaatactagatccttataaaaaccacacaaaacacatctccagatggattaaatacctaaatttaaaaggcaaatttgttttgtttttagaaaaaattctaaaacaattttatgacctttagctagggaagaatgaggcaccaaaagttgagttcagtagttttgtagtttaaaattttgagattctaaagaaaacatgaaaataaataaaggaagcatagaccaagggaagatggtgatcctaacatgtaatcaacaaaagatatggtccagagtacagacagaaatactatgtcagtaacagaaaaaaagcgaaagatatgaacagagaggaaaactaaatgacagaaataaaaattaaaagcacaatatactcttattccatatccattagactgacccaaaattaagtctgccaatacagagtgttagaaatggcatagagcaagctggtccaacccgtggactacatatggcccaggatggctttgaatgcggcctaacacaaattcgtaaattttcttaaaacattatgagctatttttgtgagttttttttttaagctgatcagctatcattagtgttagtgtattctgtgtgtggctcaagacaattcttcttccagtgtggcccagagaagccaaaagattggacacccctgacatagagcaattggaaatctttgaactgctgtggtaatgtagattggacaacaacgctgtccaaaataggaaagcaacctggcaaaatgtcctgcaaatttggtttgaatattctaggacactctcttcttaggtgtgcatctcacaggaacttttgcacgtgtgaagaaggctatatgaaacttcaggccgggcacagtggctcactcctgtaatcttagcactttgggagactgtgacaggtggatcacctgaggtcaggagttcaagaccagcctggccaacatggtgaaaccctgtctctactaaaaatacaaaagttagtcagttgtggtggcacgcacctgtaatctcagctacctgggaggctgaggcaggagaatcacttgaacccctgaggcagaggttgcagtgagccaagatcatgccaccgcactccagtttgggcgatagagcgagaccccatctcaaaaaaaaaaagaaacttcatggcaacgtcatttgtaatagtgaaaaagaatcggaagtaacaaccatcaatcacagaaatgaaaatgtagtacaaatgtatggtagaattctatacagtggtgaagaggagctatatatatcaacatggatacacctcagaaacagtgcttaggaaaaatagcaagttttaaaaagtatatgaacaatatgaagatttaaatattttaaaaatgtagtaaattttatatgtatgcatttctaagtaatagaatacatagtaaaaatgcaaagagaacatgaagatacagtggaggctttactgtgtttctcatgtttcttaacggcgcggtagatacatgaatgtttattatttatactttatttttgtatgtgaaatattgaaatattttaggtagaatgctacactgggtcatatggttatttctagtaggtaaatcttgcttcctttatataatttataggaacattctgatagccaatttatacaaacaataaattttaggaaggaaatgaatgaaaaattttccttagagcagtggtcattaaacttcagcatgcgtcagaatcatctagtagacttgttaaaacacagattgttaggccccaccccagaatgaatcagatctggggtgagggcccagcgtttgcacttccaacagagtttgaggtgatgctgctgattcagttcagggactatactttaagaatcactgctctagaaagtctctgtggtgtaaatgattcttctgtaaatttggcaggagctagaattcatcctccagattactttcatccacctaatatattcactgcagtggaccatgacaactctatcagtgtggggcaaagttttaggataaatagaagagtattgttttgagaaaaatacttaggagactgactttctagcagagctgtctgaggaactatatgaaatattattacaaataggtgccggttgcctctgtacaactagtaactgaaatttttagtgtgaattgctgctgagagtatttctctttcctttctacctttgggaaacctgttacacaaagtgtcaaatgtcttttagttgtttattacctttggcaaaagaattttgtacattaatttgtttgtacagtgactttttgtatagttgtagagatgctgtttttagatgttatttgttttactggacttaccctcaatttttccctgtcccctcatctttctagttactaattataatcttaagcatctatttatcattaaactagcaattaagtatctagcttccacaacaaaactgttttgtttttttttttttttttggagacagaatctcactctgtctcccaggttggagtgcagtagctgtagctgactgcagccttgacctcctgggctcaagtgatcctcccacctcagcctcctgagtagctgggaccataggcgtgcgctaccatggctggctagtttttgtattttttgtagagatgaggtttcaccatgttgctcaggctggtcttgaactctgagcttgaacaatcctcctacctcagcctctcaaagtgctgggattatcggcatgagcatccatgcccagcctaagacttcactattttaaaaaagagacaatcttatcaataaatagcttgcttagagacctctttgagcaaaggacattagcattgctaattttcttgttttgtatatttgtatttccttttccctttaaattttttgtaaggcaatagccacctgattgtcaactcaattttaaaccttcatatttaaatagcaaaactaaatacgtttttttggtcagcaaattttggcttaagatgcacagaaaacattgttaaagatttgaagaaataacacagtgggaatgtttgaaattcgtgcaataagcttcagatgactgcattttgctaaatagatttcaattatgtaatccatgaagaactcatttccgatcacttagtaaagaagtatgttccagagaaaacatattttcagtagctaattactccactgataaacatattgttatttggacactgaaaacataacctttgactgaatagctactttgattggaatttgcaaaggatttagggatgagagtgatagatgtgaagtttcagtcattcaagggaaagttattgcagtaacaaaattgaaaatgtaagtatacagagtacagcaagttgttattgttaactttataaaaataaaaccttttaattattataggattgtaacaaatttctgtgagtgaccctgacagtattttgcaccattaagaaggtactggttatcttatggcttagttctttaaaaagctatcaacctaaagatattcttggttttcttttacctcccccccccccccccagttaaaaatatgctgtgtggttaagatagttttaaaaaactaaaatgaatatttttatctgcctctccaagtcaaaggtccttttagtattgaatggggggaaaatttacttcttgaaagaagtctgtatatggatggaacactttgaaaacagatgtaaactttacagagttagggatatttcttctgtcctaattatcccgagtggcaggtcaacacttgataaatatttgaattaatttttttttcaaaaaatgacatatgtcacaaataatcctatgtgtgacctcacactatatataaaagttaaattagtgacataaatatgagagcaaaacccgtaaaactcttagaagaaaacagcagtaagacttaatagcattggatttgttagtggattcttagatacgacaccaaaagcatgagcaataaaagggatggataaaaaatattcgttgctgttttattcacaatagccaaaagataaaaacaaaagcgtctcccaacagatgaatggataaacaaatgtgtgtgtgtgtgtgtgtgtttgtgtgtgtgtatgaaatggaatattattcagccataaaaaggaatgaagttctacaacatggattaaccttgaagacattatgtcaagaatatatactgttgtttcactcatgcaatatctagaataggcagattcatagagacggaagtacatattaccaagggttggagggagaaggggatgggtgattattaagggttatagaatttctgtttggggtgatgaaaaatgtttagaaatagatagtagtgttgcttatataacattgtgaatataattaatactattgaattgtacacttaaaaatggttaaaatgacaattttttttatttatcttttgctacaataaaatactaaaacttgtgtgtgcacacaatcttggaaatagaattttctaatgtgtttaaaaatcttagattgagtgaattttgggggatactttggccctctgtgtctgcaggttccacatctaaagattcaaccaaccatggcttgaaattatttgaaaaaataataatacaacaataaaaataatacaaattttaaaaatacaatataactttatattgtattagctattatgagtaatcttgagatgatttatagaataaggggggttatgtgttgtttatatgcaaatactatgccattttatataagggacttgagcatttgcagattttggtatcctggaagggctgaagggagaccctgaaaccaattccctattgttaaacatactgagttgcaaatcctgatgaggttgcaagaaaaattgatggaataactgaggaaggaaattaactagccagatgtcagcaaaaacttttgcatgattggtagaacaaattcagattttagtattgatgtgattcagaactgcattcatttggacttttgtttatagtttttaatggctgttatcacaatatataaatgagaatgccactgtattataatttttaaaaagattatattctctttctcttagtaaaaatatgaaaattttggtagatcataaaagtacaaaaatatgtacatttagaatttttcaagtgttttatttttaaattatatttttgtgtatgtttaattttaagtaatatcaatggaatagtatatgtaatttataagtaaatatgaatatggaatgctgaagaatttttgttaagagtgtctatagaagctgtcaatttggaggacagttttatcacttcagaaaacattttgttgaaaataatatatctgtaaagttatattgaccctatattttaggctgctggtcttggtcgtatgaagccaaacacacttgtccttggatttaagaaagattggttgcaagcagatatgagggatgtggatatgtatataaacttatttcagtaagtatctttttaattcaataatttagttcatttagaaaatgttaattttgaaagcttgtcctaatttttggagactgtttctcatatagtctcttgtaatggaaatataagaacgaaaagaatcacacaaagcatctgggttttaaattgataatctattaacaattttttattgatctttatatgtctctttacatacatgcatatatatatatatacacacacacacacatatatgtatgtatatgtatatatgtatacactctggcttctcatttaagtttgtaaactttttcctatccctccagctgttgctgagcagagttcccaaatgtcagacccatcacctcctaaactatgtcattataatgtgctgaggaagagtgttttatcgctgtttaggcttgttccccttccaaacaaattttgcagttaatcatttggttcattcattaagttatttacatttcttttatttaaatgtacttatatgttttgtttttctaccactatgaagagttaagtttgagttcactgtaacttccgttttttgcgttgtctagtgcagcagtccccaacctttttggcaccagggaccagtttcatggaagacaatttttccacagacatgggtagtggtggggtctgtggtttcaggatgattcaagcgcattacatttattgtggactttatttatattattattacatattcaccgtaatgtagactcagtgggagtcctgagcttgtttttctccaactaggcagtcccgtctgggggtgatgggagacaattgacgatcatcaggcattaaattctcataaggagcgcacaacctagattcctcacatgcgcagttcataataaagtttgcactcctttgagcaattggtgccgctgctgatctgatgaggtgtacttcaggtggtaatgctcacctgcccatggctcaccttctgctgtgcagcccacccagttcctaacaagcctggctcattactggtccatgacccaggtattggggacccttggtatagtgcgttcttttttattctttgctactttgtctttctggttgtgttctgtttgtggattttgtggatgtttaatgtaatctaccacatactttttgtttaataacaataaaactttttttttgtttttgccagattttcttcttaatcttgaaaagtacttcttttcctactattctaagatttgcctaacctatttatcttgtttatactgaagataagcattccctctccactatgccatacttgatttgaggagtagtttttttctcatcctaagcactgatgaaatagaactgtctgcttcctcttataattgtcctttaaaaaaaacttttatttacaaagtagctttaagattaaagtttaagtcctattttctccatgaattttgatctgatcacccttttttctcactggagttacttccttactggaactcctgttgtatctttggctataaccacatatatttgcctgtctcacatatgatggttttattagtgacatttgaaaagtctttgaggaagcagctggatctcatactctactttttaaaggatctctttatatggattagtaatatatatgataaacaagatttaccaactaatcgttaaatgcttttagtaaaattaaaactgctgatgtgttgtatgttgttactactgctgagttttggttttattaatgtttttgtaagcaaaacctcattgtggctttctaattttgtattctgtgtatatagggattagggacagaaagattaatgtggtccatgagccatgaaaccctatgctttttccctctcaagacctaagaacagtgagatgacgtaattatcctaaaaaatagaaaaagtgacattttttacaaattctttcatacacctgtcacattattagttgtagttgctcataatggaacactggaaggggtctttctgactctgactttctagggattaaagtgagtgagtgttctgaaagttgagtattagtctaaacattattcctgtacattaggcagcagttaaagaataggtaaaatactgctttctggttttagaaccatgtaaattaatagcagtttcacagcagtgacactgctcattctttatcttgttgcacttccactgatgttttagctgtgatttttaaataccttgtgcaatttaagtatgctttatatattgtgtttttattaatagtatataagatctgaagctgcaaatcaatttttatagcttataacaaaaacatttatttgttttaatccacagtaaacttggggagctatattccctggctttaaagaaattgattttgatttagtcgatttattaaacaatttttaaaatgcttatagttattttttctctagtattaattatatctttcaagatacagctgagaaagattaacatgcctattaaatttatttctccagtgactttgttaactttagctcatcataggaatgtggccaaattgtctctccatgatttaaaaacaacaaaagaccttttataaccatatattatatcctgaacacattcttccatttgtcagtaagagtaataatttgactgttttattggattttagcctttttgatttcatatagctgtatcttaatatatcattgtttttaatatgtctacattgaatacttattacttgtgcaatgaaaaataataattaaagatgaaagttaagcctgttaccactttcagagaacaacgtgacgttttggaatttaaaattttttcagtagatttgagaaaaacttgggttaaaatgaagatttatgctcagaactgagattccagggtttaagtctggttttaaagctgtcttcaagattttaatgtattttctgtgtgtataggatgctctcatttctgtttttaaaaatgaaagggatcgctcctgtaatcccagcactttgggaagacaaggcaggtgggtcacgaggtcaggagttcaagaccagcctggccaatgtggtgaaaccctgtctctactaaaaatacaaaaattagccaggcgtgctggtgtgtgtctgtactcccagctactcgggaggctgaggcaggaggattgcttgaaaccgggaggcagaggttgtagtgagccaagattgcgccactgcactccagcctgggcaacagagcgagactctgtctcaaaaaaaaaaaaaaaaaagaaagggagaggtaaatatatattttcagatgtatataaaatctttgaaccactgttcaaaccagttttgtaaaaattttaaaattatgttaaaattccctcagtcttttcaaaaagaatttcttcatatcctgcaacctgctatcattcgcagtagcatcaaggtttttgtgtgtgtgtcttcatgtatttctcttggttttaatggtataagcccaaatataaatatagcgggattctgaaagtagtttttctataatttaacttagtaggataaaaatactgctgctgctttaaaccgctgctgtaggtataatgtcagtacaacaaagatctaaaaagtagttttcaagggtattacagaagagaatgttgtggaatttgaaactaacatacatatctcaacaagtgattttcaaagcatgttttaaaaatcagacgtttaaagccgaaagtaattttagagatcatctattatttattttaaagaggataacacaaatttttgtgattttttttttggttttttcattttttgtttttttgttcttagtgatgcttttgacatacaatatggagtagtggttattcgcctaaaagaaggtctggatatatctcatcttcaaggacaaggtaaattttgttggcaataagttttttatttacaaaaatataaactactttgttagaaaattatattctcacaaactgggctcttcgttacttttaataattatgtatcgtggacttattgtatggcattttaagatcacatctgtttggctccactaaagtttgtgttttctcgttgtaccaacctggatgatggttagtgattatttggattgaataaaattcaatccaaagcataagcttaagagaaacagacattagttatgtctttaaaaaacctggccaacagacaaacctaagtaaaatagcctgaggaaaaatttttaaatgaccactaaatcattagacattttcatatttatgaaagtatgctttgtacagagtcatattgatagaagcctaaagtttgtcataacgttttctatcttcagcagacctaataaattttttaaaaacattttttaatttaaaaatatttatagattcacaagaagttgcaaaaaatagtagagaggtcctctgtacccttcatccagtttcccccaatgataacatcttgccttatcctaaggtactatatccaagccaggaaattgacattagaacaatccacagacctttttcagatttcagcagtttacaaagacttgtatgtggttgtgtagttgtgtgccacttatgtgttcatttgtgtaaccaccattgcaataaagatacagaactgttctgtcactacagaggtctccctatgtgttccccctttctacttcccactatgtactttgtctccaatcattactgtataattttgacatgtcaagaatggtatgtaaataataatatagtgtgtaacttttaaagcatttttgaaagtgaagattaaagcctaagtaaggtataattactacttttgccaactttataaaaactatggctgggcaccgtggcccatgcctgtaatcccagcatgctgggaggctgaggtgggtggatgaccagaggtcaggagtttgagaccagtctgaccagcatggtgaagccccgtctctactaaaaatagaaaaattagtggggcatgcttgtaatcccagatgtttgggaagctgaggcaggagaattgcttgaacccaggaagcagaggctgcagtaagccgagattgctcctttgcactccagcctgggtgacaagagcaagactcaaaaaatacaaaaaaaacaaaaaacaaaaaacaaaaaaaaaacaactgtgaagatttttatatcctttgaagattttctgatactttaagaaattataagcttaagaaaatttacatatataacatattacccctatcaattaattaaccaaatcatcagaatgagctaagcctaaatacgtaagaggtatctgcttctgtatttaaactgttttaatcttccctctctttacccctttaagggcagtctgcagttttgaaaaaagcaatttgaggtctttatccatgtaaccaaatatgcattttcagcaatctggagtaggtttggcaaaatactatttcaattatttcttgctctaccagaattgaggtttagagtgcctaacttatacctgttaactcaacataaatagtagtgttccctttcacgtatcagtttgatgaataaattatatagttctatcatttactgaagtttgaatgtgattgaaacttttaaaaagtattttcatgtatttataatcattgtgaaatgtttttgaatgccttattattcatcattaagttttaaaacaggaatttgggaataggaattaagagcataggcattggagtcaggcaaatctgctttaaaaatatcagccttttctgttagatgttttgtagcctaggcaaatttgatgacttccaagcctcagtttccttatctgttaaaatgtatttaccttacaggttggttgttaagattaaaaagaagattaaggcctgcgagctcttagcatagtgctggcatgtagcttcttttgtttctcttcatttacgcaaataagtgatgaggattatggacatactatcaattttatattatatttgtctttgtgatacatgtttgtatggtggaaactaaatctttactaactctgacaaagagaaaatgaagaaaaactactttaaaatggagaaatggtactttcaccatgaacttaggaagactccatttggtggtcttggttttatagagtgggtagagtttttcagtgttgtctgtcatcttacgtatctatggacagttgttacattttacattttttatgtaattgatttagagagaattgattcacatactatgtattactgtctaccagattctactgtcctatgacttgtactcattactgattctccagctcgtaattcaaatacagtttgtgtatctatatccaaaatgcttggaacctgaagagtttcagaatttggacggggagaggttgattttggaatatttgcattacatagtacttaccagttgagcatctctgatccagaaatcccaaatctgaaatgctccattgagcatcatgttaggcatgtaaaaagtttcagactttcagatcaggatattcaacctgtaacctagttgtggtttatgtatttaaatgaatagtcatttcaaacagattatcatagttgtttaaataagaagccatttataataaacttattttttcataatagtttaattactaaaccataatgccttatttaacagttaaaatatgacttagatactattttaaataattttctgtctacagaagaattattgtcatcacaagagaaatctcctggcaccaaggatgtggtagtaagtgtggaatatagtaaaaagtccgatttagatacttccaaaccactcagtgaaaaaccaattacacacaaaggtaattttcattcaaacaataagtcttattaatagtaatgttttaatttgggagaaatatttttaattatataatatgtcttataaaaataacctgttctcaaacttgtactggtcatttctagctggtcaggtaaaatttatggctttcaaaaatggctacaaaatgactagctgtgtaaggtattagagtagatcatcaaacagaaaccatgctagttatttactaatatggcttctgtgtttttatttatagttgctttaaataaaacattttaatttgaagcataagttaaatctgaatttggaaagaacatggtaattttaaagtaacaaactcatgactttcacataatttcatccacaaatctgtgtcatgtttgagaagaaaagagggatgacttccaaatcttactctcccaccctcactctcctacctctgttcagtctagtatctccatctgtcctattcccagctgacacgcaacaagaaaataatctgcgctgtgaatcatcaaactgtaacatacttttgattcctgcaaaatatttcccattctttttctgaaattgtaaccttggaccaatcatgtctctgtacagtttatctcttctatattatttagaagcagtaatgttgctttttatttctttccttctcatttaccttgttggcttagagtattagtaaagtttagttcacacccattttccttttcagttctttgctgacttgattataatttattttgtttttcctcaaaattctataaactgattctgataactgttcctatattccagcatttattttagtttacactatacattctttcatttcctcttttttgtttttttcttttgcttcaaacattctttttctacagaatctgttgggaattaataggtgaagtttaatgggagggtaagaagaaatacatatcaagcatctactccgtgcacccaacattataatggatgttacccatacattagctaattaatatatgttacgatcttatgaaatcattatttttatagaacaggaaactgggtcagtacatttctacttacctttttattgtaaaaatctaaatgcctttaacttactttataattgttaaatgtcaagatttccttgacatttctgagatcttttaaacaaatgcagcatatccgtagttataatttttattatcaaagacaaatgccattaaatgtctgctttataagaacaatattgaatgctataatattaaatctaatgattctttttccattacaagtttaagaaattagtgtttgctttattttgtgtttattttctgtttagtcagttattctcagtcaacagtgtagatactatagaaacgtttatacattttaaaaagtcttcagaattagagacattagtgtgtagttgttataaatccacagtatttagctgtgtctatcttggttattgaagcatacatcatgcaagaagtcaaaaagaacacccttcaaatactttctgccaggcccagagttcagtgcattaatacttgcattagtataacaagcttaagaggtaggtactaatacctctttcgacaaatgagaaaagcaagttcagtaatgaaagtttactcagctgttttaactcctgggaatataaatgtagaggtaagattgcaatcttgcagcctaactccagagcccactgtggtatactctttcctaagtccagagttttatatgccataaacaaatattttaatacaagcttgtattaagggaacaaaatgagattaggaaaattgttaatgccagatatatttgtagatatttttaaatataaatggataaatattaatgcacacgtatatacatacatatataaatttatatatgtgagaaaaatcactcctgtataacctggcattttatataaagcaaaatacttatgtctctgatcaaatttcttaatatttcaagtgtgattaattttttacaaacaacaaatatccattaaatgtttctaaaattgctgttcagttatttgcacagtgatggcatgtttaaaatttatgtattatctgcaatatcaatgtttaatgtcatatttatacctataagccacagttcaacatcttctcaacttatttcaagtatgaaagtgtaaacattttaaaaatatgctgaaatttaaaaagtaattttacagaaattaaatttaggggtgttagtcatcctgtaggggaggggtctcaaatatgtttgctttttaaaagcttcaacactcagtgcagaaaatattaatcttcagtcttgattatttttcagtggactgctgcttcatattatattttgtttataaatgtgctctgattacatttttattattttattaatataaaggcaattaacatatttttgtgttttttaaacataatctagttgaggaagaggatggcaagactgcaactcaaccactgttgaaaaaaggcaggcatttttcatcattttattttaaaccctttttcatactgtaaactctttaactccaaccttattcccttttttttaaccttggtttttatttccatggtgaggtaatgttacagttctataaatgcagattagaaaaattattattagtctaactaaaaagttaaatattctcaggaaatggagttatatcacaaattcttttctattatcacagcatttctgaaatattagacccagacagccggtattaattttttttaatttaaactgcatggtttagatgataagtagggacactgaaataggttttatttgcagtgtcacttgcattctttaccatcagttgtacccagccaagtcctcaattttgatactaatgtatttttcatttcaaaaattacaatatttctcacagtcgtgctgcgtttgggagatacacagtcatgtcaacatacatgaattttatgagaaggagatagaggtgagagttatggagcagtgtggtttggtagccatattatttcatcgtgcaaaatcatttgtcatgtttgcatatatcacagcagcatgaaaagtgacattctacagaagtgatcagatgtcctcgtatggatttctgcttttaaaattttggtgtaggagtttcatgatagtcatttgcttgctcacagaatcaatgctgttttttgttttgttttaactcctgggaatataaatgggaactccttggtgtattgttctcagacctgcagcagatgggtgccctttgaaggagctcccaccatctttctgtggttcagagaaagatgtggttatatggctttagaattgggtgccacatattggggacaaaacataggtaaaaatgagaagtctttccttagactaaggtttcactgtgataattgtaagaatgtgttagtatgtcttcaactcccatctttcatttatattgcagataacaactttgtcttttaaaaagttttgagctttaaattattgagataccagattaccaaagaaatagtttcacagaacaggtataaacttgatttgtccagtttgactaaaacagcttttcaaaacaaaatctagcagctcactgtaattttttttattgttatttatgattctcttacattcattcagaatgcttgaaaatattagtaagtaggcagataatttggattggtttagctattgtaaagagttatttctctctagccatttataaagtatacttttattataaacaactgaaagtttatggtagatgccgtatacaattgtctgaattatctgtagtataaacatctgaatatacaaacattaggaaatgataggaattcagcaaaagggactttaatatttactttgcttacattttatattttgcttaatcctttagaatccaaaggccctattgtgcctttaaatgtagctgaccaaaagcttcttgaagctagtacacagtttcagaaaaaacaaggaaagaatactattgatgtctggtggctttttgatgatggaggtaaggttgttaatttttttaaaatgattttaaatttactgacattgtgagaatagtaagaaatgacatgcactctttacctgtggaccccattcaaattttgccagcattcccaaaagcaaaaggattaatttcagaatcaggcacagcctttagttgtctggtctcttcagtatccctaatgcggaggttgttcagtagtatttccttgagcttcatgaccttaacttttttttaatatgaaccattttgttgactgtaacccaatttgaagtgctagttaatgttttattataattagttttaggttatctacctttggcagaaatatcacagaagtgatgctgtgctcttctgtctacatctcatcaggtggcacaggatgttgatttgtaccttcactggtgaaattaaccattgagtaatatatgattttcaccacatgtattcactgaaaagttaccccacccccttttataattacaggtattggggatggcacagagggattactctgagactatgtaaatacactattcttgcagccttcaccactatctttaggatccattgatgtttctgcctgaatgtattgttattgttgtggttgccaaatgatgattctcctattccatcatttcttcctcatttattagttggcattttattgtaaggaagagctctttatttctgtcagtgtggactcattgattcctattttattgatattcagtgggatatgtattagactgttcttgtgttgctttgaaggaatacctgagactgggtagtttctaaagaaaagaggtttaatctgctgatgattctgcagaccacacaagcatggtcctgacatcactcagcttctagagaagcctcagggagcttttacttatggcagaaggcaaagcaggaacaggcacatcacatgatgaaagcaagagtgagagagtcatagagaggagacagagatgccacacacttttaaatcacccggtctcatgagaactatcacaaagacaagcaccaaaccttgagggactgacccccatgatccaaacacctcccactaagctccacctccagcactggggattaattacagttcaccgtgagatttgggtaggggctgatatccgaactattccaggatataatttgttactttcatttgttttgatgttccaattgtcctatatttcgccagcagaatcctccttaggctcatttgtttccatttatcatgtcccaatcgttcctttttttttttttttttttttttttttttttttttttttgcgactgagtctttttctgccacccaggctggagtacagtggcgcaatctcggcccactgaaagctccgcctcccgggttcacaccattctcctgcctcagcctcccgagtagctgggactacaggcacctgccaccatgcccagctaattttttagtatttttagtagagatggggtttcatcgtgttagccaggatggtctcgatctcctgacctcgtgatccacccacctcggcctcccaaagtgctgggattacaggtgtgagccaccacgcccagcccattcttttgggttattttctaatacaagaagatgttccaggctcagttttattgttttgcactttcccttcacagccacgaaagtaaccctttccaaggaatgctggttccttttactgaatcatagtgtttagaaacaaagatcagggcattggatatgcttgtgtctactggagtgtcactgctcccaggccttctccatggacagagccaggaactccttgtgtgtgtgtctgtggagatataaatggagatcaaaaagcaatttcagtccagcttctcccttttcatatttctaatttcagtgttaaacatggctcctgctaaggtcaataattatacttattttctcaatcctgttgtatgtgactgatctcgaccttaccaggccactatcccatttggctaccttccttgaatgggatcagactccgttaggagtcccttgtttctcaggtctgctaatggctttttgactgaattatcaaggaaggacagaaagatttttgtttcatatggagttgtagtaaacatgtttttcgagactaaattgatgttcctgattaagaaatttgcatttagtaaatgatttattacatttttataattcaggtttgaccttattgataccttaccttctgacgaccaagaaaaaatggaaagactgtaagatcagagtattcattggtggaaagataaacagaatagaccatgaccggagagcgtaagtttatttcacattgaagggcatgaatctattagcacttcattgctacagtataaatttgataggataaaaattagacaatccagaaaatgtctattatcttgctttgttctttactgaagttaaaaattttaaatataaccttgttctctttagtcttcatgtttaactagtaaatacttaattttacttagatataattttttttaacatactagcattttagaaggtccttcttaaatacttgtaacattaaagtgttaagcaacttctttcttttaatcagggagaaaatgcacaaacgttacatatttatatatgagataaattttgttgtagacttctagacaacaaaatgcaggatgccattgtcatccatccaattctttccatctatactgtcacgattctagttcttgtttcagtatttctctcctgctctctaagtactcttgttttgtctttgacctgtaacatgtatattgtacagagtacataatatgcataatcttcaacctaattaatatgtatattgtacacattatgggtcaaaggtaagacatgggtactcagaagcattgaaacccagttttatttttcagaaagcagagttttgaccatatgattcctctacccaaaatagttaaacgacttctctgctacctgccatagaaaatactaattgttataatgtagcagtcaaggcccttgacagtctgtcctctcattccctttctattcttctgtttcccccagtgtttcagtacacttttccctatgctctaaacatgcatgtgacttcaggcttttactcctttgcctcctctcatctctctcctgtaaatagctcttcacttgcctctccttttatctctttaaatactgcattctttaaaacccagctcagttcttcatagtgcctttcctattttccccccacttacccccccatctagttgttatgtttccttctggaatcacaatatacttttatacctaccactcatcacattatggctggtattatatttattgtcttatttaagttttgtgggccctgtttagcatgttttatagtagccacttaattgatagatcctggaattcaactgtttattcatttcaaatagtgaattatgcaagaaatactaataataaatttaatagtcaaacctatagcagatctgttttctcatatctcaatttaaaaacatttttattacaaataaaattgcattttgttaattgctttttgtatatatgtgcacttcacctgttctgttgttgccaccaatgtttcattgccagctaagccttcagaaaggtatttactggaaaatcaggcttgttgatgatccttttctacatcctgtcccagttccttctttccccaaaatgctatgaacttaatctgccatcaactatatcttcagtatggcccacaggtcatatttgggccctgagataagtgttcttggatggaagaataatccaaaaataattaaatatttgtctactagtttttactgaaatttatgtacttatcaatatagtttgactaaaattaacttaagaaacattagcttccatttaaattttattattaatgtctttgtccattactcagtgctaaggagagattcagagaaagtaaaatactcagtgattactcagaaagtaaagtactcagtgaatttaagtctactttgtgaatgaatggtgtgaattaattcaaatggatattgtttagcatatgatagactgactttttctataaatcatgctttttagatatatggattcagcccaatatagaatgaaaatacttgtatcttaattctatttatttttgttgtaggatggctactttgcttagcaagttccggatagacttttctgatatcatggttctaggagatatcaataccaaaccaaagaaagaaaagtaagttactctacaaatttctgatccctttatagatggcctactcagacacagattcaacttaattaaaacccagagatttttttcctgttgttagttacatgtgaagtcaatattttaaaaaatctagcattgatagttggcatgcatatatcagatattaaagaaagtctaaagagttttcaatattcagagaggatttaaattacagctttacatgtgatttctgaaaggtggttcatttccattgcccctgcctacagtcgttataaccactcagtccctgctctacatacctattactttccactgttttgttttattgctaaaataggaaaatctaaacatttgcctgcaatagttgcattcagaattcttctagcaaagactttggaatattccacctgaaaatggtatatacaggttgttataatgatatttgtatttattttacctgatataattttaattcttagattaatgttgaatcaatatgaagctgatataaagaattccttttagatagaaaatagtaaggtacaatttgtaaggttgtaatcagggtgagattgcttttattgtaacacagtgtatactgggtgtttcatactagatttgatactgaaaaatatttttcatgttcatagaggattagaatgccattcatgttattttactgttaaatatctttggatgtagaaattaattttgcatttccttaaatttttagtgtctgcccttttccccttcaaaatgttctagtacatttttttacatcacttttattcattgataactgggaaagcctttgggtgttttgagcagagtagtaacacaatttgacttattgctcaaagggatcatgttagctactatggtaaaatttatttaggctgagagaaaatggccataaggggaggcggggtagataacagtgagatcagctttagcagttaaaaatgcaatttattacaggttggagattccttatcccaaatgcttgggatcaaccaaaagtgtttcagatttcagatttttttttaaattttggaatattttcattatacctgctggtttagcattcctaatccaaaaatcagaaatttaaaatgttccactgagcatttccattagacatcgtattggtgcttagaaagttttagattttgaagcattttggatttcagattagggatgcacaatctgtattgtctatatgggttctaattttctcatcagtttgagagactagaaattgctgtttttgaaataaattgccaaactgattattatggttggggtatggagaggagcgtaataaatgagaggcactaactttgcaagttacaatttaatatttaagatcttcctgttatgtaacttaaaataagattagttgtcagtattctttctgttttttaaagtattatagcttttgaggaaatcattgagccatacagacttcatgaagatgataaagagcaagatattgcagataaaatgaaagaagatgaaccatggcgaataacagataatgagcttgaactttataagaccaaggtattctcttctgcttccttttcattaatcttttatataataaaagacatgaaaaccaagaactttaatttgatataggagggtcagttgtataaatgaactctactttaaaatagatttatttgaggttagtggaaagcatttttaaaaaaaataaaaatagagaacagatatttttattacacgaaaattcatttcagtttctttttgtctccttatagttttatgaaccatgctaaattcttatttccacatggtctaggaatgactgtcctgtttcatttcagacataccggcagatcaggttaaatgagttattaaaggaacattcaagcacagctaatattattgtcatgtaagtaatatctttataaagattttcttgctaatttatgataatatgctttgaattaatttctattccaagtacatatctatataacacccatattgacttagtggttataaggaggaaaaaacaaacttgtaaaaatatactatgctttaagcatatggagaaagacaaaaactttaaccttatgcttatatgaatcccaagtaatctttttatcatagtaggttatattggaaccttttgtttacccttcttctcacctttttaaaattccttatctttgtaaacactacagcatagccgttaagcacgtgtggataggagggtcctacgttaaaatttgggccccggacagcttcctcttgaaaataattcaaaaaatgttatttggcagattaaacttgaatagtgattcctatctggatccccattcttatgtttccaacacgcaaattttacatacagacacattgtccttgagttaaatatgatactaaatgcctactttggctcttcctctactgaactaggttagctattctttgaacccacattttctgagttctggaacatgtgtccttagataggaaagctcaggcctctcccccacaaaaaaagccaagtaatgaaaaaaactaccaaaagattgttagtttaacaacattcaataaatcaaaaagtttcaagttttgctgatgataatcaaatacctgtaaatggaaaagacaccaaaacatagaaatttagagaaaaactatacagcaattggtcactgctgccaccatccataaatagaaattaaaactaagagaagataaaaattgcatttatccatatatagcttctgttttctaaattttgatagtaaacatacctttcacctaaaagaattctattcttattaaagaaggggaaacctaggatttagtgttagatatcagaggtactgtggtttatagaaatacttactgttcttatgaacaaattttgaaaaatcttttgttgaaagattatagtcttttatatatgcatatatgatggtggtaccataagattataataccatatgttaagctgggcatggtggtgtgcacctgtagtctcagctacttgggagactgaggtgggaggattgcttgagatctggagttttggagttttgagtccagcctgggcaatgtattaagaccccatctctcttaaaaaaatatatatatatttttactgtatcttttctgtatttagatatgcaaatgcttaccatcgtgttacagttgcctatagtattcactacagtaacgtactatacaggtttgtagcttaggagcaacaggctgtgtcatatagcctagatgtgtagtaggctataccatctaggtttgtgtaagtactcctgtgatgttttcacgagggcaaaattgcctgacagtaagttctgagaaatgcgtctccatcgctaagcaacacaactgtggttgttattctatttgcagaattctcctgcactcagaaatattctgtaattatagtaatttacagtaactgttattgtaatctactttataatttttgctacattttattctgtaaatgcattgctcagggtttttttttttttctttttctctttttgataccaggagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatccttttttttttttttttttttttttgagacggagtctcgctctgttgccacgctggaatgcagtaacgtgatcttggctcactgcgacctccacctccccagttcaagcgattctcctgcctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttctaaaaaaaaaaaaaaaaaaatttctacattataactcacagcattgttccattgcaggttttgcaatgtttgggggtaaagacagtagaaatattattcagtaaacaataatgtgtgaacttttaagatggataatagggcatggactgagtgctgctatcttgaaatgtgcacaggtacacttaccttttt

SEQ ID NO: 14835 - DNA, 6610 bp, Human
tgtgagcccagccttctcacactagagtccctgtttgttctcctacccggacttttttgttgctgttgttgttttgagaccagagtctcgctgtgtcgcccaggctggagtgcagtggcatgatctcagttcactgcaaactccacctcctaggttcaagagattctcttgcttcagcctcccatgtagctgggactacaggcttgcgccacgacgccgaataatttttgtatttttagtggagacggcgtttcaccatgttggccaggctggtctcgaactcctgacctcaagtgacccacctgtctccgcctcccaaagtgctgggattacaggcgtgagccacagtgccggccttttttttgttttgttttgagatgggagttcaactcttgttgcccagattggagtgcaatggtgcaatctcagctcactgcaacctctgcctcctgggttcaagcgattctcctgcctcagcctcccaagtagctgggattacaggcatgtaccaccatgcccggctcattttgtatttttagtagagatggggtttcactatgttggtcaggctggtctcgaactcctgaactcaggtgatccactcacctcggactcccaaagtgctaggattacaggcatgagccactacatgcagcccccaggagctcttgatctgaggcataaagatgcttagagggtttccaaatatattttatggtcacctattctcccaacaatgtgtgctatactgtgtgtttacacataggtgtgtctttagaggaaagggttcaaagctttcattagattctttttttttctaataaagaaaaaagctttgttgcccaggctggtctcaaactctcaagctcaagcaatctgtccgcctcggcctctcaaagtgttgggattacagccatgagccaccacgctggtcctcattacattctcaaaggggcctattgaaaaaaaaaaaaaaaaaaaaaaaaaaggccgggcacagtggctcacgcctgtaatcccagcactttgggaggccgaggaaggcggatcacaaggtcaggagatggagaccatcctggccaatatggtgaaaccctgtctctaccaaagtacaaaaaaaaaaattagccaggcatggtggtgccgtgcctgtaatcccagctattcaggaggctgaggcagtagaactgcttgaacctgggatgcagaggttgcagtgagccaagattgcaccgctgcactccagcctaagcaacaagagtcaaactccgtctcaaaaaaaaaaaaaaaaaaaaaaaaaaaaaagatgagactgttgagtcaggattaggatccaggtctgctggcaccaatttcagtgctctttatactttctgttgctattcattcattcatccattcattcagcaaatttatatcaagtatctggtatgtgccaggtatgattccaaattacaccattcccagattattctgagaatgctgcagtgccaaactcttggtatcacagactttatattctagtgggggagacagacaaaataataatataacgacgaaggtgcaatgttatgtgctatgagaaaacgcagtcggaggatggcgaggaaggggaacggaattttagatagggcggtctgggatcagaacctccagatgcccgtccatggactccaacgaagggagcgattccaggtaccagggcaccctgcacaaacctctcttgagcttccgcctcgcccaggtggggacggtagggagaccggagggcacacgcatgcgcacgaaggaaacggtaaagcctgaagggaggtgcagagcgcatgctctctcttgcccgagatgccgaggattttgacaaggactccgtcgtcccggatgatagtgctcaggttaatgccagtgggagggcggcgcccaatagtaacttcctttggaggttgtagtaccgcccccagagccaattttccacttccgcttccggcgctgcggcagtccagatcaaaaatggcggtagttggtgtgtcctcggtttctcggctgctgggtcggtcccgcccacagctggggcggcctatgtcgagtggcgcccatggcgaagagggctcaggtactggggccggggtcgacgggtcgagcctcagccccactcgggcgagacagggagggactgtgaccttggcccgaggccttgcgggagggaaagtgagacccgggcccgccccataccggcgctgaacgtttgtggcttctccgcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaaggtacgcccttgtacatctcttcaagcgtccgttctcttttcgttatgtgtgccttagtgcaagttcttcattctctgaaggcatgggtgccaggcgtgtacagcttgtttatcctcacaaacagaaaatgtattttcttccattttgtggatggacagctgacacttgggattacgtctcaattctcttcttcaaggtcatacaataagtgctcttcagtttcccttttctccgattcatcctacctcctgccttctgagacagttcttttttttttttttttttttttttttacttctgagacagttctgaaacaggtgtccgttgtgtaaagcctggaggtttgggaaatccaattagagtggcaaagtctgaaggtggttcgcgtaagcgaacccagcagctacatgggaggctgaagcaggagaatcccttgaacctaggaggcggagtttgcagggagctgagatcgtgccactgcactccggcctgggcaacagagcgagactctggtctcaaaacaaaacaaaacagcaacaacaaaacatgggcatctggcagctactagttgcataatgaagagactgacagctttctctattccccaccaataccttttctcgactgttttatcattggttgttgatgtagatatattacaatgttgtgtcctctgttgtttgctgtatctttaacaagggcttattctgattcttcaatactggccatgcgcggtggctcacgcctgtaatcccagcactttgggaggccaaggtgggtggatcgccggaggtcaggagttcaagaccagcctcgtcaacatggcgaaacactatctctactaaaagtacaaaaagtagccgggcgtggtggcgggcgcctgtaatcccagctactcgggaggctgcggtgggagaatctaggaggttgaacccaggaggaggaggttgcagtgagccaagatccagccattgcactgcagcctgggcaacaggagtgaaactccgtctcaaaaaaaaatagtaataatatacttgatcttagccaaaaggccgagaagtgatgaaaaaagttattattattattattattattacatcacctagcccatataggactggccttgtagaaacttaacctagactcttgaatttgttgagtctttgagcggcactcccatccttgtacaatgcaattagaagccaaacagtaaaggtttctcagcctcagcactgttgacatttggggctgggtaattcttgttggggggctatcttgtgcattgtgaaatgtttagccatatccttggcctgtacccactaggtggcagtagtacctgcgcaaccccactcccgcttccccctcccccgcccccatcacagtgtctcccgatactacccagtgtgccctgaaggggcaaaatcaccctgggttggagaccgttgccctaaagtaatgcttttcaaaggtaataggcaagataattcagggtgggctgcagtttcccagcccagatattgtttgaagtctgggatggtgccagaaatctgcatttaattaagcatctccctcccctaatactgccaccattttgatataggtgatttgaggattacactttcataaacacagcactggatatactagttactagggagaggatgatgagtaactaacttgagcttgcattttctgccatccatatttgtttctggaattaaaactgtcctgtagccaggataactttaagggctcccctggtagttataagagctccttaaataatgggaaggttgaactacaccagtagataaaggactaatttccattttgtttttatatatgatctgtcaccccgttataagcagttcatgacggtgttctttctaaattattttctggaattatctaactgacatcttcactccacagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaatttagattggtcatgagctgagagttactttctttggttgtgttttttcgcagaaattagcatttgagcttcaagtcagtgtccaagttgaaaagaaattggcattagttatttctgtttccacagtgaaggtctaggctgctgtttagtgttacaggtccaattcagcccattgaataagtgtttataacagcccctcttggtttattgtgcctgatgtggataaagggaccaagtggagtggtgctaattaagcatcaagattagtccttggtcaggtgcggtggctcatgcctgtaatcccagcactttgggaggctgaggctggcagatcacctgaggtcaggagttggagatcagccgggccaacatgatgaaatcctgtctctactaaaaatacaaaaattagttgggtgtggtggcgcactcctatagctgggtgtagaggcttgaacccgggaggtggaggttgcagtgagccaagatcgtgccactgcactccagcctgggcaacagagtgagactctgtctcaaaaaacaaaagattggtccttgacgggcctgagatatcaaagacattgaatggctagcagaatgcctgcaatttacacctgaaagaggtatctgtatttctcaagaggaagtgcttgatctgggtctcatctttttcctgtcccattccactagcatttactgcagaatcttccctgtagtcataattttcttgaacatgtcaagttcttttttttctttttttttgagacggagtctctctctgttgcccaggctagagtgcagtggcacgatctccactcactgcaagctctgcctcccaggttcaagccattctcctgcctcagcctcccgagtagctgggactataggcacccgccaccacacccagctaattttttgtattttcagtagacacagggtttcaccatgttagccaggatggtctcgatctcctgacctcgtgatccacccgcctcagcctcccaaagtgctgggattacaggcgtgagccaccgtgcctggcctcgaatgtgtcaagttcttactttgaggtaatctccttcagggctggtagggtcagaaatcttaagagaaacaaagggagcgtgacacatttctgcttattggcttttctgtggaattaaaactatcctgctttaatggatagtaaatggtagtagtagtagttacaaaaccactctgagagggcaattattattattattattattattatttttttttttttttttttttttttgagatggagtctcgctctgtcgcccaggctggagtgcagtggcgggacctcggctcactgcaagctccacctcccgggttcacgccattctcctgcctcagcctcccaagtagctgggactacaggcgcccgccactacgcccggctacttttttgtgtttttagtagagacaaggtttcacatgttggccaggctggtcttgaactcctaacctcaggtgatctgcccacctcagcctcccaaagtgctaggattacaggtctgagccactgtgcctggccagagctggtttattttattttattttattttttgagacagagtttcgcttttgttgcccaggctggagtgcaatggcatgatcttggctcaccacaacctccacctcccaggttcaagcaattctcctgcctcaccctcctgagtagctgtgattacaggcatgtgccaccacacctggctaattttttgtattttaagtagagatggggtttctccatgttggtcaggctagtctcaaactcccaacctcaggtgatctgcccacctcagtctcccaaagtgctgggattactggcgtgagccaccgcgcccagccagctggtttattcttaaggctcaaaggaacactttcgtggtaaggttcaagaggcaacaaggtatttcatattatattacattaaactggtaacgcaaaagtaaggcatatacagtacggaatagaga

SEQ ID NO: 14836 - DNA, 29994 bp, Human
  misc_feature (1)...(29994): n = A,T,C or G
actaggttagcaagttgtaggaacaactcttcaccatttctcccaccctaagaggtactggggagtagaatgcctgtggggggcattgggtggcaacggttatctttctctgcaaaattcttacaagtgtttgtggagcgtcacacaagatttagctactctaactgcacgcagtgcgaaaaccttttaaagctatgaaggggagtaacgctcttgcaagctagaggcacgcactgctgcgtttgtcaaaaaaggcatttatttctgttccatctgaagtctttcatcttcccattctcgactggaaccctcccacggcttaggctgccagctttcttcccttccagcaaacactgctcgagaagttggcagtcctgccggctttctagactgccatttaccaagcccctaccccagcccccagccccgccaccacccaccaccttccctcaactccccactggaaggctggcaagatctcctcccggcccggctggaaacacccacgcagctcccccctccggaacacccagatggatcctcggcgcaggaaccacacagaagggggaaccgctgctccctgatcttagataccgttgctaggtggcgctttccccccgcggagctgggtaattaaaaaaaaaaaaaaaaaaacttcggacgccgggggtctggtcttctccacaggagcgcaaaatgcatctgcgtcctttctggaagcttctacgccccaagccgccagcagtattcccgggacctgtcaggcgcccttaggaaagcaggatcggggggaaggaaccccctgctcccggctgcgtatcggcccccgcgcccatcctcaccttcttgatatgagccgcaatgtccttctctatgttgtatttctccagcgcctgagtagcgcactccaccgagtcctgttgcatctcttccgacatgtccgcatttttgatcacggcctttcggtcgcacatggttacctagtgggcaaggcctggggtaaggggttgagttgggccgcgccccccaggcactaactgcccccaccccggccggcgccaccacgggacgacgccccccaccccacttctcaggaagcgcgggctacgcggagggctaagtccggagtggggcgaaataaggcagcgaggacaccccctggccccccgagtttctcaccgtggagaagggggctggccgactgcaacggtctcctgggggaggtgctagcacagctcaggcccggctagagctaccgtcgctaccgaaaccgtggcgcatctaagcagccccacgccagccgccgccgcctagtgctcaggccccgccctgctcccgccggccccgcccctcgccgcgcgaccctattggcttgacgcagcccacggcattcttccattggtccattgactccatggttccctcaggatctttctcctgcattttgttgcagaccacaatgcaccgctcacggcgtcggttgcccgggcaatgggccgcacgctacgaggcccacacacccagaaggtggagccccggccgggttacgaggaccacccagctgtctggagaggtaggaagggagcttctgccggggccaagggaagtgattccaaattcacggaggttgtcccagggtgtgttctcgaacaacagtctctagaagttggtggccattcctgcccccacccccccgcccccccaccacgacaggtcgcatgatctcgcaccccaggttagcaggattacgacagaggtggcctctccctttactgaaagggtatctctgaagcagggccggcttcgtgggtaaaccagcagtgcagtctcacaggagggacccttacgttttcattttgcactgggccccatttgtagtcggttctgctctgaaatatttaggggagggcatcctcaggattgagggagggcttcaaggagggagggtgtttccttacgaattaagggattatccccaagagtggggtctctgccaagcaatgcggacatcctttaaggggttggggatggggatccgggtggatttgggagtgttgagccccggggtttttgtccagggtgaagcttcttgctcaggtgaggcaggctttcctgtgtgggagagattcttggttgggatttatctctgaggaggaggtattctaatggacgaaaaagcggccgttagagagatgacgtcccctctggcttagggaggagacacgaagtggttaaaaaagcaagatcttgggggagttgagggacaagtcagatctggatttaaatcccagcactgtcatttactagctatttgaatgtcttctttaagtaaaggaggactaaatgtaaaaggaaaccagttcatacgcttgttagcagtattaaacatttgaagttctctcagcacaatgtgaggcacatagtaaatgatcaatgaatcttatcaataattgtcagtttatacaactatcccaaaggccacagcaaggttttgaacaaccagctctgaaatgcctataatgtatttttcgaacctccataaataagttatcaggttaatcatgtatctggaagcttcctatttacatttctacattttcctctgaccatctactctcattactccttaaaacaatttgtggctgggcatgatggctcacacctgtaatcccagcactttgagaagccgagtcaaggggatcgcttgagctcagtagttggagaccagcctgggcaatatggccaaaccccatctcaaaaaataaaaataaaacaatttgagcagaggcacacaactccagaaagaaaaagatgggaataggccgggtgcggtggctcatgcctataatcccagcactttgggaggccgaggcgggtggatgacctgaggtaaggagtttgagaccagcctgatcaacatggagaaaccccatctctactaaaaatacaaaattagctgggcatggtggcacgtgcctgtaatcccacctactcaggaggctgaggcaggagaatcacttgaacccgggacacagagtctgtagtgagccgagatcgcgccattgcactccagcctgggcaactccgtctcaaaaaaaaaaaaaaggaaaaaaatggcaataattagaaccttttcaggttcaacatatgcatatcaattaaatcaacagctttttccagttccatgtttctaatgatgagattcagggtttgaggagttataatattactatagtacctctcttgaggaagaaataggttgacaacaagtgaggaccctggaaatgcaaatgacactaaagtaaagccacggtgactccactaagtagaaaccccagggaaatttcctaaatcatcctcatgatttttttccatatctacactacactacccctgttattatttatttaatttttactataataatactatcatcataatatagtaatgtaattgttcattaataataccttatatggccgggtgtggtggctcacgcctgtaatcccagcactttgggaggccgaggcaggcggatcacgaggtcaggagatcaagaccatcctggctaacatggtgaaaccccatctttactaaaaatacaaaaaaaaaaaaaattagccgggcgtggtggtgagcgcctgtagtcccagctagttgggaggctgaggcaggagaacggcgtgaaccccagaggctgagcttgcagtgagccgagatcgcaccactgcactccagcctgggagacagagcgagactctctcaaaaaaaataaataaataaaaaataaaaaataatactgtatataatattctatataataattttatttgaactccctttattttttaaataagtatactttttattttattttatttttttgagatggagtctcactctgtcgcccagactggagtgcagtggcgcgatctgggttcaagtgattcttctgccttggcctcctgagtagctgggatacaggtgcacaccaccatgcccggctaatttttctatttttgtagagacagggtcttgccatgttggccaggctggtcttgaactcctgagctcaagtgatccgcctgccttggcctccctaagttttgggattacaggcgtgagccatcgcacccggcctaataagtatgcttttaaaagacaaatttatatcattaccataaatggaaagccagtctcattggccataaatagaaggtaactataaaatataaatattagaatataaaacatttgtttttgcattgttaaactgatctcagacactatgagtgatatgtgtcctgcacttggaaaatgctaccctcgaggagggttcttaaatggggtccacgaccggattgcaaaggttttccaagccctctggaattatgcacaaaaatgtatgtagtgcttacaggcatttttccaaagagaggatccttagcttccatcagattcataaagggattcagaacctaaggaggattaaaaaaaaaaactcttctacaataacccagactcctagaataaatgtgagattccttcaccaggtccccctgaagtggcccatatggggttctgtagcatcacacattttggcaacttactatatctactcctgcctgataaacttgcttaaaaatccttctaagcctgaaaacctgcatttttcattcttgccacaggaaattataactaggggttaatgtttctgagagcacgggctttggaatcaacctaagctatgagctccttcaagttagttaacctctccaaggcacaggttcctgattgttattttttatttttatttatttattttttttgagacggactcttgctctgtcacccaggctggagtgcagtagtgcgatctcagctcactgcaacttcaccctcctgggttcaagcgattctcctgcctcagcctcccgagtagctgggattacaggcgtttgccactacacctggctaatctttgtattttagtagagacagggtttcaccatgttggccaggctggtctcgaactccagacttcaggtgatccacccacctcgtaggttcctgatttttaaatggagatcacatcttcgttataggttggtggcagggattatattaaataatgcatctagagacctagccacggtataataaatagtagctattgccactgtatattgagaccttaccatgtaccagacatttagacacattatctcattggcttctcataacaattctacaaggtaagaactgttcgtctctttattatacagatgaagaaaatgaggttcaaagagatgaagtctcttgcctaaagtcagtgacagaaagtgacagagctgggatgtgaatcctggtctgactctacagtcccacatggtagatggaacctccgagcaacacctaaacaaagggagttgatgcctccgaacagagtaatgtcgctggagacactaagcatcgtcggcccctggcaggagctccctaaatatgtgttggatggatggaagaaaggatggatagttcagagtacttcagccttgattcctccgcaacagacacctgaaacttgaccctacattggttcttggccatcgtgatcttccttggacagaatcacctttcagctccggtcatcagactttcccagggccctcagaaagcccttcagagttgttactcacaggcaggctgagggattccttacggggtctgcagctctcctcacctcatccacaagtaggaccgtggcctgttcctcactactgccccaggatcactctgttcccagcccagtccagcaatcacttgtctagctttctggaaccttgagtactttcttgaaccatgagtcctgtgaccaccctagcagctctaaccctcccttatctgaaaggaagtgtgaggtgaccttgcaggtcccagagttgattgaagaccccatccagaaagaaggcaccctgtgggagagattgcaaggcctaggtctgaatccggaagcttccaccccatggagaagggctggcaccagcctggggctggcagtggagctgagctttggagccaaggactgtactgcagtgcagggagagtgaggccagaaaggctgagacaactcagggaaagaaaacctcccttctggctaatagtcaagcaccgcctgagtagaccaacactctcctgtccacaggggcagcagatgaagacacaaccagagaggactaacaggccccctcagctctcagtcagagggcagagcaacacagaatagacattaaaggaacagactttgaggccaggcagccttgggtgtgcatctgtccctactaagccatgtgacattaaacaagtgagtccacctctctgagcctcaggttcctcatctgtaaaatggggattataagagttcttgtttctcagggacaatgtgaggattaagtgagatgatacacatagagaatgtggtgcagtactgggcacatggcaaagatcagtgatgctagctaccacttatcattagtgttcctgtagaccaggacttctcaaccttggcactattcaccttttgggccagaaagttttttttgttgttgttgtggggagctgtcctatgcatttgaggatgtttaacagcacccctggcctctacccactagatgccaatcacaccacacccccagtttcaacaaccaaaaatgtctgcagatggtgccgaatgtcttctggagggtgaaatcactccccagcagttgaaaagcaccaccctaaacaatctggactgaatttgaatgtcacagatcccaagctcacagctccatgtaaaggccacaaggcaggcaggcctacttgcagatgaaggaacggaaagagcaacaattacagatcaagcggctagctccggtgtagactaagaggcgggatctgtagtctgctctaggagctaacaaggcctctgtgactcagtaggtgacctcagtgtcactctttaattatatgcaaagtggtcttgtgttaactcttaattattctagggctccaaacaagaaaataggtagttggtatctgatttctggcatcaagatcctgattcattgactgggagaaaatctgactctccaaaactctttcagagttcatttagcccttcatttatgactctggggagatttctgagcgagagctaggtgtcaggccctgttccaggtgctggagatgcacaagagaacaaaataggcaaagtttcctttttatggaacttatagcaggagaataaagataaaaacaagcaaaaatatttatctctgataagggcaatggataaaaataaagtagaataggccaggcacggtggcttacgcctgtaatcctagcactttgggaggccaaggcgggcagattgcctgagctcaggagttcgggaccagcctgggcaacacggtgaaaccccgtctctactaaaatacaaaaaattagctgggcgtggcagcgtgcacctgtagtcccagctacttgggaggctgaggcaggagaattgcttgaacctgggaggcagaggttgcagtgagctgagatcgcgccactgcactccagtctgggtgacagagagagactccacctcaaaaaaatttaaaaaagtagactaagagaaccaagcatcgctgggtgaggggtcttgttttaaagagttttctaggaagacctctctgagaaggcaccatttgagccaagacttgatgacctggctactgcatgaggatggaaggtggggaagctgatgggagcagcgagagaggtgggagcagttagaggctattgcagcagtccaggtaagaaggaatggtggcttggacaaggaggtggtagcagagatagggcagagatggccagattccagatgtattctgaaggtagagctgacagatttgctgagcaattggatgcagaataggagggaaccagaggcagtcaaggatgactccagacttgtgagctgaacaatgagaagaatagattgagatggggaagtctggcagaggaaacaagaagttctgctttggccatgttaagtttgagatgcctattagatattccaagtggagatgtcaaatatgcagttggatatatgagttctgggaagagggccagccttgagctataatttggagagtcatcagcttataggtgacatttaaagcaatgggactggatgagatcaccactgagggcggagtacgtgtagatggaagtaatgcttattcagctagcaatattctctgagcgtttactatgggccaggcccggagctaggtgctaggtacagagatggacttcctttggcacctgccccagagaagctctattacttacttaattttcctgcctaagtgctttggccatgtagaggatgagccttgagttcctaccctgtcttttagtcacttagtcctttttttctcttttttctttttttgagacagagtttcgttcttgttgcccaggctggagtgcaatggcatgatcttggctcaccacaacctccgcctcctgggttcaagcaatcctcctgtctcagcctcctcagtaggtgggattaccggcatgcaccaccacatcgggctaattttttgtatttttagttgacatggggtttctccatgttggtcaggctggccttgaactcccgacctcaggtgatccacccgcctcggcctcccaaagtgctgggattacctgcgtgagccaccgcaccctgcatcattttttcagcagacatttgttgagcacctgcttgatacaaggcacccatctaggcacaagggacatgaaaggaagcgagtcagacacagttcctatccttttggagtttacattttatgtgtggagacagacattgaacaggatgcacacaggatcacaggatgtgacaaatgcagtggaggagaaagataggctggtgtgagagctgttaatgggggctctgctctagcctgagaggcaaggaaggcttttccaggagtcacattagaggaacaatctatacaagcagggaactaggctgggggaagtgcagggagctttttaggtggaaagaacagcatgttcaaaggcctgaagctggaaggaggctggctgacttggctccagagaagctgttgggggagtgtgggagagacaagacagggagtaggggtggggagaagccagacctttggagtcttgtaagcctggttaagacacgtggactgtcttctgcggccaccagtggctctgttgaggtgggaaattaaagaaaagcaaaattaaaaagaaagagaaataagtttttctgtatgagggtgacttgtcccagaggcagcaataggcacaggccagacccaggaaaattcttcataatattatctaatgtgctctggagattctcccagtactccctcaacatagggagaagaaaaacaaattttcctttgttttatggaatgagtttatagattcctattctctgtaaccagtgacttcaagtattgttttatctaagcagtggagtgaaggtcatgagcctctgagctggcctgagttacggccacctgggcgccatagtgaaggttatgggataagtctgtgcctgggcaaacctagataacggacatctgggttgcttggcaacggtcacgtgcaatcctgagtttgtcctgcctctatatccctgctttcatgccactgtaagcttgcttcaagctagcccacccccttttgtgaagtgtgtatagaagtcaagtgctgtctttcttccgggcccagtcttttggacgttgagtcagctgggcctgagtgcactcaataaatgattctcctgttttagattgagaccatcctgactaacacggtgaaaccccgtctctactaaaaatacaaaaacaaaattagccgggtgtggtggtgggcgcctgtagtcccagctactcgggaggctgaggcaggagaatggtgtgaacccagtaaatactgcacatgtgtaatgagccgagatcgcgccactgcactccagcctgggcaacagagcaagagtccgtctcaaaaaaaaaaaaaaaaaaaaaaaaaaaaaaaaaaaaaaggccgggcacggtggcttacgcctgtaatcccagcactttcagaggctgaggcgggtggatcacgaggtcagagatcgagaccatcctggctaacacagtgaaaccctgtctctactaaaaatacaaaaaattagccgggtgtggtggcgggcgcctgtagtcccagctactagggaggctgaagcaggacaatggtgtgaacctgggaggcagagcttgcagtgagccgagatggcgccattgcactccagcctgggcgacagagcgagactgcatctcaaaaaaaaaaaaaaaaaagattctcctgttttaacccgaggtctctctctcatcctcctgaatcccacaacactgaaaggtagtgggtagggattcatacgatcagagggccactgaagtgggcaggttagtagggcagccaggacaccagtgaggaagttattgattgttgcctctttgcttcaggctcttggtttctccattttaaacatctgtttgcactccaggtgcagtgtctcatgcctataatcctagcgctttgggaggctaaggcaggaggatgccttacccaggagatggagaccagcctgggcaatatagcaagaccccatctctaccaaaaataaaaataaaaaattagctagtatagtggggtgtgccggtagttccagctactcaggaggctacagcggggaggattgcttgagcccaagagttcaaggctgcagtgagctatgattgcaccactgcactccagcctgggcaacagagcgagaccctgactcaaaaacaaaaacagaaacatctgtttgcaaagccctggttctctcaggggacagagaggggaatgcaaagaagttgtttttctctctcggtaagagcagaacccttggtacccccaaacttatcatcttaggatcacaaagccagagcttaaggctgtacataataatctgtttcttccaggagccacttcccccaagaaactccaaaggtattatttcattagcagggtgccaggtggttttggccagggcctctgcaactcttttctctgtgaccattttccatttcggctcatataaatcaacctttactacaaagctataaagtaaaataatgtaattagtgcagccaactgcagctgttctcaaactcaatgtcacagccattacacatgtgaaatatttacaggggttttaatcaattttctttcctgacacccgttttttattaaaaattacaaaaataataaatgcacatggtagtagatacagaagaacacaaggaatgaattataaatgttaactgtacagagataaccattgtcaatattttgtcttaaatacatccagtctacagataagaacatattcatatcatataatacctatcacactgtatgtatctttttttttttttttttttttttagacagggacttactctgtcaaataggctagggtgtagtggtgcgatcgtacctcactacagcctcaaactcccaggctcaagggatccgactgcccctccctcccaagtagctgggatcacaggtgcacaccaccacacctggctaatttttttgatttttaataaaaatgaggtatcactatgttgcccaggctggtctcaaactcctgggctcaagcaatcctcccaccttggcctccaaaagtgctggtattataggcatgagccactgaacctggccaatgtatcatttttgttacctgcttttcgtaatcccagcactttgggaggccgaggcaggtggatcacgaggtcgggagttcaagaccagcctggccaagatgttaaaaccctgtctctactaaaaatacaaaaattggctgggtgtggtggtgggcgcctgtaatctcagctacttgggagggtgaggcagagaattgcttgaacctaggaggtggaggttgcagtgagccgagatcgtgccactgcactccagcctgggcgacagagcaagactccatctcaaaaaaaaaaaaaaaaaaaagccttctacaacataactatttacttatgtatttttaaagatggggtcccactctcacccaggctggagtacagtggtgcaatcctagctcactgcagcctcaaactcctgggctcaagcaggcatcctgccttcacctcccaaagtgctgggattacaagcatgagctactgcacccagcccaattttaatagcttctttatagcccatgcggccaggggcggtggctcacgcctgtaatcccagcactttgggaggcccaggtggttggatcacttgcggtcagaagttcgagaccagcctggccaatatggtgaaaccccatctctactaaaaatataaaaaattagccaggtgtagtgttgcgtgcctgtaggctacttaggaggctgaggcaggagaatcgcttgaacccaggaagcaaagcggaggttgcagtgatccgagattgcgctattgcactccagcctgggtgtcacagtgagactccgtctcaaaaaaaaaaaaaaaagtccatgcataacttcttgaaacaatcacttatcagtggacacttaagttgcttccagtttttcagtattgtaacagtgctttgttctgatgaatatctttcaaagataaaaataatctttttaattctactttcagaagtaataggtactcattgtataaaagtgaaacactgtagaaatttagaatctgaaaaagaaagttcctttgtaagatctgtaatcttacaactcaaagataatgttaaaatttgattttttcccggcatataacaggcttttttcctttttaccaaaatgggatgattctgagttccctgtcacgatatataaatctactttattcctttcataaacttccatgcatttccaccacctgtccccacccacccacccacatctgtatacacacattctgcctcccttgccgttaccctgtatgaactgttcatgctcctatctaaggccatctccctggcactgggtccatctcctctcattcctgtgattgtctcttctccctctcctgcatcatcagtttcccctgtctactggattattcccaccagcgtgcaaacatgctgtcatattcttttaaaaatgcttcccttgcctacacattctcctgtagctaccatcccatctcggctttcctccaagagttgtctgtactccctgtccccgattcctcacctcccattctctctttaatccactgcacccacacagctcaaatgtggtggtcaccggtgaccaccatgctgctaaacacagtggccaattctcagtgcccttcatggccatacatgtcacagttgctctcttcctctgggtcctcccttggcttccaggaccacacactctcttagctgtcctcccatctcactggctgctccacctcaggctcctctgtttgtttccccttttctccatgacatctgaaggaagaagtgaaccaggccttctctattgggctacttctctatttaaactctctcttgggagtctccattttcatggctttaaatttcatggctcacaactctcaaatttgtattttcaccccaaactttgcccctgaatgcccatcccatatctctaagtcctatttgaaatagctctaggatgtctaacaggcatctgtctcaaacctaacacatccacaacagacctattctactcccaaacctgcctgcttatcctgcaggcttccttatcactgtaaatagccactgcattcttccaggtgctcaggagagagatctagaagttttccttgacttgtgtatattcctcacacctcacatctaatttaagcacattaatgagcttaaattctttaagctcaatcttgaaaatatatctcaccaccttcgctcttcttttgacctttttttttttttttgatacagagcttctctctgtcatccaggctagagtacagtagcacaatctcagctcactgcagcctccacctcccaagttcaagcaattctcctgcctcagcctcccttgtagctggggttacaggtgtgcaccaccacacccagataatttttgtatttttagtagagacggggtttcaccacattggtcaggctggtctcaaactcctgaccttgtgatccacccgcctcagactcccaaagtgctgggattacaggtgtaagccaccgtgcctggcctttttttttctttaagagatgaggtcttgctctgttttccaggctggatcctgggcttgagggatcctcctgcgtcagcctctcgagtagctgggaccacaggcacgagccaccgatgcctggctaaatttttacttttttgtagagatggaggtctcgccatcttgcccaggctggtctcgaactcatggactcaagcaatcctcctgcctcagcctcccaaagcccatgtctggcctgggctgtctattctgtctcactgctctatgtgtttatctttttgctgataccaccctactttgaatactgtaactttatagtgagtcttgaagttgggtaatgtgagtatgtgagtcctctgactattttttttttcagaattgttttggctaatctagtacctttgcctttctctgtaaaaaaattgttttggctaggccgggcatggtggctcacgcctgtaatcccagcactttgggaggccgaggcaggcggatcacaaggtcaggagattgaaaccatcttggctaacactgtgaaaccccatctccactaaaaatacaaaaaattagccgggcacggtggcaggcgcctgtagtcccagctacctgagaggctgaggcaggagaatggcgtgaacccgggaggtggagcttgcagcgagccgagatggcgccactgcactacagcctgggcgatagagcgcgactccatctcaaaaaaaaaaaaaattgttttggcaagtctagtacctttgcctttctatgttgcccaggctggagtgcattggctactcacaggcatgatcatggtgtattatagcctcaaactcctggcctccagcgatcttcctgtctcagctcccaagtagctcccaagtgtgcaactgagactacaggtgcaaaacacagtgccctggcttctctgtaaattttagaatcagtttgtagacagtgtctgggaggaaaaactttttatctaccctcaggtttagtctttggggacctgtgaattaaacagacgaaagatatattaacaagagaaggccaagcgtggtggcttacacccataatcccaacactctgggaggctgaggcgggaggatcacttgagtccaggaggtcgaggctgccgtgggctagcatcatgccactgcactgccccatgggcaacagagcgagacccctgtctctaaaacaaacaaaaagaagacaaaatttaatcatttattttattaacatacatatgggagttcaccagaaagactatccacattactagagatggaaactttcagctccttcccccaacctccagggaggggagtggggctagagactgggctccaaacactcttgaacaggaggttccgaaagtctggaatgatgaacgcattgatgtgctgggagggtggtgcacctggagaggacatggaagctctgttcccacctcctcctgctgtgccccgccccatgccttgccctatgcatcgcttccatttggttgatcctagttgtatcctttataataaactggaaaatgtaaataaggtgctgtcctgagttctgtgagtcactctagtaaattattgaacctgaagggggtgagtgggaacctctgaatttgtagtaggcccaacaaaaatgtgggtagctggggcacctcatttgtgcaggcatctaaagtgggggcggtcttgtgggactcagtccttaacttttgttcagggtctgtgctaactctgggtagttagtgtcagaactgaatagaattttcagaggtccagttgatctcagataattgaacaattgatgtggaaaaatgacacgtatctggtgccagagataaagaccgcaccacacatttggtgtcagaaatagtgtcaaagataagacatcacaggaagtcactggtattagcacagtgttatacatacagacttcaataaatataagaatcataaactacaaataggaaaaaagaaattaagaaatatgtgagccgggcatggtggctcacgcctgtaatcccagcactttgggaggccaaggtgggcagatcacgaggtcaggagatcgagaccatcctggcgaacatggtgaaaccccatgtctactaaaaatgcaaaaaattagctgggcatggtggcgggcgcctgtagtcccagctactcgggaggctgaggcaggagaatgacgtgaacccgggaggcggagcttgcagtgagccaagatggagccacgactccagcctgggcaacagagcgagactccgtctcaaaaaaaaaaaaaaagaaaaatgctttgaggtggaacaaaaggcataatgggagacaacaaggcctttcagaggtataaactcaaaggaaagttctagattgggtcacacaggcctgggccccttactaagtcaaggacctgaaggctgaggaggccttggccaggcaaagactcgggaggcagaggtagagggagcaaaacagtgtccagggagaggagccagcccatgcaaagacctggaggaaggaaagggacacaggcttccagacagcagatcccagagaagctgccaggagtagcaggagtggaggagaagctgcttcaggcacatcctgaaggccaaggtgagggtgtggagatggtgttgtctctagggaggcagacactttgtcccctctgctgtgtccctagcatctagcacagtacacactgtagatgtcagtatcttggagatcttttcatatccacacatatgaatgtggtatttttaatgtttgcatagtattcagaactagaactgtacatttcctgcttaaccagccccctctggatgcagattgaggtcccctctaattttgggggaaccataggttttaataaacatcctcacattttgaattccgctccccctgagccccatcttcctcacacaaggagggatgattggatttttgctttgtccccttctgctgtccttctgtcttccaaacaagcatccttttgctattcacagctctcctttggacactgtgagaccatactcccctcaaggccccttcccccagactgatcatgccacccctttacaatcatcctattcagggatatacaataaacatttgtatggtaaaggcaactcatactgattgccagtgaacatctgaaatacttaggactgacatgtgtaatctaacccagccaggctctgatttacattagggcatctcactgtaagtagcttgtggcactagtgcaaggaagaacagccctcacctccaccccatgctctaactgtgctgaactatttagcttcccgaaagccccaagcttgcctctgtcctcccagctttctttgcagtgctttctttctgtctggaatgcttttcttctcctctcatttacctgcctagcaccatctggttcttcaggtctcagtttagaagagccactccctccaggaagtcttccctgaacactcccctccagcctgggttaagagctgcaggagtgccctgaatttcttgtagcacatatctcattttgttataattgcctttttaaattttattattattattattattttttttttttttttttttttttggagacggagtttcactcttgttgcccaggctggatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtaattgcctttttattttttaggccaggcatggtggcttaatgtctgtaatactagcactttgggaggctgaggcaggaggatcacttgagctcaggagtttgagaccagcctaggtaatatagtgagaccctgtctctatttaaaaaaaaaaaaaattggggccaggcatggtggctcatgcctgtaatcccagcactttgggaggtcgaggcgggcggatcacctgcggtagggagttcaagaccagcctgaccaacatggagaaacctcgtctctactaaaaatacaaaattagctgggcgtggtggcgcatgcctgtaatcccagctactcaggaagccgaggcaggagaatcacttgaacctgggggtggaggttgcagtgagcaaagattgtgccattgcactctagcctgggcaacaagagtgaaactccttctcaaaaaaaaaaacaacaacaaaaaaaaaaacttttggccgggtgcagtggctcaagcctgtaatcccagcactttgggaggccgacatgggtggatcacctgaggctaagagtttgaaaccagcctggccaacatggcttaaccctgtccctactaaaaatacaaaaaaaaattagccaggcatggtggcgtatgcctgtaatctcagctactgaggcaggagaatcacttgaacccaggaggcggaggctgcagtgagctgacatcgcaccattgcactccagcctgggcaacaagagcgaaactctgtctcagaaaaaaaaatatatatatatttttactttatttttcagagacggggtcttgctctgtcacccaggctggagtacagtggcgagaccctagttcaaagcagcctccaactcctggcctcaagccatcctcccgcttctacctccagagtagctgggactacaggtgcacaccatcacacccagctttttttatttatttatttatttttatttatttattttttttgtagagacgggatctactaggtttcctaggctggtctggaactcctgggctcaagcgagttcccagagtgctgggattacaggcatgagccaccacgcctgactgtaattgcctttttagttgtctgtgaatggtgtgagggcagggttgagtcttactgttgtatcccgagcaccagtgcccagcacagagccaggctcaatgttctatggctcgataaatgtgggttgaatacatgaacaaatgttgagcagacaaggagtgaagccaccaccaaagtcccagatgccatgtacataaccctgggctcttaaagctggggtccaagcatagcactagataaaaaaaacctgctcttggctgggcgtggtaactcacacctgtaatcccaggattttgggaagccaagacaggtggatcacttgaggtcaggagttcgagaccagcctggccaacatggtgaaacccaatctctactaaaaatacaaaattatccaagtgtggtggcaggtgcctgtaatcccagttacttgggaagttgaggcaggagaatcgcttgaacctaggaggcagaggttgcagtgagccaagatcgtgccactgcactccagcctgggcaacagagcgagactccgtctcaaaaaaaaaaacaaaaaaaacaaaacaaaaaacaaagtccgggcgcggtggctcatgcctgtaatcccagcactttgggaggccaaggcgggcggaccacctgaggttgggagttcgagaccagcctgaccaacatggagaaatcccatctctactaaaaaatacagaattagccaggtgtggtggtgcatgcctgtaatcccagctactcaggaggctgaggcaggaaaatcgcttgaacctgggaggcggaggttgcagtgagccgagatcgcaccactgcactccagcctgggtgacaagagcgaaactctgtctcaaaaaacaaacaaaaaaaccccccaaacatccgctgtccttctagcaccttcaaggagtgtgtcacaacaagacagactggcagcccatgagaaggatggaattacaaaagaaactggtccccagctgcctagcaaggaatgtctgtcaatgtgacattcacagaagccctgcacatgtgctggctgagggggagagccagcctcaggcagacagaaggaagttcagccactgggcatgtgttagcatgggggatgtgtagcctagaagcttcctggctttcagttattattatttttttttaacttaaaaaaaaaaaactccagataattcccatacttgttttttacctttaaggaatgtatttgccttggaggtgccattactgaattatattgacgcagttcattaaaaatctgcttagtataaaactgacttgggtctaaaaaaattaggattctactaaataaatgcatccttttttgttgcattgaaaaacattcttagtactgttattaatcttttcacacccccctaccctttgcttgtgtttctgatttactctgctgtgaagaaagttttcaaggtttgttacagtggaaaatgttttggaaaaagttctgggttgagggtaaggaatttagagcttaggaaatgaaatttggtgaacctgatgagctcatttgccattttgtacctcagttccacttttctggagctagaataactgttctttatatactagttaataaaatcaacaggtgtttactaagcacttactatgtgccagtaccatagggctgtaaagggaagtgattggtctcagtgtttcttggccttttttgggggaatgggggagtacagcttatagacctttgagaatgataaattcctacgctgtcctgtatggtagccactagccacatttggctattacaattaaagttaattattgttaaatataatttaagaagttggtttctcagttgcagtagccacattttaagtgctcaatagctacatgtaaccaatggctaccacatagaactcaaatatagaatgttttcatcatcctagaaagttctgtgggacagtgctacatggagattctccccagaataaaaacacttttctgcccacatacaatattttgcatacaactgttacaactttgcaggatcagggtcaggaggtggaggttgagggggcagggaggcaggagttcactgatcccagaagcccattaatccaagaaaaggaagccctgatataaaaagctgtttgaagactccatcacagaatttaacaagttagtaaaaataaagcaaccgagctgctacaaatacagtatgttcacttgaagtaacttcatataaaatcaagcccttgtgttcccacctgtttgggcatattcaaagaaaacaccagttcattatctaaaagttattgaaaaataatgttaaagattttttgcagtctctgaaaaaaacaccagaggggaattatattcacaatatactgcaaatcttgaattatctttcccatttttctcttctcatcctcccacacttgacacttgctttcctaaagctcacccccaattccaaactctcttccaaacctcctagttctgctgctgtttctcttcttcctcccctgcatggctcagttctttattatgtagctttccagaatatgttttattttactccatcacacaagtacagtggtagagaatgacagagaaagctcccagggtgctgtgaccaggaacacgtttcccagtgactcattccatagctctcctgccaggcgggaccagttcctcatcttctcagatggtctactcccccatcacttcctctctgcccactgatacctagggccaaggtctgggaggagctcatgactgagcctgacagagaggaaaatattttgctgggatgccagaggggactgatgtcacagagaaaaggagaaaaccagatgggcaggtttgcagcatgttttatgcctggcgttgttggttttttgtttgttttaaatttttatttcaataggtttttggggaacaggtggtgtttggttatatggataagttctttaagttatttagtggtgatttctgagattttcatgcactcatcacccgagctgttgttggttttgggatttttttttttttttatgttgtttttttcagttgggcactgccctacactctggtggagaataaatggcttgctgtgggaactgcattaattcttaatagtctgccaacatcaaaggcttcttttcagtttggtgaaaagaaggacaagcccatttctgtaacaggatctcactctgtcgcccaggctggagtgcagcggtgcaatattggctcactgcaacctctgcctcctgggcttaagtgattctcccccctcagcctcccaagtagctgggactatgggtgtgtgccaccatgcccagctaatttttgtattttttgtagagacggggttttaacatgttgcccaggctggtggtgcctcagctccttctctcttcttccctgcttgaactccttgccccagtcacaccagtagggattttccctggtctgctactctctctcctatttgggtgatttctcatggtgtccttttttatgttttgagacagagtctcactctgttgcccaggctggagtgcagtggtgcaatcatggctaactacagcttcaacctcccaggctcaagcagtcctcccacctcagcctcttaagtagctgggactgtcaggtgccgtggctaatgcctgtaatcccagcactttgggaggccgagatgggcggatcacttgagctcaagagttcgagatcaagtagctgagaccacaggtgcacgttaccatgcctagataattttttaatttttttttttttttttttttgagacagagtctcggtgttgaccaggctggagttcagtggcgcaatctcggctcactgcaacctctgcctcccgggttcaagcaattctcctgcctcagcctccaaagtagctgggattacaggtgtgcgccaccacctccgactaatttttgtgtttttagtaaagatgaggttttgccatgttgaccaggctggtctcgaactcctgacttcaagtgatccacccaccttgacctccccaaagtgctgggattacaggcatgagccactgggcctggcaatttttaagttttttgtagagataggggtctcactacattgcctagcctggtctcaaactcctggactcaagccatcctcctgcctcagcctcccaaagtgctgggattactgccactgcactcagcagtcatgccctcatttttgtctgaaatgcccttccctcttccccctggttaactcctactggttcttcaagactctaaacatctcctcccagaagccttccttagaatctctaagactgtggtaggtgaccctccgatgtagtctcaagcagcttatccttatcacaactgtactctacatgaccgaatagcaacctatatacacaactcaaggacagagctgtattattgcatgccctgggcctcatacaggacctaaatcataaataatgttgaatatctagatgaacaaaaagtttaaaaggtgtccctgcctagagtctctggccttagcagagaatggaacctatgaaccctttgaacatgaagtcataattgtggtctcatttgtgttctaactgcaaaggtcagtacaggaataaagggggtttcatggatgatcataaatgcctcctaaggatttagctgtgctctatctaatccaagaagcctgtactaaccacatccctacattttctgctgggtaactgaactcctttggagattgtatgctgcaggacattgcacaattaaagctgaattattattatttgcaagcagttttccacctacagtcctattgagtcacttagctgactctatttctctctccctaggagactgcccaattgtctccaacagcacttttttttccttttttgtctttccaggcaacaatcacataggagtggtaggactcagagaatggtattaatacacctaagcacaccacccaaaatgagaaggcatctggactttcggatgcctataggatatgtaagctcctataaggctgcacacttagactcgagatcatatttggccagggctctttcctgcttgtctagagaacagctagatgctttacataatccagaatacaacagatagttataatggttttattttaggaatcatttattatgttttattccaattataaaagtagtgcatgctaattacaatttgagaaatacagaaaagcataaataaaaacatagaaatcactgccatcaagagatatctccacaaccacaacatttggaaagctttttctattttttttttgttacaagcagcaaatacactatatatgtgtatacattaaacaccactttcaattcactttaactgtaaattactgtgactttaatatctctgtcatattaaaaacatgacttaataattgtgtaacattcaaagttaatgtgttgagccactcccttattatcaagtttaatttttttaattgcacagaatgcaatgataaatatacacatgtaatttattatgagaatctcttgcttatttccgtctgataaaaatcctacaagcagctgggcgcggtggctcacgcctgtattcccagcactttgggaggctgaggcaggcggatcacgaggtcaggagattgagatcatcctggctaacacggtgaaaccctgtctctactaaaaatataaaaaaatcagccgggcgtggtggcaggcacctgtagtcccagctactcaggaggctgaggcgggagaatggcatgaacctgggaggcggagcttgcagtgagccgagatcacgccactgcactgcagcctgggtgacagtgtaagactccgtctcaaaacaaacaaacaaaaaatcctacaagcagaattacaagatcgaagggtatatgtatattatgaaagcctgatgtatactatcaacttgtattccaaaaaagatatacactcagtagtatatgtgggtgtctagtctttggtttgttttgattttaaaatgctcagatggtataatgagaaatcaactaccttctgattaaatgtgtggttttagtccctttttttgtttgtttttgttttgtcttgtttttgagacagagtctccctctgtcacccaggctggaggagtgcagtggcacaatctcggctcactgcaacctctgcctcccagattcaagcgattctcgtgcctcatcctcccaagcagctgggactacaggcgtgccaccaagcttggctaatttttttttttttttgtatttttagtaggggggcgggtcttgccatgttggccaggctggtcttgaactcctggcctcaagtgatccacccacctcagcctcctaaagtgctgggattacaggcatgagccaccacgcccagccaggtttcatttttaatatgaaaaatctttatttatttttgagacagtctcactctgtcacccaggctgaagtgcagtggcatgatctcggctcactgcaaccttcgcctcccgggctcaagcaattctcctgcctcagcctcccgcgtaactgggattataggaacacgccaccacgcccagctaatttttgtatttttagtagaaacggggtttccccatgttgcccaggctagtctcgaactactgacctcaagtgatcctcccgccttggcctctcaaagtgttgggattacaggcgtgagccaccgcacccagcctgaacaatctttaggttaggagtattccagccgggcgccgggctcaagccggtaatccaacactttgggaggccaaggctggaggatcggttgagcccaggagttcgagaccagcctctctacaaaaaaaatagaaaataaactagctggacgcagcgcagacccctcacggcgccccgaggtgggaggatcacctgagtccagcgagatcgagactgcagtgagccgtgttcgcgccattgcactccagcctgagcaacagaataagaccctgtatcaaaaacaaacaaaaagtcttctggtgcaaggcctcactgtaaggtccctgggttcaatgctccgcgttctgggatgtgaatgtggaaaagtaagtgccaaggtgggtgtctacctgagctccataaggactcagtacttaggatgggagcatggctctgggttccattcctgacccctctgtggcctcagactctgcccgggagaggatgaaaagcacaagtcggatgcactctatagtgatcgctgtgatactcattaagagtcttactccctcgactccgacaaactcaaggccaagctatggagtccatctcatgctgacaccgtcagttctgagcaactgtaaaatggggacagggtggcccgggggcctactgacctgaggtgggggccgcgacagcccggccgctgcggggtcagcctgcggtctccgcctgactccagctctcctgcgccccgcaggccctgggcgctacccacgtcagtgagtgctcacaagtctgtgaggtaggcggcgccacagagagaaactgaggcgcgggagcccaagccacttgtccagcgcctcagccgagcgcgaaccgcgctcggggatggcatccacacggcccggccccaggctctccctgtcagcgcccgaaggcccttcgcacctccagggggcgccggcctgcgcgcacgcgcaatggtcgcagccgcgttctctttaagaggactccttttgcctccgccgaccccttcgcttccgctccgcgttcccacaatgcagtgcggctgagcgcctcggagcccgcggggacgctgcggggggacccgtgctgaggcggcggcggcgacgtgggctgcggcgggcccgcggcgtcgggcggtgcggatgtcgggctgggcggacgagcgcggcggcgagggcgacgggcgcatctacgtggggaaccttccgaccgacgtgcgcgagaaggacttggaggacctgttctacaagtacggccgcatccgcgagatcgagctcaagaaccggcacggcctcgtgcccttcgccttcgtgcgcttcgaggacccccggtgaggcccccgcgcccctgccctctcctcctcggtgcctgaggcccccgccttccctgctgtcccctcccccagggctcccctccccccggcctcccctccccccgcctccgcgcagacccctcacggcgccccctcacgggtggaggatgaggcagcctctcctcgcaggcccgggccgtccttcgcgccgtcgtcacttcctttatttttattattccaatattttacttagaaacccaaaagctgagcctttggagggcccaagcccgcctgcaccggcctcggggggtccaaatgagccttgtccgcctcctgcctggggcagcaccgtagggggaagcggccgcggggcagcgcgggggtcgccgttcgcccttcccgctcgcctctcccccggcccgtgctcgccgtggctggagagcaagctgcagggtcgcggatgccgctggaggtcgtggagggatctctggtggaatagctcgccgttcgcgcgccccgccccgcaggccagggcccgggctttgtaaagggatcacggattcgggaaaacttctaaaacagccggagtggggctctgatttcacttccctcctttgatgagggaggcttggcgagatgctaaaggttccagggatttggaaactctagattcctaaccccgctctaaggagtgcttgtgattttgcaaacagcgtcggccctcaggccggaaaaagcccaggaactttcaaaactgtggttggtggtggttagcagctgcggcgctgacctggtcactccactccggccaaataagagcccgcaccctgttttcctagcatcatttgctcccggggaacgcggaatgttcgtagggtgtccgacctacctggggtggacgtattgatagggcaaggggagcatctgaggaagggcaggcaggaagcaccgcgaggcgttgatggctgaagagtcgactctgacagctcatccctagtatctcctcatttgcctcaaaaccggaactgggcatttttacccctaagccggagaaggctatgcctcgcttatttagtaaccgtgccattgtggtttttcaacagttgctatgggtcaagtgccatggtgtgtatttagctttttttctttccttcttatttttttagattgataaattaggggtttcaccatgttgctcaggctggtctggaactcctgagctcaggtgattctcccgtctcagcggatcaaattgttaggattacaggcgtgagcaacccgcccagcctgtatttagtatttttaacaatttatgaggtgtaggtactattttttttttttttttgagacaggtcttcactcttgttgcccaggctggagtgctgtggtgcgatcccggcccaccgcaacctccgccacctgagttcaagcgattctcccgcttcagcttcccagtagctgggattacaggcgcccgccatcatgcctggctgatttttctatgttcagcagatacggggtttctccatgttggccaggtttgtcttgaactcctaacctcaagtgatccacccacctcagcctcccaaaatgctgaggttacaggcctgagccaccacgccaggccgggatcaatggatttgaactccctcttctgtttttcgaatgcaaacttactatatgatacgctacattgtcatcttccctcattcctttcataatagaaaaactatcttttggtgtcactagatgtgaagattcaagcaaagcatttcatgtagtatcttatttaaccattacaataaccctgtgagataggcatactgttcacattagagatgtaaaaacttgattaaacacttacccagagatgactactagtaatttgcagaatagtgatttgaatgcaggctaattttatttatttattgtatttattgagatggagtctggctctgtcgtgcaggctggagtgtagcggcacagtctcagctcactgcaaccttcgcctcctgggtt
